United States Patent 7,868,149 (PLANT GENOME SEQUENCE AND USES THEREOF) - sequence listing, part 107

SEQ ID NO: 57981 - DNA, 13997 bp, Oryza sativa
cagataggctagccgtatattcactataacatgaacataatgtaaaataggtactcatatactcggaaaatatttcaataccataaatgtatatagaagagtattctaataaaagtacaaagcttacaaaagagaagagaaaagctactagagccatacccgaactcttccgaaggcttccggactcctgatttctactctattcctattccaccagctagatactaccaaactaaattgagagaaatgagagagctattgcttgaggtgtgtgagtgaagtgagaaggtaaggggtttatatagcctcccaatgacgattgtgatggttggaatggtcggaaataccctccaaccatcattgggagctaatccacatcgtccagaagaaaccctgcatccagcggcgatgagggaggttcggtcgaaccccctggttgggccgaacctggggccggcccaaccagcccatggtttggctggcggcctcctctgttattcttctccagacttttgaattttggcctagtttgtcgtgtcaattctgagttcttggcccattcatacataagtctggttctcgacatcgtccgattgatttatcgtttgtattgatgtcgattctcctccactttattgtcgttctctacaaaagattagtatacctactactagtggaatattattattctaacatatttatgcattgcaagtatcactagttctcctctattttggtaatattgacggtcgaaactgatcgataacaaccatcaacagaggccatcttgatcaagggatttaatgcatgtgcgtggcctcgaagggaggccttggactcggcctcggcctcggtctccctgcaccccgtctcgacctcgctggctgtagcatcctcaacctctgcttcccttctcctcgcgactgaagctcaggatggagaggaaggtgcccgtcacggccgtgtgcttgggggagaggtgggggagaagtttttattttatatttttcatgtgaattacatgtggaccccacatattttttttattccctccttgctgactaggatgcatcgtttgcatgattttgaacacttgacgtgtagacggcaactagacttattcccaattttattagcctactcgttcactatgggaagttggcagatccgacacatagtgatgtggaaagagtccacactgactcccttacctagtggtcggatctgactcgtatctctaaactgcaaaactagatatgatgactcccccaactattaaaactgtctaaaatgtctctctcgattgtttttaagagcggttttcactgacatggcaacaatgtggtagcccagtcatcaaataaattaaaaataataagtggagcccacatgttatcacatctctctccccttttcttcttctcggcctgatagcagcagatcactaggacgacaacggggagcgacggcggtggtggcgggacgatggacacacaatgaccagcaaaaccctctttaaatcatgccccttgacctcacccttgaaagggaacccatccaccgcttgacccaatcccttgtgccgctcctttcctcactcactaatggccgtatcgcatcaacatcacgcctcctccaccaccaccacgccaccaccgccaaatcgaacgcgagcaccaccaaaagcaacaacagcttaggtattcctccaagccatcttctctccctctattgctgctgcatcacggtagcggctctagtggttctcgccttttgttgttggtcgggccactgttgcccaaccgggtcactccattctatgggagaggcaatgaggaggatgacggcttcgacgaccacccgtgcgaggagtgtgggctggtcgaggtcatgggggaccccgacgcaatgtcgctgtgcaacctcgggctgcagaagctacagcaccgtgggaaggagggtgtcgggattgtcgccatttggggtgacgggaagctcaagtcggtcacttggctcggtcttgtcgccgacgtcggctagcatcattccccgagcccaccactattgagaacctgaggtactccaccaccaccccgcatccctacttggcggccactccgctagcagcgctgggagccggaggaaggggtcggagtgggagagagaggagagccccgccatcgtctcgttgtcgctccccgtcgtcgtcccactttttaaaatttatttgatgactgggatgccacatggacatcacatcagcaaataccactatttatactgccctgggagttaaattacacaggtttcaacagttgagggattaagatattaggtattgcggttgagggatttgaatcagattgaaccaatacttgagggagtcaatggggacttattcatagtgacgtcgggaacaaagaaatttatggactcgcgaaagaattaaaatttggcccataattaatagcattgtatcgtaaagaaaaacttaatgctatagctaatttatgaaaaaaaactttaggcttaatttaaacggttatgaaaaaaaaggtatgaagaataatttgtttactaactatactagtttaaacatgtttgaactaaatttgaaccgacatataccttttttggctatttttttattccaggcgtgttgccatgtaaacatagttaccgaacaatgtaatatgagcttgtgaaatatcattgaacttgagctgtttttttttacaagctgtggtatacgcagaagatgaaaaaaatttccaaaaaagaacattttcaattcgagctgaatttggatatttcaaattctgaagcccgggcaccatcagaccccaattccgcgtccgatataaatacgtatatgtaaatcaccgaaatatgcagatttggctcagaaatcaaattagagatcagcaatttataaaacctccgtagtccgtatcaacatttcggcaactgagcacaatcaaagtctgtcctgttgataattctctgttaatagcaaagctttggcctcttttttaaaaaagaaaataaaagagataatgctctaatgtggtcctcctcatgattgtggacaacacgacagtttcttgaagcagctctgagaaaaatgtattgctgtcttctttttattagccaagctgttggcatcgttgacgatcaatacaagagcacttaatctctctgtgtgatgcgaaagttcatggcaaccattagccaacacagaaaaagctgggtgagagttgagttccgactactttagttgagttccgagagagcattttcagttaggtaatctgccacgcaaaattactctgataaaaacaatttcgacacctccaatttgttaattaaagggatcagtagtatcagactgggatcttgttgctgacattgtctgttcgttgttgatgcagcacttgagaaagatccaggcatggagagcatcagcaaatttgccacggcagcgcatgcgaagaaagattcagaagatgtgtctgaatttcatatcgctcctagtaccttctgctgacgaaattacagatgacaaaccattgtcttgagaaagtcaatgtcatcttctatctttttcgccaaaatgtgagctaaccctaagtagttggagagctcccatctatcactattagaatacctcgtgtgtcccactctgaaggtgcatgctttaagttttacttcatcaaaatatgatacaatcgctaataagaaactgttgataaatttgcaatctttgacgcagaatcgagtcaatcaaccaatcatacattcacactagtataaagtattcatttatatatattatatgcacacatggagaagtacatgatgaaatcggaaaataaattagtgggcctcatctgtttgcttatgcttatgcttatcaaccaaaatttgaattttcaaccttaaatttggagctgattttagggttttttcatcaaagtttttatttttcagcttttgcttttaaatcgccaaaaacacgtacataaaaattttattcataaattacttttcgtttgcaaatataccatttgatttattccacgaataggcgaaacaataggattggtcaaggtttcggctggttttcttaggatgcttgcttttttacccctgcaaaaaaccaaaatatatttctacgaatttttcatgaccactccattgcatcataatatttgatgagggattcacagaagcaccactcaagagtgtaaagcaccatccctactcccaaataaatggccttggcccattgctttccaccttgaatatcatagcgtcatagcaggcatattaatattattgaaaaaacggtggcaaatttgcaaatgcccctaatattattgagacaataaactagaattctagaaacaccagatttccagagaaaaagaaaaacaaatccatggatatattgcactgatgagtgatgactagactacaaataggattgctttgaaatgcaacgaagcaaggctctcatacctgccaacttggaaacaactacttcatagttggctcgtacctgctactcctacgtgccaactgtagtttactactaacaaacttggaaacaataaatattgtttgcgtccattatccgacgattcagatctcttctgaattataaatttataagctataaccattatttgtgccatatatttttctaaaacaaaaggcagggctttaatcgtgcaactacctcacaagcatgcactaccttaaatttctagttttttttttttgcaatctcgagttgtgtgtaccacagatgtaatttactttttttcgcatgtccatatcagcatgaaacttgagttagggaaagggtaaggtgaaaagctcctttcaaccaaccaatatattcatgatacatgatgctttcattaaagtgctacaaataaagggagatgtctttgctattaatagtcttgtaatttacttcctcctttcataaaagttacacatattatttttatcaccaaaactaataaaaaattaacttatattatatgtaacaaagataagtagtgtatgtacacatgtaactaatgagtattaagatgattcctcgagttctgatcaaatatttaatttagctctacattcaagtttagaatatataaagattacaaatagaaacaacttattttaaaaaattaaactatgaaatatgcctaattgttgtggatggagggagtatattttgttaatggaaaggaccaagtattatggtggtatcgaaaaggtgtggtgggtcgatatgttgtccattacaatattgttgtgttgcccttcctaaaagaatacattaagaggagttttgatctgttgaggcaaattgccatatcatcatggcaatggtagagacagaaaaagaatctataaaagttagttggcataagcacaagaaaaaaacaatgcccctctaattaatagtcatcattccctttgtcatttgaaataggaaggttggtgataacatgagaaacgatagtgacaccaaggacgaagactagggtgagaatggtgttgaaaattagcctcaagactagggctgtcaacaagtcaagcttgagcgagctcgatataagctcaagccaagcctataaaatgttcgagctgtctagcaggctcggctcgagctcgatcaaaagctcgagctcgactaccgagcatgatttttaattaaaacgatatatatttcaaggataatatttaaaaataataattaatttatattttatcgtattaatagaataggaaaaaagaataaaataaatactccctctattccataatataaggcacaaccacttttctagatgtttcataatataagacatgcgcatgtaggcaattaactatgaccccttcttcattatattattactttttaaaatcctccactctcatgttctctaattctattggatgcatgcattgtatttattaggatgatccaaactacaagatgataataattattttcttggtctttggattaagggtggttatgccttatattttggaatggatggagtatatgatatcaatacaagacatacaaataacatatttgatcttctaatttattaaataacaacaaaaaaatcatatattattagactcgttgtaagcttgagctcgactcgacaaagcttacgagcttagggagaggctcagattcggctcgtctagagctcgaatcaagcctagaacaagtcgagctcgagcagctcacgagcctcgaggttttttttttacagccctactcaagacaatggtgtggggtgaaaatgggtgcgagcttgatgctgcaggtttaccagttcatttcccatattctgtcggtcccttggttgagccatcacagacaagatcttgtttttgaaaatgaggaaggaaaaaatcaggaggaaaacagaggatgaagggttttttttggaacttttcttgataatcattttttatgatgagggggtgagggtactttcaggattggttattttagataatggaagaattttattgtacgctaaaattacacacggtctctacatctacaatacatagccaagaaaaaaaaacaaagataaataaaatgaaaaaaacctaagacacacacacgaacacatcatgttgtcttgtattatctcttttctaaaatataagcaatttttttacatatttcctgaaatatacctggatatatctccgtccagatatacagtgtgcaaaaataattatattttacaacagagagactaataactaactcatgaacaatcaacaaaagagctagacacgtgctctggaacaacaccttttaagaaggacacggtgtttgtccaacattatcatccaaaaatagatcgagattttcacctaaaggcctggtttagttcccaaatttttttcccaaaaacatcacatcaaatctttggacatatacatgaagcattatatatagattaaaaaaactaattgcacagttagggggggaaatcgcgagacccatcttatgagcctaattagtccataattagccataagtgctacagtaacccacatatgctaatgacagattaattgcttaaaagattcgtctcacggtttccaggcgagttatgaaattagctttttcattcgtgtccggaaaccccttccgacatccggtcaaacatccgatgtgacacccaaaaaatttcttttcgcgaactttaacaaggaaataacaaacaatcgatgacgttggatgacgctgttagggttgtctattggatcacctaggtttagatctagtcaggtagaacactttggatggatgaacaacaatagatgaattaacaaagagggagtgagagggtttagggatgtgatcggtcgatgttgaggaggaggaagtgcggccggccatcgtcgttgtcgtcgcaggcttgacgtggacggcggtgacggtgaactcggtgccgatggcggtgattgcagcggcggtgtcgacgacgaggcgtggcgcggcggtggcatgttcctatcactagctgcgccccctcgatcggttagggtttatggggtgaagtggcggcggcgacgaacctcgtgtcttgtgttgtcccgtcatccacccctctttatatggcgcagggtgatggggcccaccagccattgggctgggcgcccccgatcagggcgcgggtcaaggcccctttgagccgttgggctcaaggggagggagatccatctaacattctcccccttgatctcactatttcttttagctttttctattccatcacagatttatatatagagcatgattcatcgtcacggttaattactgatggattcgacagccactatacacatctctattcactatacacatctctattcagaaacagatactttaacttttgggccctatagtccaggattcattaggcttcccttaaacccatgcatgctacatgttccttgaacatgttgggaggtaggcctttcatgagcggatccgcgagcatcctttctgttctaatgtgctcgagactgattgtttgatcccggactttgtctttcacaacatagtactttatgtcaatgtgtttggcagcaccacttgactgattgttgtgagagtacattactgtgggttcgctatcgcagtataactttagttgtttctcaatactgtcaaccacctttaaaccgggtgtgaatttctttagccagttcacctgccccgttgcctcatagcatgctataaactcggtatacatagtagaccctgcagtggtgtcgggtctcggaactaacaacttggatccgacataaattaatgtatcaatccctggatcagtagatatcgatacatacaatataaccggttcttcattgcatacgataaagttttacaatactaagggttttacaataataggtactcatctaattgatcaactagaattaatacacagcggaagtttttatacattctgactagggaggtataacctttaaggattctctaaattatcggggtcatcgtagtaatagtcataagggtcctcttaacccagatctgaaaaaggggttatgagagcaagaacgagtattcacaatactcagcaagttatcatgaaaatatgttatgcattggcatatagtagggttctttgcaaaaagtagaaataaacaatctggaagagttatagcaagaatttataaacatatagactttagatttctaaccagggtaccatatgaatcccggtactcaactccatgagtacggctattcgaatagtttcaaggatattctactgcagcagatgtacgctttacccacagtccacgacttgctgataatcatcggctttagtcatagctcagtattaagttattaacaattgtggcacctattccataaacttatatcctcatatgccctgaacgtattgttaacagcagcaagaggagttctggcgttcccgaggtatttaaggggaactgatcgtatgacaccacgtcatctcgatcagggtttagaaatataccatatagtttatactcgagtatcacaaaccatttacttgtacatggtaatggttaaagttgcccttcgcggctatagttgcctcctacgcgaggacttaaaaataagaaccactatacagaggtgccatattgctaattaacataataactaggtctgtccccattctagaaactgcggtcgtactcgttcgttcgacataagtacctggtaaaaactatattgatcgagacagtactagccacacggaaatcaaccaaatcttacgtactaccccaatctaagtataaggtatttaaaccagattgtaagcaaagtaagcaacactaaattatctgggtttctatggttgatttatgcatataaaatagaatattgaatagaaggctataaataaataatttgtaaaaaataggcttaaatgatcaaaaggtatatggtaacttgccttgctcgatgtcctgagattgattgatattatctaatgtgtcagaagaatcctcaagacctagggttaagcatataaaattcaaattcaaaaggaattcaaataaaatccaaaaataagaaaaatagagaaaataaaataaaatagaaaaataacaaaaaggggctcaaaagatagagaatgattttagaagaatattggtccaagtttcactggaattggatttatattttaaaagatatgggcttctaaagtttgaaaatcaattaaatgtgaaatgttactatgtgcgggtcccacctgtcagtctctctctcttctcttcttcaacctccggccgatccccaaatgcagccggcggcgctagggtttgggattgcggcggtgctagagggggaaaggggttgcggccgaggaggggagggagctagggttctccggcgacggcgagcggcctagcggctagggcggcggtgacatggttaggccgtgaaggcgattgggattatgtgagttagatatggctaggggaggggttctagagcatctacggagtgcctagatggattccaacagcttgccgacctttggcaaggcacggagaatacttgccgacgagcgcctccattggcggcggccgtgctcacgtcggcagcccagagggtggcatgctagtgcaaaccgattgcaaaaatggactctaggtagtatgtagatggttgaaacgaaagaactcaccgagatcggttgaaacgacggattgcggccggaaaaacttcgtggcggtgaagaacagagcaacgcgggagaggcggtgctcggtttggtgcggcgaggtaaaactcgacgcagggcttcggttagggtctactatactagaacatggttgatataaggtgttctaagggatatttagggcggaggatggatggaggggtgtggtgtcgatcgcgcacaaggtgttcgaccgacgggcgaaagtgattgatgagatggattggtgaagcagagcttcggggttgtgggactatggttgttgatgatcgatgatgaacaaggaagggattgaggtcctatttgtagggctagaaggagtagatgagctcgggcaccgtcatcgccatggatgagctcgaactttagatatggctggggcggcaagggctgtgagagggcggccaagataaatttgagtggcgggaggccacgtttgaatacttaccggtgaaagattggcttgaccgcaagtagaaacggctagcgacgtgttggcgccaatccgggcgcgacgcgcggcggcggcgagggtgaaaacggccggctcgggggtgaatgatttgaattgtgagaggggaaaccaccatctaactttaatccaagaattggtgcgattcaccctgggtagaatcaaaatcggactcggcggcggctttggatgggagcgcacggtgtcgagcggcgatttcttgcggcggttgtcatcccggctttgtcgtcatcaatattggtgcggcaatggcagtctgagggcgtcggacggctagcggcacgccaaggcgatcgggcacgcgcaagcggccccgaggcttacgcgcggcgacacggcgcgcggctaagtcggatgaccggggggcgcgcgtgaaggggaggaagaagcaaagaaatccacggtttttgagtggggtgtggccccctaggatcaattctaaactttgtaaaagattgggtagattgggctgctctaggtgggctgggcatttcatcaagcaccttgtgtgcaatgaacagtgttttcaggaatttttgaaaatttccctagaaaagatttgaatttaaactatgaatttggaagggtttcactagggtttggagtaaagaaaatcctcactaatattagggtaaactaaagaaataatctatagtttgaaatttgagagaatttgctcaaattcactaaggtttggaataaaggaaataattagggtaaattggcaaggttctaaggaagtaacacttgaaccaattaaggatcaaatagattttttttaaaacacactaatttaatcaaaagccagcatgatgcagtcaaattttagtttaaaatttgaggatgttacaagtggtgatctgttttgagcttttccatgaaatagctcctactgccagggtgaacacatatcccgatgttgactttgtattatcttttgcaaagttagaatctgaataccccactatctggagcgattctgattttctgtaagacagcatgaggccttttgttccttgcaaataacgcaagactttctttactaattccagtgctctaggcctggattactttgaaatctgccaagtatcccggtaacaaatgccaagtcaggtcgtgtgcacacttgcgcgtactgtaggattcctacagctgacgcatatggctttattttcatttcattgagctcatactgatttttgggacattgcgatgccccatactttttgcctttgactataggagcaggtgtagcactgcatctgtacatattgaatttcttcaacacattttctatatatgccttttgagaaagtcccaatgcatactttgttctatctcggtgaatctctatgctcaaaacatatgaagcctcacagaggtctttcatgtcaaagtttgaggacaagaatttctttgtttcctgcaatagactgacatcactactagttagtagaacgtcatctacatacagaattaggaaaataaatctactatttttaaactttgaataaatacagttgtcctcgacattctcttgaaaacccaaaatttctttattgtcccatcaaacttcaagtaccattgtctcgaagcatgttctaatccataaatggatctctttagacggcatcccgtattttcgtttcttttcatgacaaaacctttcggttgcaccatgtatacttttcctccaaatctctatttagaaattccctttttacatccttctgatgtaattccaaatcataatgtgccaccagtgccattataatcctgaaggaatctttacaagagactggagaaaatgtctcattgtaatcaatcccttctctttgcgtgaagccttttgccacaagtcgcgctttaaacttttctatattccctctgcagtcatatttggtttcgtagacccatttacagccaactattttgacacctttaggaatttcttctaaaatcccagacaccatttaatttcattgatttcatttcatctttcatggcttccaaccattcagatgagcgagcgcttctcatggcctcttcatatgaggtgggatcatcctccatatgcgactcttctatattataacttcatagtcatcacggattgccgatcttctgactctttcagaccttctaggggcctcctcatttggcacattatctgtttgaggctgttgcagctcctcctctggtgtggcaataatttctgttgaatcctgtaaaacaggttcctcactttcattcattgttgccacaggagagataacaataggtgttggtaccgcaacatcatgcattgcaggcacaacatcagcaggtagagagaagaaaggttcctgagtcaagggagcgggtacagacacccgcctctcctcaagatcaatttctcgtactaccgagctcccccctaatcatttccatctcgtttctacaaactttgtttaactgtttggacagtagaaatgataaccctttgatctttcaggatagccaataaaatggcagcttactttttgggatccaatttcccaatatttgggttaaatactttagcctctgcaggactcccccacacaaggaggatccatagctcatacagtgttttgggcaccgatgcattctatgcattgtatgcatggttccaaaactgagaactccaatggaggaagaattacattcttaaccagtctctcaatcctccccctcgaaatatggcctaaacgacagtgccataattttgatgagacatcaggaattcgctttctttttcttttgtcaacaaggacacaacattcacattctcagaaagagataacaaataaagctgatcttgcaacacaacaagaccaatacatgcattattataccatagttcacatttgccatttccaaaatggcaatcatatctatcaaaatccaatttggatacacttattaagtttctttgcaaagaacggacataaaacatctcgaagtaaaagtgtgaagccattcgcgagctctaggagaagatctccaatagcttcaacttttgcttcaactccatttgcaactctaatggatctttcgcttctttgcgtagtcctcatcgaacagaatccctttaaacaattacatatatgaatagttgctctagaataaatccaccatgtagatctagaataaccaatcataatgag

SEQ ID NO: 57982 - DNA, 1163 bp, Oryza sativa
  unsure (1)..(1163): unsure at all n locations
ttttactttaacttggaagccatgttgctcatcctaagaatgtggtcttttacaccacctccatggtaccactctgttacaagctgctttatgagctgtgtcgcataaaactttgaagaaccagtaaacttgctctttatacttttgaggtacatagagacagtgtcatactctaggaatgagcccaatatgcttggctcaatcgtgttctttaccgcagccaaacagttcttgttggctaaggaccatttcgcatgttcaatttcatacgacatgatgagggaagcattgtccctctctctcttttgccgttccgcatttgactcattttcacctctgaaaagttcagcaggttctataggacatggggtagtcaacacccagtccacctctcccaagataaaagcaaggtcgagttctcttttccattctcgtagttatctcctgttagggtcggaatatcttttatgtaacccatcaaggagtagccaccagcaggttctataggacatggggtagtcaacacccagtccacctctcccaagataaaagcaaggtcgagttctcttttccattctctgtagttatctcctgttagggtcggaatatcttttatgtaacccatcaaggagtagccacctgagataatcatgtattgtgagaacaaaattaacaataaaaaatattatgtattaagtctacatcaccattgggcagaaaatagacataacacatagagccataactataacattgcaattatcaatgttggtccgaaaattacaacatcatagcatatagttaatgttcctaaaattaaaatctcccgttgattcgaaatttaattttagaaacactaattttcatcaatttcatctatttgcagcggaagatctatatacaattcatataaacaataaaaaaactctattatttactctgtaaaaattctcccgttggttcaaatttaaacagaggtaaaacatgcaaaaacaattcaaattctattgtaatttgcatgaaaatatacaaaatacatgttcggaagcatttctcacatttatctattctctaaacaattttcacattggttcaaaatgcttagaaataaacacaatcattaaacatattgannnnnnnnnnnnnnnnnnnnnnnnnnnnnn

SEQ ID NO: 57983 - DNA, 2116 bp, Oryza sativa
gggggagaggtgcaagagaagttttgcttttatatttttttgtgtgacttacatgtgggcctcacatattttttttattctctcgttactgactaggatgacacgtcagtgaaaccactctgcatactgccatgggaccttctttgcacggttttgaacacataaagggtagaaatttctgatatcggggattagggatgtcatacagattcgacgtaaaattgagggacagcaagtggacttattccgtaaactagtagaagcccttggccgaacgagaatatcacagtttgggccattaaagaagcccactactgctggaatacaaagccagccatcaatataactacttgggccaaacccagttaattatgtaagaaaatgtgaactccctatgggctcagatgggccatatttcctgcaccaaagctgattcataccccatgtttgactcctttggaaagtaagtccactttgacttcttcagtttcaggtgcaatctgattcataccccctaaccaaattaccaaatattttgacccatcaactattaaaccagatattttgacccatcatctattaaaaccagtgcaacataactcctttggtggttttaaaggcggttttcattgacgtgtcgaattgacttagtctctgagtctgacttgtcattacaataacaaaaataataaaaatagcatgtggacccatgggtcaggactgtttcctctctatatactccttgtttctcctctttctctatggtcgggacgacgacgatgccaacaagctagagtgggcaaggacggtcggcagtttcgacgagcacagagctaggtgccagcgtggcccgaggcggagtccgagcagctgtgatggctgatgagagggatccgcgacggggcttcacccaagacagagcgacggcctcgaggcacaacgatggtgcgccctcaagacggagcggcggcttacactgatctacagctcattgcccttgaggcgcaatggcagcacgacttgagatggagcggtggcggcacgacctcgagggaagggagctcgtcaatggcatgacctgcagggtggtgagaggttgaggagatggcgtgccggcatcactgacagcgcaatgaagtagctggagaagatgaagaaggaccccatcacccactggatcatagcattcccctccacgaagtccagcgccaccgatgccgctgcaaagcacaccaccaccgacccccttctctccctcgaccatctccgttcgtcgctacaatcccctaagtccgcccatcgctagtcattgccgcaatccactccgcctccatatcgcctcgattccctcagtccgcccatcggccatcgccgctcgctgcctgactggctgttgtgtcgcgtgtttgctagcggtccggcaccggagcgtgtccatggagtcgatggagaacttgtggaggcgagcaaacagtagagggtgtcgatggtgctgctgccccaggggcgtcgtgtggggaaaggagaaaaaggagagaataaagaggacatgacactgacacgtgggatccgcatgctgactcagccattttgactttaggtcaacatgccacgacggcaaaaaccgatctcaaaacagccgagggagtcgaattacactagtttcaatagttggagggttaggatatctggttttgcggttgggtgatacgaattagactggagctataattgagggagttaaagtggacttattcctttctaaacgaggctagaacagtattttcccgagtaaattgactttggttgaggcatgcttggattcggcctgttttggggtgtatcaggtattcgggccaaaccagcgtaaaaatttgtggtttacagcccatccaagcgtgattttgagcccatgtaagaaaagtaataggaataagtccactttgattcccttaaaaagtaacctgaatctaatccgtgaccctcaaccgcaaaaccggatagaacgactccccaaactattgaaactggtgcaatttgactcccttaacggttttggatagtggtttcgctgacgtggtgcttacgtggtagtgttgatctagcctggtcttga

SEQ ID NO: 57984 - DNA, 3415 bp, Oryza sativa
acttccaccaccgctccagctagctcccgtgtcagctcccaccggccgtcaccactccggctcccgacggcggggaggagcctcgacgacaggaacaggtcagcaacgccgaacctagtcgccttcttctgcgcctctcccagcgtctccaggaactcctcacgccaccggaagccgcactcccacatgatggcgcgcagtgtcaagtcggtcagcgtcccggtgatctgcctgctcacgtttagtgccgacagcggcggcgatggtgccaacgagcacacccgccaaagagtatccccaccgtggtgccgatggagtccctcactgtacgctcagccatagaggtcgaagcccctgggccaggcgccagaaggaggccgagctccatcctcgcctttggccatgatggtatgcatgtagcgatgcctgccttgggacgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcgaagaccgccgccatcacgcatgcggatacgccgaggtcgaggtcgatggcgatggggaagctggcgcccgcccgctgctgccgcgtcagccatcgccgccgccaccactccggctcccgcttgccgtcgccgcccttgcctgcaaattacactacgagagagaaggtgaagagaaaggggggagagaacggggagagagggaaggggaaggagagagtgaatgacatgtaggcccacatgtcagtggggcccacaatattttttatgtgtgaatcacatgtgggtccatagattttttttttaattctaatgccacgtaagcgccacgtgggacgaaaactaggtcaacattgccacgtcagcgcaacatcagcaaaaccacccatcgaaaccaccaagggagtcaaattgcactggtttcaatagtttagggagtcgttctatccggttttacggttgaggatcacatattagattcgagttacttttaatggagtcaaagtggacttattccaaagtaatattacattcatgtaatttgttctaagaaaaaaaatagggttttgaaccaggcccttattctcgacttttcactaatgtatatacccctcacgtgatggaacaagtggcaaggaagataacatcaatccaaactacaactttttctcgtttttcgttaacacgtttcctaaactattaagcagtacattttgtaataaatctattttctagttttgtaatagaataaactaaacgtactgctatatgttactccaatatagagtttcaacccctcttgggttgcaggcttgcagctgcatagcaccgctgttcggttgcaattgttttgaacaatgtttgcttgtaaaaaaaatgctgctgtagaaggcaagtgtttctgattttctggctacctgcagcctcagttgacgcttcagagtacagtacagttacagcactgctacagaacgtgcttccaaacaaacccatttctgctaatgcttttccaacaagcattgcctacatgcatatccacctactaggtacgtagcagctctcatgtcctccatttctttacttcccgaagtagcatatgtagcatccaatgcgacaaacaacactctccaattcaacgggcaagttagcgctgcatgttctagagcatatcatatgctttatactagctcgaactaaaaatgggaagaataaaatcgattttcgagaagccaccttaaaggcttaaacgatgtggtggtaaagttacagttacttcctccgtttcacaatgtaaattattctagcatttttcatattcatagattcattaacatcaatatgaatgtggaaaatgctagaataacttacattgtggaacgaagggagtacatgatttacgattatttagagtctgagtttagatcagctgtacgttggacagaaactttaggtggtacttaaaacgagataagttattagcgtatattcaatcaagtattaaaattagatttatttgatttctaggaaacttttatatataatttttttgtgctaaacatcccatttttcagctcagaaacgtgcccaaggagaatgagtaagtagtcgccgaattaccgactattccctccgcccaaaaaaaaaccaacctactattgaatgggatgtttccagtataacgaatcttgtcaatactagattggtttttttagacgaagggagtagaacttaaccgaaatgggtggtaaacaggatgcactcgttggtgtgtgcctatataagaagtacgcgcgaagtggtggcattatcctcataatcccaaaagaagaagaagaagaaaaaggttcgaagtggagctcgatcagctgctccatgcctttggtcaacccttgtcccatgcatatgctccgttttcgagcgaaatatcaccaactctaccaaaaccgatgaaatccaccagccaaacgtccaaaaaccaagcagtaccattttgcagtactgcacatcacatgctccgatctgcgtcctgaatcaccaaccaccactacaaccggctggcctttttgcctgcttgatgcagaactaaactgccttttttcatcgatctcaatcagccaaccgaactctgcaagccattcaagcgaccaggctaagtacaagaaccgtttccattatatagagagatgattaattaacaaccaagtaatgcttattttgctcggtcggtacgggaagtaacaaccgcttagccgtgttaacctcttttgcgcctgcttgcaaattaaaccaaactaatctctccatttcagattgattatcattcgatttaacattggcagtgtcttataccggttcgttggattttcttttgacaatgtttgctaccatacactcaaattttatgtaatttgctagtagaaatgacaaaaccgtgttacggctgaaaaacacctagtaatttgctgaaggatactttcaattcaattggagagggaaattcttcacaaaaacgagaatgccctagggccaaaagctttcaagctaaggcttagagtgaagatggaatatgatacatactaacgatgtatttaggatgatgataaatttagagttgtataattcccaaattttcactctaacgccatatttgaaggggaccctatttgaagtatgggttctaggggtgttcttatccttcttaagaattatctctccaattgagttcaaagtgtcctccagcaaataactagttttataatatgt

SEQ ID NO: 57985 - DNA, 23141 bp, Oryza sativa
ttttgcccctactttttataagtgaagcaaccattttgcactggttttgaccgtggttatgtgggactagaatttttgagataaacaaagggaaaggaaaattaaaaaatgattttgcaatttgtcaatgactgttatacccctggtgagtaaatcattaagcagtgtgtgaatcagattgaagccgtgtattcccggaaatgcttaccattggccgtccagccagaaataaaaaatcagatgtctcaatttaaaagaacaacagtgtaggtgcatggtgaaacagttggttaggtgtactgataagccaacggagcatgcatgcaaacatgtttcaaaatttaaatgattttttctcttaaactattagtccgaatttcaatctaattatatcattggattcgttacaattaaatctttataacaagatatcacatgactacattccgatgagttttaattttactttttaaatattgcacacattgttactgaaatgttccaaaaagcatttgttgatgtttcactaatgcattagcaatgtttcatgctgtctttttttatatgtttcagcaaatacattttttatgtttcaacaataattataattcgatgtttcaatctaaatataaaaaatgtttcactggtcgggacttaatgtttcatgtaataatgattattattgccatcaatactttttatatgttgtacctctttggaacaatttgtgaagagggttgaaacatctccacaagtgatgaaagaattatttttaaatagttcaacataagtttgttttttttctagaacacatatatatttttatcaaaatatattcatgtgagatcttgttataaattatagattgggtatatattttagaataaaatttcgtttaaagtttgattaagagagagagagaaagtaatactgcctcaggccaccttggcaaccagctctactcttgcatgcatgcatgcgacaacctcgctcctccaacgcgtccctgcatacatacagacgaggagcagcattcgatatttgaaaaaaaaaaatattgaatgttcgatttgtagcgtcctatttaaaaatatttcaacataattaagtatttgtgcaaaaatctaatggtataattgaaatttagatcagatatataattttggagaaaaatatttacaatttgaggaaaaaattaggcacgtgtaatgggagggagagggagagggagagagagtatgcaagcagcagcgcaagcaacgcatgtagggcaggcaagcaacgcagcacggaagcaacgcgggcatgcggcagtgtgggggcgagcgttgaccaacaagtaaaacattaagttatatatggtgaaacaaagaaaacaacaaccgaaacatttaaatatgtttatgaaacatggtgaatatacacgttgaaacatgttgttgtcacatatgaaataacaagtattgacggattgaaacatatgtttttcttttatcaaaatataatcatgcgatatcttgttgtaaagagttaattacaacgaatacaacggcgtgatcggatcatagattgaataagtaatttaaaagaaaaatcattttgaagcttgctaaaatacatgcatgtatgcatgcatgaggtggagagagagtagtagcagttaatttcaggaattttgtgaaacacaccgaagacacatattgaaacctatctctatcacgtatgaaacatgttattctaacggtttgaaacacatgtttttcttttgacataatataatcatgtgatattttattgtaaagatttaattgcaacgaatataacgatgtgatcggatcgtagatcggataagtaatttaggagaaaaaatatttaaagagaggagaaaagaatgaaaagaaacagctaggcacatacgttataggacagggttcattctcacatgcgcttgtttagacatccgatttttggtgtgatgccggatgtccgagccgtagcgctctccgtgtattccccatctccagtacggcctagcgagtggcggcagcggtgcaacagcagcagcaagaccaggcagccagcagggtgggcgcggcggcggcggcgacgactgcgggtcgacgcggctcaacagcgggccagcacgacggcggcgaccgttggccagcacgcaggaggcgcggcggcaaccgtgggtcggcgcggctctgctgcgggccagcgcggtggcgacaaccgttggccggtgcgcaaggaggtgcggtggcagcgtgaaggagaggcgtggccttggtcaggtggcctgttggcaaccgcgggctagcacggtccggcgcgatggggtgctcaggactgggtgagtacggttggggaagggaaggtgcaaaggggaaggttggcgcaggggctgctgggggccgacggtgcttgaggaggcacagatgcagcagggcgacggtgctagaggagatgcaagggtggctggctggcgctactggactttatggtgtttgctatagctgaaattgtgttgaaattcagtgaaatctccttgaaagtatgttgaaattttgtgaaatgaaatcttgtatatttattgctgaaatcatgttggaatcctgttgaaattttgtgatatttgtcaagctattgctgaaatctagtcattttttttataaatttcaagtatagcaaagttcacttcgaaacatttgtaaagttcagttcaaagctgaactcaaaaaagggcaaatacacaagtgggcacatatttgcataagggtatactcggcgttgtatctccgatctaacaccattagctagttttaacagaacagggggcactctgctccttcatttcaaaaaagcatgggcaaaattacaaaccctaaaaagtaatggcaaaatcacaattgaatcataaagtaagggcaagaacataattaccccaaaaacataagtcttgagatgttaaactacataaacttttaaaaattgatgataaaaaaataagtgcacaactgaaatgacaaatactgtctattccctcgatccccatcaccctaccaaacttcagttcagaaaccattcgagcgatatgatttccgtctcaaacagatcgtgcaactacgacgcatcggtaactaacaagttaaccatttccatcatcgaaaattaattaagtaacgatcaagcaatgctgatttaatttttctctgtactccatgatagaaaaggttgcatttcttttcaccgtgcaattaacatggtgagtgttgctcagtagtcagtattcagtatgaaaggacaagtaggcacgcggcataggctgggcgatgacaaaatgatcgttcatctgccacattgaatagtttgatcgatgattcgacgcaaaatgttgcagattttccgggctgattcagcatttgctaggtgattcgttgttgtcacatagacctcaagaaatttaaactttaatttgtgcatattgttgggggtaaattaattagccaagagtccacacctgcatgtgcacactgagctatattattggaccgagctaacgtgtttcggttcgtacaaattaactagctaggctgcaccactagcttacacagtaaccttctcttttccggaatcgacgggataagataacacggcaaacgccattgtttaagtacggttgttactacccttcagcactatttcactactctgaatatatatttaatttcatctcgtgattaattactgagctaatccgggctggtgattgatgagagggttggtgggaaattaaccaatcaagctagctcgaggggacgttttacctccatctttacttgtaaacatactgtatcgaggttgtagctgcggtttacggccaaaatggaagcatgtactccattttaatctctctctctctctctctaatttattgggtcacttaacccttaaacttgactcattttatcgctaaattattaaaaatgtttcattttggccgtaataacatttctttttttactcttcatataagttgcattttaagctaaaaattgttagagttatagatggtaaaatatgaattatgtagagagaaaaaaagggggaagaaatagtgtaaggggagtaaaagtgaaccattttcaatatttcaagctgtaaaatgagtaaaaatagtttaggggatcaagtgcttcgctgaaatatggattttttactttttaaaaccagaacaaataatccatgtcaacccagtagataagcttaaaaaaaatagggcaaatctagcttttgaatatgccatgccactctgaaaaagctgatccggccattcccacagaaattgcagttgtaacatcccattcccacagaaattgcagttgtaacatccataggaaccgtagtcgtaacatccttagttggatgctaaacagaaaaaataaaaagatactccctccgtactaataaagaaagttatttaggataatatttaagtgaaacattgggaatataaatcatgaataactcttaagttgttgagtttgaaaatgtaaaaattatatgaatagatttaccttgaaaaatactttcataaaaatatacatatatcattttttaataaatatttttatagaaacaagaagtcaaaattgtattaccgtgttactgtccaaaacgattttctttacgagtacggagggagtagtcagttagccatgtgttttaccaagaagtcaaagtgaatacaacacaacgatttgatgagcaattatggcatatccaagtttaaatatctccttcattcatgaatagtaaattttaagtgcaattggcctatcaaagtttaaatgctcctttatactcccttcatctaattttgatagtcatattttatcttagcacacagaccaatgataagtaattatacttatcatccatttaaatatgctactagtcattcctagtaaacaagcgattcattaacatttacatttctcaatacccatgtagccaatcatatgtggaaaaatggagagtcatgcattaaatccgagaaagtcattaagatgataggttgttggattgaaatatgcgtatcaaaaataaaattttcagatttagaaatatgactatcaaaagtagatggagagagtagtatttagaatttattggtttgtattctctccgttgacgttaaaattatttggcacagccaacgaggtccacgacatggtggcagccagccagttggagtagtatgcgattaatcaataaggttagtctgctctcatatgttttaaagaaacattattatctgtgcaatgaaattattcaagtcactgttgatagttctggaattatatatattggtgaaagagaatattagaatggcataaagagctaacccatttcatccttgatgtcccatcgatcaacaaattaaagcaaataaatttcaggccctgtttattcatatatatttttgttttatgtattgatttataccacgtttaatgcactacatatatgcatttttaatcgcagctcggatttgttatggtaatatatatttcttcgaggattaggaagacactattaatttataatgatgtatgtttccactattttccttcttcgaattgctttggtgaataggcatataaaacatctcacacatttataaatataagtttggtatacatgtcttgatatcttagcgcagatcaaaattagcgtacacacaccctctacaaatttatatcttagcgcagatcaaaattagcgtacacacaccctctacaaatttattctaacatgttaatttcaaagaagaagaacctgaccaaccacatcagtttatcaacattttctttttaattaggttatgtgcattccctagaggtgcagagtttagatgtatttattaattattatactcctttatgatctttaaaaaataagtttgtcaataagaagcaaatgcgctctaaggaattcatgctccagacatgctagaaaggcatttgatattttttttagcgttgttttggtacttgctatttcttggatttgtagtttctcttaaaagaaaccttcacttggtaccatttctttcatattaattgactttgacgtctaaaaaatcttacgctttttgaaatacaagtttgagaaaattcaataatagaaaaaaataagatttaaatatgaataaaacccaaaaaatatattttaatagaccgtggaaaaaaattaaaaggagagataaaaactcaaatgaagttttatgaggttaaacctcatgctaaaattcctttaaaatcttcttgtcttaagccattcaataggaataatataagattgttatattagggtgctaatcctatgtttcaaaggatcaaagaggatatttttctacatgatttaaatcatataaatctcctatgtttttccaataaataaatgtgttttgtttgttcctttttttcggtgtgcacaacaccgcacaaggtatataatcttgttaaaaaaaacacctacatgcaaatataaattaaccaaacaacatttactatacatataaaaagtagctgaattatttaccgatcatctggtgatagatcaataatgccaccacgcctaatgaaagctacatgcacctagctgacttcgtacatatatatgctctatcgctagcgatgaacagatgatgtacgtaccaaaaaaggacaacaaagttagctactttttgatcgatgttgatgccctaaccaaaataactacaaatatatactatcaatatcagacacagtgaatagcagctttataataccaacctgcgcccctcttaggctgtgtttagttcaacacaaaatttgaattttggttgaaattgaagatgatgtgactgaaaaattatgtgtgtatgacatgttgatgtgatggaaaaggactgaagtttgtatctaaacagacccttacttgaacttaaattagctttgtctgaattagttacagtactgttcaagctacctagttcattcaatttgttggactacgctgtaacgttagctagctagctagctttgctttcttcacaagccgtcatggatcgaccgatcgagttcgttattaagagaattattggtagtcgtggtcctaatcatgcttatattgtcactcgattaattatatatgtaagatatatacgcattgttattagcgtgtcagctttgcatttctactaactttttgtttgtacgtactttgcttttgtataatttctttgtcctttctcgtaactgtgctttgcttttgctgtttctctcaaaaaaaaaaactgtgttttgctgcctgtacggcacctacctcttgctagtttaatccggctggttgcaaatctatgggtgtgtggttgatgagaccatgcatatgtatttgctgatcaattattctaggtgcagatgtaattaattaatattggaagcggttcctgattaattaatgaagtattataagccaccgaggaaaaaataagctagtgagggagagtattgcagttactatagcaggtgttgcatctgaaaacggatgagatcatacattattttatcagttttcagatgcaacgttctccggtgactaagacatttacctaggaacagtgacttaggcaatacaacaactctgttgtatttggtcaaatattgttaaaaattggtgttggttaatttctgctaactgcacttaattattagcacataaatccagatacatttagctatatctcgaatccgacgttttgtacagcactacaactccggagtcttaattttcactaagtcaaagagaatctattttcatattctttttctttttgttagaactatattactccctccattccaaatagatctatatatttcatatgtacaccaagaccaagaaaaactaataactctctcatactatatttactctagcaacaaactcgatgcatgcaccatccccaatattttctagccaatagcaaatcaagatattgcatgtgggttataaatacttatgtgcatggatgcatgcatcaatgtccatttactccaatgcacaaataacgaatagacttaataaatgaatacaaatatgcagatcatttaggaataatctcaaaataactactccctccatctacttttgatagtaatatttcatcttggcacacagaccaaggataagtaattctacatatcatctatttaaatatgctactagtcattcctcgtaaacaagcgattcattaatatttacatttctcaatgcccatgtagccaatcatgtgttgaagaatagagagtcatgcattaaatccaagaaagtcattaagatgataggttgttagattgaaatatgcctatcaaaaataaaattttcggatttagaaatatgactatcagaaatagatagatggagggagtatatttttcttcctcaacattggtcataaactagttacaccggtaatggtctgctatatgatttctctgcacacaaagtgacagagaagttgattatcatatatattttcatgtacaatttgtaggcagaatgcattacccgtacagctaaaatagacgttgcaacctatacatagattccagcggcgccgcagcagttggatgcaatcacaaacggggtgacagctagggtcaacaactcaagagaaaacaagggctagatagcctatagaatgcatggatccaaatccatccaattcgcatcccacaaattgaaatccatcaaattaatctcgatactacaaaatagtacaaacgaacccaaatattttttttataaacaaaagctacgtgaacacacagctaataaaggaattgttatttgttcctatcacaagtacttttacaataatctctacggtaatattctagctgctaccacaaagtaatattaattaattgttgatttacaaattatactcctccattccttcaaaagaataagcgtaactagtaaaacttattctactaccagtagttttgatgttctaatataaatgaatatgatttattgatgggaaagataaactgtctatatatatataaattgtcaagtaactgtagtttgtgtctctaagttttcgctcgatctcttttatgtcccacaagttttttttccttgaaaatgattatgttgccactctcatacatgcttgctagcttaataattaagaaaaacacaattatcaaatgaaaaaaagattcatttgtaaaaaaaggggcataggattatttaaccacaaatttaactgaaaactgatatttaaaatttaaactaatatcaaattaattttgattcagtttctacaacattttcaccaaaatttaaatccaaacaaaaataatcttggttctcaatttctcaatgaaactcttgtatggatttaataagaacttaaattttgtttaaaaatatatatttaatttttaacatttggcatcaaatgattcagtctcatttgaattttcataatttgatatgtttttcacattatgatttatgttattaaagtagttatcacataacacgtacgagaggtaggtaatatagcccttttagaaaaaaaaacattcaactcatgcatggtgttagttaacggaagggattagctattgagctgtcgacagtttttaagggtcaaaactttcaatttttttcaccttaagatctgtaatcaacggaccataggaaacgggtctgaaccaactgaaagcacgaaaccaatccgtttagagcgtgtgggcacattaagaaaccctgaataactaggcacactgtaactaaatgtaactgtaactgagctgtaactactctataactagattataactggactgtaactagtgtgtaactagggtgtaactggactataactagtgtgtaattaggttgtaactggactgtaactagtctataactaacttataagctctatttaactgggaatataataaacattttttatgtaactaaatggaaaaacatcaacgatggaatttatataactgaatagaaaaacattgacgcctccatcctcaagatgaacaacaatacatgcgtgcgaaaatcaacgaatcgtttcccctagaaatctaggagaagaacaccaaccaaacatacaaaggatttatagggcaaacatgatgcaggatctgaacacaaaatatcacatgaacgcaccaaaaagtgaaaaaatcacatgaaattttgagtagagagcgtgaggcagagaagatcgctgcgacagcgaggaacacgagcagctgaaggggaaaaatcggcgaggaagtgggcagcgagaaacccaccggccggcagcaaaaaaaatcgccgagagctgcatctggcggggtctccgcctccgcctaggccacctcgcctccaagaaatttctggaaaaaggcaacatgcagctatacacgccaacgggtagcacatctattggtcatcaggtttggatccaatagaaaaaaatctcacacgaatcatggcgccagatcgaacggccataaaatcgaatgtttctggctccaaaactgtcgacagctagctagcaaaaccgtaacggaatggacatagaacaaaaacttaaaaaacatgtagagaattgagacaaaatttagcggtacataaggatgaagaaaaactcaggagcaagtaattaaagaattttctcaaaaacacaaacgaacgagccttctattaactgtttgattgtatatcttggttcatatatatatactgtccttgatctgtggcctttcccaaactcgatcgttttcgagcttttaagtatatatatacctactaagccttgtaaatgtccggccacgtccgaggttaatttacgtacgtgtggttgatccatcccgtcaggacgtcacctaccactggacactatactcgtccaaattggttaatttgggtgggttcggcagcacacgtacggttggtgatggctatccaagtatgttaggtaggattcatctatatttgcatggtgtatcacgttcagaatgtcagaaatgtgaatcctgtacgtctttgtatacgcgtacgcgtagtagctagcaatatggcatgctaattattctcacaagtagtatacgatgtatatatataatcctaatgtcaggggaacgtacttaattatgcaaatttgtgagtttacctgagagattcctcactcataattttattatggaggccggatgagatagaagctgatgcccgtgagaaaggtcttgtagttggatacttaattatgcaaatttgtgagtttacctgagagattcctcactcataatccagctccgaaacgcggcggcgaacacacataaaaaaaattatcgaggatataatacatacttattatttaatatattaattaatatagttaataattgaatagcctatatgggtttaattttcgcgttcaccccaagaaattaaatgtaggaaggccactgtcaatactacaaaatatcaaataggtgtcagcactatatgcgctgtaagtgctaaaaagacacctgtaggcttttttccactttcgcatgttgaaatcctaaaaaattggcccctttaagcaattataggtgctagttctaaataataaccgatacctattttataggtgccattttttaaaaaaaaaaacataacctttaatgttaaaaaccgacacctataacatattataggtgttttttttaaaaaaaaatacacttctgacttaagccgagccagtgggccccaccacgaatgacgaaataaggcatcacgaggagataaggttcaatccatccacagacttccagagccatcttgcatctctctctccctcatctctcaactctctgcctcccttctctctcgttgtcctctctctctcgctgcccatggccggcgaaggcggcagcggcggcgcgtcctcccctccgccagatccggggaggggcggcctagcggcggcaacggcgggaggtggcatgcggcggtggaagggagggggatgcggcgggaggtggtggcggcccagcaacggcgccttccctctgttagatctagagggagggcaggcggcgggaggggaggcagtggagacctgctggcgagaggcagtggtggcccggcggcgggatgaaaggcagtggctgtccgacggtggcgccctccctccgtcggatttggatggagggcaagcggcgggaggggaggtggtggcggcctggcagcggaacgagtggcagtggcggcgcacttcctgttagtgaatgatttctgtgaatgttagtgaatgattttttgatgttcttcaatgttagtgaaagatttctgtgatgttcttcaatgtttcttgttctgtgatgttgtttgattggggattgggggttgtgattgatttgggagttctgtgatgtgggatgaatgagctcgatactcgagtctttttttggctcgcgagtaatctcaaaggtgccggttcttaaaacgggattagtgccggagcactcatcagtgctatcttcatggtgccggttggaaaaaccaacacctatggggtttcccaaccgccacttttcacgtgttctgtggtagtgtgtgatccatccagcaattttctagctctcatgtgcatgcaaccgttccatgcatgcatgtatattactcgctccgtactaaaatataaaagattttaagtgtatgtgacacatcataatactacgtatacgaatttatatgaaagtctgtctaaatttatagttttgttacattcacctaatattttttatattttggcataaagggcatatatgcatatcgcctcacacaagcgtatgcaccagcgaaccagcctgacacctgttcctctatgaatccatgccaatccgtgctggtcagagcagcatggccatgcacgttcacgtgtgcatcggtagatcgaccaccagcgtatatgcatatgcccatgcacacgtacaatctttcaagtaccagctgggtgatcgtacggcccgcacgtttccatgcctgtgtatactttggctggtcgatcgcctcgcgtgtatcgccagtgttcagtgcgtgtataacacgtcttttatatatacgtgcttgtatgactaattgaatgttaattatttaaaggaaaaggtatgttttactcccccaactattgcgacagtacaaattacccctcgaaccacagaaccggatatattacacctcaaactattgataccggatgaattaccccccccccacacacacacactcaatactaagcggttttgctcctacgtggtatacacgtggcgtcgacatggaaatccaatcaacaaaacaaacaaaagaaaatatagggcccacctgtcattacctctcttcagtcttccccctccccccttctctctctcaggcacgtgtcgaagggcagtgggcggcggcagcggcgcgtggacgggcggtgagcacggcggcagggagtggtggacctgggacaggcggcgggcgcggcgggtggcacggcggggagtggtgggcccgggacaggcggcgggcgtggcgggcgtggtggagaggcggccggtggccggcgggcatgacggcgcccgtgcccccctgtcactgcggagggcagcaaagcgcggcagcgaggcggttggcggggggacaacgtcgcggggattcgccgtgaacgcctacctcctcccgctgctgccaccgccgacgaccggcccgttgacccgcgtccgcgaatgggaggacgcgctcgcctccttcgccgcaccccgccgccgctcgcctcctccgcggcccctgcctcaccgccgccgcctagcgtccttcgcccctgcctctcgcctcgccaccacgctcgccactctgctgcctcgcctcctccgccacccccaccacgcccgccctgcctcgccttctccgccccagccacgctcgcctctccgccgcctcgcctccttcgcccccgccgcgctcgcctctccgccgtccccgtcgcgctcgcctctcctctgcccccgctgctctccaccgccgccgccgccttgcctcgcctcgccgctgctgactccaccgcgcttgctgcctcggccgtcgccgtccgaaggagaagagggagagagagtgagacagtgagagatgagataggagagagagatagaaactgacaggtggggcccacctatttttttaataaataaattgctgactctactgccacgtaaaccaaaaccaccgcggattaggtcgaggggggtaattcgtccggtttgcatagttgggggtgaagaaagtccggttttgtggttaggggggtaattcggacgaccgtgatagttagggggggtaattcatactttttccttatttaaatctaaataactttcctatagatattttttgtaaataacacaacacttagcagttatgaaagtgtacacgtggagaacgagatatttcttttcctaatcaggtgcaaacgaatgcagcctctcaagagtctatataccgagcatgtagttggtaatttcaaaatttcacaactactaaattctaaattaaaattatttgcctaagcagtctgcaaagggttgttgtgagggtgttccgggtttagcggttaggcgtttgtgaggcgatcgcggtggatccctccgtgacgctgacaacgggtgcaagcccgatcgtcggctcgacgcaagctgtaaccggcacacctactggcaaagcgcgaggcggcggcgtttgcggccgattctgggctatctctgacgttgcctccatcgacgacgatgagtctgaggatgagatgcttcatttacaaccatccgtccctaaccacaagatgagttttcctatgggtgcaggtcttgaagaagggtggacgacggtgaccagacgttcaagacaagggcggcagcaacatttggatgcgttgtcgtccggcgttcaccatcatgcatcaactagcccaagtaagacggaaaatggaaagactccgtggacgggtgcccttcctccgcgtcgacgttcgccgccggtgacaatcggcgacctgatttccaaggcgtcgcaccgtcctttgcgccggccgcggcggccgagcggatcagagcagccgagatcagcgcttcctcttcaaacgaggggtcaaacgaagtctccaagaccggcacaacattagcaaaagaatgggccatgcatcacaccaaacatgcgggcccagccgcctaatgggctccagtctaagggccctggcgatggcctctacaagcgacaaccaaaggcgctgcttgccctagctcgtaaacagcgtcgaccaatcaaccccaagcgatcttttgcggaagtggtgcgagcgggtgagatggctggtggtggaggacgatatggcggcggccgtggtaccggcagcggcggcgatggccaggatggtgacggccgtggcggcgtgttcaatccaggcaggggagaaggtggcgctgggcggccgcgggggagaggaccgtggcggcctcgcggcagaggttgacatcccgggaacacggctttgtctggagcggctaccgggaatggcagtggtggtgcttccggccgtggtcatcaaggccgtggcggagacagtaacagaggtccggatggtcagttcgctgtgaatctgaatgcagcaacagcatcaggtactgatgttccaagaggagagtctagggttgacatagtgactgcagaggctggcacttcttcaaaaggcgtcaaaagggcgtttttcagatgcaaggagaaaaaccatgctgtttcacagtgcacaaaaattttgtgtgatatttgtaagccacctgaacatactgcactttcatgcccgcttttactcgctcccaaacccacagcaagcatgtgtggatggggagttgatggtggaggctttttcatgatccccacgccaacaacaggggcagtgaaacccagggaacacaacaaaacagcaattatccgggtggagaatggccacatttctgtggacaacttgatcattgaattgcgaaggttggtgccggttaggttccaatgggatgttaaggagactgctccagacacttatatggttcaatttccctctgtgatcgaattagacaggttgcgtagggttggcagtgttcctagttttgactttaatgtgaacctagtcattgacaagtgggagcaagagattgaagcgaagtttgttctaaagaaaacttggtttaaagtttatggagtgtcatatgagattagagactttctcagtctacatgctgttggttctgtcattggtcaaacaacaactgtggacatgatttatctcaggaaaaatggtgtggttaggatgcaggtggcagttgatgagttagcagatttaccacctagtgtttacgttgttgtccgaaaccatggctatgaaatcttctttgaaccggaattgcctgaggtggatgggaaaggaaagaagaagattgatgatattgaccaggacggagaaagaaaaaatggtggtgatcatgatgttcacatggaagatagggacccaaaacgccaaaagaatggttctgatgggtcgctaaggatggaaataggaggcttagcgccagctaagctgccctcaacgcgcaccaataatatggttctagataatgaagcattttcaccgtctcctagctcagatacgcctgctacaacaacggagttggaagcgtttgcctcatactcctccgtggtgttggaaacgcccatgagtcaattgggagcccaagggacaggaaactccgagtcaaccaaggaggctgtcggtgaggtggtgtactccgacgaggtttcgacacagctagcgaagttggcaacgactaaggtactttctactgaggttgctgtgcagctagcaggaacagatgaggtggttacgaatggcaaagagcaacaacaagaacctgtcagcatggcacaagaattacagcatgtttcagctagcttcttgtctcccgtggagcatgtattggactgcaacgtgcagtctgaattgctccccaagaatagccagcttgcaggcgatggaagagtaacatcgactaagaacttgatggcagtactagcaaccaatgaagaccaacttagtgcctccagtgctgccacatctaaagcccaggatgcagcacaggcagttggagctcgatccccgacaagaaggcgacctcgtcgcccagtggaccctattccaactaggcaaagtgaaagacagaaggcgatggcaaatgcagatgcgccggtggcaaaccgggcagagctgcttaaaaaggttcataacctcgagacgctaacaggtaacaagtttaataccacaaattctgttgcttcaattccagataagactcttgctgcaaatttttctaaattaggggtttctctaggaaagaatgatttagaaataaaggagtccattaaccagattaaaatttcagaagtggatagatttgctactctttatagtagtgctgtagcgtctactagtaatgtagataaaagcaatgatgaattgttaaaattgtcttctctccagcacttatgtagtgactggctagaagaggctgagagtaatgacgatgagtctatggattctcaggccatacctcaaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatatgttaaggagcaaaatttggattttattgccattcttgagactagaaaaccatcattcacccctttaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttcgaagaaataaagaggatggtttcaaatgggttttaatggcagtatatggtgctgctcaacccgagttaaaagaataatttttgacggaactagctcagacttgtggtaaggagtcataccctctattggtagggggggactttaatatcattagatcacccgaagaaaagaataataattcttttgaccctcgttggccttttctttttaatgcggtcatcaatagtctcaatttgagagagattatctttcggggagacaattcacctgggccaagaacctcgaaaatacaacttatgagaagttggatagagtgttaatgaacactgactgggagcaaaaatatcctttagttacgtgtcaagccttacctcgagccatttcagaccactctccaattatactgagatccggatcgcatgcacattttggcaatcagccgccatttcgttttgaattaggctggctagagcgggatggattctttgagatggtagccaaagagtggcaaagcataaacaagggaaggaatcctatggaacgttggaaacacaagattgtccaccttaggcaacatttaagagggtgggcgcgaagtttaagtggcacatataaaaaacaaaaaataaagcttttagttttaattaacacactagacaaaaaagccaaacacataactcttcgttgaagcaggtcaaaaatgatttggcaaaactgttaagggacgaagagttgtattggtaccagcgatctaagacaaatcatttactccaaggggatagtaatactaaatattatcacttgatagacaatggtaaacatcgtaagcagatgattttccagttggaacaagaggacactataataacgggtgaggggaatctcaaagaatacatcaccaattattataaaggattatttggtcctccagatcataatcatgtatccatgatagagggatggactgatgatattcctcaagtgtccgacttggaaaatgacatccttactgctgaattttcagaaaaggaagtcaaagaggcaatttttcaaatggatcataactcctccctaggtccagatggctttcctgcagagttttatcaggtcttttgggagattgttaagaatgatctcatggctctatttagagaatttcataaagggacattatccctttataacctaaactttgggatcatcgcgctattgccaaaaaaggctgatgcaaatcaaattcaacaatataggcctatttgcctactgaatgtcagctttaaaatttttacaaaagtggacaccaataggattacaacggttgctcacaaagtcattcgcccaacccaaacagcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcgtggtgcaattggatttccaactgggtggaaggaggaactgtaagtgtcaaagtcaatgataatgtaggaaaaaatttccggacacgcaaaggcttgagacaaggggatccaatgtccccaattctttttaacatagtggctgatatgttagccattcttattgaaaaagtcaaagtcgatggccaaattagaggggtaattccacacttagtggatgatggtttgtccattctccaatatgccgacgatacaataatatttcttgaacatgattttgaacaagcaaaaaacatgaaggccattctttgtgtgtttgaacatctctcggggctgaaaataaactttcataaaagtgaaattttctgctttgggggagccaaggaaatggaggaccaatatagacaactgtttggttgtaattctggttcctttccattcaaatacttaggaatccccatacactatcgaaaactcagaaattttgattggaaatgtgtggaggataggtttcaaagaaaacttagcgcatggaagggcaaaaacagctcctatggtgggagattggttcttcttaacttggttctttcgagtcttcccatgttcatgttatccttttttgaaatacctcgaggtgtacttcaaagactagattactaccgatcgagctttttctggagcagtgatagccagaaaaagaaatataagttaacaaaatgggattatatatgccggccaaaagatcaaggtggactgggtgtcctaaatcttgatatcatgaatagatgtttgttgagcaaatggctattcaagcttcttaatggtgatggcctatggcaaaaccttttgcgcaacaagtacttaaagggtaaacccctctcccacatgtcacacaaaccaggaacatcccaattttgggctggcctaatgaaagtaaaagatcaattttttcagtatggatcttttaaacctggtaatgggatggaaataagattttgggaagatacatggttgggcttacaacctctcaaatatcaatatccttctctgtacaatgtggtccgaaaaagacattctactttggcagaggttatgagcacaacaccgttgaatgtttcattccgacgatcaattgtaggaccaaagttagttgagtggaacgatctgatctctcaactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaagtaatcttgacaaaagataatctcataaagagaaattggaggggaaacaagcaatgttgtttttgtaatacacaagagaccatccaacatcttttctttgactgtcatgttgtacgttttgcttggcgatgtgtcttctttgccttcaacatcccccctccccacaatgcaaaagatatatttggtgactagctaaggggagtgcctagacccacaaaaaaaatgattttatttggagctagtgctttatgttggtcaatttggcgttgccgtaatgatatagtttttaaccataaaaaaatgcctaacatcatgcaggttatcttcatgtgttccaattggctccactcttggtgtatgatgctttcacaggaacaacaggatactatgcgcaatggtgctacacgcttggaaatagtagccaaggaacttttatttcattttggatggcgtagtacctacagaatttcgtgatagaatctacgtgattttgaaaaaaattattattttagtagatcatatcatcggcagaagttgagggtttgtcccatctcgccttttttaacttttctgttcacgtctgaatttttttggctgtgtgcttacgggcagaggccggagatgtaacacatttccattatttaaaaaaaaattattaaattaagaacagtacactgaaagtactccaagaagtataacaatagtccatgcaaaatatgatttggtggggtgactagcagagctaatatagcatcatgcatgatttaagcaagattatatggagatatatcacttctacacgactacaccggcaaaatgtacaagttagtgcgttctcggtctaaccgcacgacgacgcccatgtaaaccgaatttaacagtgtgaaccgggctgcaaaattaaattaaactgtcgcaagttttgtagcaattccgattaataaatgacgttatgacgcaacgatagaattaaaacaaatcaaatgacgttattacgcaacgatagaattaaaacaaatcaaattaagtcagcctggtcagtgatcagtgcaccatagcgcagctaaacaaagcaggttaaacgtgcttaattaagtcaacacaaccacactacctccctgccttatttttcttttcaaacctctgaagaaaaagttcagaaaagacatggagaacaaaaaaaaaagtgtactcctagctaagtagcgaagctaatctgcttctataaatacccagcaaggcatgccgtgtcacccaccacacgcacacagttagctctagctttgcttgatttgcagcagcagcagcagcagcagcagctagcttgcatccatgggcgtcttcgccgtcaccaaggtgtccgagggccccgtccggccgtccgcagcgacgccgtcggagacgctgccgctcgcctgggtcgaccgctacccgacgcaccgcggcctcgtcgagtccgtgcacatctacctccgccgcgacgacgccgccgtcgaggcgccgtgcgccgacggcggcgtcatcgtcgagggaaagaagaagaataataagccggcggcggcggtggtgcgcggcgcgctggcggacgcgctggtgcactactacccgttcgcggggcggatcgtggaggacgagcggtcgccggggcggcctgccgtgctgtgctccggcgagggcgtctacttcgtggaggccgccgccaactgcaccctcgccgacgtcaaccacctggagcggccgctgctgctgtccaaggaggacctcgtgccgtgcccgacgccggagcagtggcccgtcgagccgcacaacagcctcgccatgatccaggtacatacgtgaattaatactgcattattcctgcttgctttttttttcttttttctttttggctttctagattttgctttgcactgttggatctcgttatgtttttcatgtgtccttgaaattgatatggcaacaagcatgcggcagtttgaatctatcaatcaaacatgcacgtcaaacttaatttcgtgaaaagaaaattaaattaatactactgctagctcctgttgtgcattgtgagtgtactgcacttgattagtacaggagttaactgcatctacgactctag

SEQ ID NO: 57986 - DNA, 3951 bp, Oryza sativa
aaatgacgcggactcatcagtcagttgattaattagttggaggtcacgtgatttgcaggtgacgacgttcacctgcggcggcttcgtgatcgggctgcgcaccaaccacgcggtggcggacggcaccggcgccgcccagttcatgaacgccgtcggcgacctcgcccgcggcctcccggagccgcgggtgaagccgatctgggcgcgcgaccgcttcccggacccggacatcaagcccggcccgctgccggagctccccgtgctgccgctccagtacatcgccttcgacttccccgccgcctacctcggcaagctcaaggcgcagtacgccgccaccgccggcgccagcaagatctgctccgccttcgacatcgtcatcgccaagctctggcagtgccggacgcgcgccatcgccgccgaccccgcagcggccgtcaagctctgcttcttcgccagcgcccgccaggtgctcggcctggagaccggctaatggggcaacgccatcttcccggtgaaggtgtccgcggcggcgggggaggtggcggcgtcgtcggtgatcgagctcgtcggcgtggtccgggaggcgaagcggcggatggccggcgagtgcctgcgctgggcggaggggcgcaccggcggcgccgacccgttccagatgacgttcgactacgagtccgtgtacgtgtcggactggagcaagctcgggttcaacgacgtcgactacgggtacggcgcgccgtcggcggcggggccgctggtgaactgcgacctcatctcgtcggtgatcgtcatgcgggcgccggcgccgctcgccggcacgcggctgctggcgagctgcgtcaccaaggagcacgccgacgacttcgccgccaggatgagggaggatctcgtctaatataccatggccgcccccaataacattattagtcacgtacaatattgtcactgaatattaatttgttcgtgtatatctattgtggtatgtattttttttttcataggaaaaaagtagtagtacgacaataggtagctgggagctacctaatatcgacctctggtttgagagtaagtgagcgagcgagagatgtaaaccacctcagtttttaccgtgctttgtgacatgcgtggtacagtactggtactattaatcattggccgtgaaaaattatctacccatatgccactgtatttatggttgtttgtggaggattacgtatactaatttatctatgtcttacatttttcttttcatggacgcactcttaaggccccctttgaattggaggataaatggaggaaaaacaaaggaatggaaattctatactattcatgcctttgattcgtagaaatgagaaaaggaaaaacgtaggaaactttcctattcctatgattttagaggaaaaaagtagaaaatttaacatccactctaacctcttggaaaaattcccttgagtgtatctctctcatctggttcctacgtttttcatgcggtccaatcaaacggtcattcctatgtttttcctgtgcttttgcaatcctttattttacacttgtattcttatcagtcctacgatttaaatgggtcctaaatatgtgtctgtgtgagatgcccgttaggtttcttcaattcacgccactatttcaagtggctagctacatccactacatgagttttcccttggagacaaacctcctatcataagaccaaccgtcgacaccagacaccagtgacgtcctctattactgtggctcacctcccacgccacctttcttctaataaaaagggggcaattggagttcctcgttaccgctctggctctcactcactacgcctcctcacctccactccaactctcccgtcatgatgcatggactcaccgcgaccgccttagaatatcaccaccagtgaggaggaggaaaacaacgatggtaagcgacaaaatgcatcttgttcgaggccaaggacaagatacaataaaacgaaaagaattgtgaatgcctagcccaatatgcgatttaagtaataaaaactgatccaaagtacaattcacttcgaaataaattttgtgctcgaccaattcgatcatcttcctttttgtgatgattcggttaaagtgtgaaaggtgacaatcaacctgcaagtacacgtacgagagagtgacactcctcatatctgatatctgtgttgaaatactcccttcgtcctaaaataagtgtagttttacactatttacgttcaacgtttgatcgttcgtcttatttgaaaaaaattttatgattagtatttttattgctattagatgataaaacatgaatagtactttatgtgtgactaaatatttttaattttttcacaatttttttaaataggacggacggtcaaacgttgggtatggatatccacagctacatattttgggatggaggtagtatattactactgtcaagtcatatacttaagataatttctaactctgccactgacactgggtctagtcacatacacagccatgcatgatgcacgtacgtagatacttggattgtgtacggctcgatccatgatgcggacccagcatatagtaccaaaatagtggcagtagtttggcattgcacaggcagtacgcatacactaactcatcgttgaataggagtaataattatactaatccatatagataacccttacaccgttttatattataaatcattaattttaacctttttctggttaatttttttaaatgtttgactaggtttatagaaaactttagcagcatctaaaaaactaaatttgtttcattaaatctcacattaaatatattttaatagtttacttattttgtgttaaaaatactactatgtttttctataaatttggttaaagaaaaaagttaaaatgatttataatatgaaatgaatggagtagtgtactacacggatacacctgcttttgcaattttcatgcagctttcgttcatttatttatacatacttcacttacttctctctacgtaccatatatataaatatatggaaggtcttcctacaacaactattatttggaagttagtagttcacatcagcttcataattgtatgagtgtctggagtaaaatctctctcggcaatcagcttatcagcataaacatactatatatctatcactggacttttattacaacgttctgctcactttcttgcaacaaacgccaagccgtccgtacaatcttctataattgcagggaggcaggtgaccggcaaaactgaagatctcaaacaccaaccgacactggtgtactcatgcaatattaagaaaaaaataataattcaagctccagttaagctagctatagcctacaggctatatattgctaacgcacattatttttcgttgacctccttccttttgctgatcgcgagaaattaagctagagcaagtataagagaggctgatgaaacatcgcatcctactgcttatttccaagcgtcttaaggaccttgtttttgttttttttttcctcctcgccgacctaatattcacctagctagcataagatatttacgtacggcaactgcagaatcatcctctcgaattagcctgacgcaacatgtttgccaatcgcgctgagtacttttgttacttgcaaattgcacctaattcatcaacgacttcagatttaagaatgcaacatatgcatgcatgtagtattgatcaaggctcaccactcccatggcaatgcgaaatggcaagctttttagttactactattttcttcggtcgtaaatatttgacgcatttaatttaagaaaaaattggttatatagcattaaaatatcactttttggttttatagcaccgaaatataccggttcactttaatagcacctaaagtttaccccgttcccatttttaacaattccgttaattctcaatcgttttccgtccgccttg

SEQ ID NO: 57987 - DNA, 13843 bp, Oryza sativa
agaattgactgaagtgttaaaaagaaaacggggtgaactttgggtgctattaaagttaaccggcatctttcggtactataaaactaaaaacgtgaactttcgatgctatataaccaattttgcctaattttaactacaaaatttgaccactcttattattttaaaaatatgtaaatattatttatttatttattgtaatttgttctattacacaagatactttaagcttgatttatactttttttaatttacactaaatttgtaaataagataagtggtcaaacttgataatcaaagttaactctgtcagatatttattaccagagggagtacttccgtttggagaaagagcgccgaagattttgtttcgagcgaaaaatatcgaaagattagcaaatacaatacaagaaccatacttactagccaacctagtctggccaacctggccaaggacagaagctttgaagtttgaactccctagctgaggaggatgtggttggcagtttcaggcttcatcttgtccatcttacgtacactaatgcactctgtttctccattttgcacattggtcaaacttctagttctagcagaaatcaattggtgatattcaaactctgcttccggaagaggtagggaggcaatgttgtgcttaatatctattatcaccaaccattagattcccgcatacataacgcatttcaccaacccatttgggttctcacgtatagccatctcgcattagtcattcttcagtacttagtagtattaggtatggtggaggaaacaaaaggtgtatcaagtgggatgacgtaaggttcgattacatttcatacatctttgatctttgaaactaattaatttaataatgagggtaatgcgtcaaactaataacataatgctttaatggcctattttggcctgtgtctctctctgtattgctttatgtaaaatagaacgagaaacatgtgacaacattcgaattgtgaaagttatttttttaattagacactttggtttgatcgctgacgatggtcaatggatataataattatcttttcgaggcaatatgcttccgtacgtcagggtgcccgattcatggagatcacaggagtagcttttggttcatcatttatgggattattgcccacatttggtgagataaattcatttctcataaagtctggtaaacatcaaaagtccagtaaacatcctcatgggcactcctatgctgtcacatgtcatgcctcgaattagaaagaaattctttaaaaaaaaggtcataagtttcatattataagacactttaattttttaattaaagttaaacttgtttaagtttaattaagtttatgaaaaaaatgtagcaatgtctataacactaaactatttttattgaataatctagcattgaaaatattttgatggtaatattttgtgttgaaaatagttttcttttaaatttgatgaaacttattaaagaagtctaatataaaaaaacaattcaaaacgttttacaatatgaaacaaagagagtggaccaataggctaattattttaaatcattagatttatctagactagaaaagatccaaaattcgatctctcacctcacccacccttccaaagcacgcacccctcccctctgttcccccatatcattccttttctttagctatacagtagaagtagttagtaagatgcagtaagccaataatcatcacataacaaaaacaaaagttaaaacaatcacaatttttaaattgttattgaattttctgtccttctatatcattgtattcatatcacggttaaaattaacagttcaaaaccagtattaattatattttgacttgtaaagacatatgttatattcggtcagatcttaacccttttaacatatgacatccaaaaagctatagtaaattacaaagaaaattgaaattagacgttaattatcatcatatatcactttgtaaaacatgcatagttaaattagatttacaatatctcgaaataaaatcacaaattgtgagcaacattcaaaagatatatattctctatgttatttttgaggcagagcgacctcccgagcaggttaggtggccacccgagctccactgctggcaggggcggatccaggaacaaaaaaaaaattgaggggctcaattacacagtttttttaaactccagtcatatagggacctttagtttattattcatggtgaaaaaattgaaaggggtgctccaggggtatccatgggtctggtgtgtagaggggactcgaatcccccctgcacccacgttggatccgcccctgactgctggcgtctcctttatcaatagccgtcgacacctataaaaagttaaaaactagtcaatcaccgaaaaacactattagtcatccggatttaacgatatcgctggctctgccactagatgaccctttgcatcattgcatgccatcccaccaatcataaaaaattatcaccatatcagttctcaaactaaacaagcccttaattaattagttgctaacgggatcacatccataacacaaatgcaagctgcaaatttttactatatctttggtatgtaatagtagactgcatatacagtgaatctctgcgctgtcgttagtgtgttcaaaaaattgaaaaaaaaatacagcattgcttatctttcctttataaaaatgaaaaggagaaaaaaaaggaagatggtgcacacaggatgagttcataaaacactccagtttgcaatcaaataagtatgtatatctatgggctaattagggtccctgtttttgaccaaccgctaattaagaatcattgtaactgcaagaagtgtcagcaaatgaaaaggacgcatcactaatcccaccaacgcggcgttgactgaaggagcctataaaacctgctgctttatagtagttgattcactagttctcttttcactcccacccttgtctgcttggcggatgtcgctcgtctctgataacatggcgtctgggtctattaggccgtggtttttctgtccactggttaaatgaaggaataagtccagtttgagtccctcaaatatatgttagatcttattcttatccctcaattgtaaaaacaggtataacgactccctcaatgttaaaatcatgcaaaataactccctcaatggtttttagagcggtttttgttgacatagagtccatgactgacatcaccaccgcaacagcatggacaattaggtagctcatgagcttaatttacttgcactcgccgtcgccaggggctgccacatctcgcaccacggtggatgagtcgtgcggattgttgtgatcgtgttgttgcttctctttctgagcttggtttcagctttcaatgggcaggcaaccttctcttcacaattctccatctaactctcctgtggcgccggttggaatgttgtcgtgaaatccgattcaccatagcgcacattcatcccaaacgatggcaatctattaggaaagttctcccacaacgttaccaggttcagtaaccccgacgcgagccatttgtacactctttagccacaatgcgtgtaggcacgagcaacttctcatactggcttggctacctgccaccgtggtgcccgacgacaacacaactctagtcctccgccttcacttcttaccttacgcatcacaatcgggcgacctttccacggcactgttcaacgtctccatcatggggaggtacgtcctgcattcttccttcttgtcgtcgcgcactggcgcggtgagggagttcatcctcgcgtccgatggctctggtgtgggtgggcaggaacgaaaatcgttgggcacctagtttggtgcgtcccaccgcttgttcttcacgcttggcatgattgtctgccgccaccgatcgcttactgtggacaccccttgtcaccgacctcccaccgtcgatgtcgcctctcatggatgagctcgtcggtcatcgttcctctccccgccaacgaactcctagggaagagaggggagaggtagaggggtggggaggagaggggatacgcgagtagaggttgaagtccaattacatgtgagccccacatgttgtatatttctttttaaacgactaggataccacgtcaaccaaaagaaccatccatactgttatgggacctaactcgagtggctttgtcaagatgattggtggaaatttctagtattgcggtttagttatatcaattaaaatcgacgtaaagatgagggatggcagtggacttactcccaattttctaatccaaattgtgggttgcaggcttgcgacccacctaaatttccattcgctaccggcctaatggaccagaaacattcgtagcccattcaaaacaaagagcggataatatggtgccgtgggccaatttagtcagattttaggatagatcgcaccctcccaagaaagcccagcgctagtatagaccaaaggttgcaatccaaactatagtgggtttttccgctcaaaaaacgaggtccacctttgtcgttgttgctgcatgctttgacagtatggttagcacggtacttccttcgaaccaaaataaaatatactccctccatccaaaaaaaatcaaattcaacttctaaagtttaaattttatcaaaaaaaaaaacttctatcattctacccacccttagcacgtaaaacgagaatttttttcccttcaataccctttatctacatcactcttactatttttttcaattattaagggtattttagtcattctctatatccactaattccacctcgggatactaggaatgtattttttgtgggacggagggagtacttccttagtcctaaaatataagcgattttggacgaacagacagggaggaaatgtctcatccttctaaaatctcttatattttaggacggagggagtttgacgcaactgccactaagctaaagattaaaaaaatattattatatcaccatgatatacaccacatacactaatggaattagatatgttaagggtggagtattttagaaaaataaacttataggaaaaaaagtattagttaattgcatgtatatatatacgtgtcttgtattataaaacatcggaaaaatggttgcttcttatatttttttatatgggagtactattttctccattttaaaatatactgtactaacctaggatctaaatagaacggaggtagtaattactttgatgcggttcattatgaaatttgtcgcatactcactgactcacacgtgctatttattgatgtgtattccctctgtccaaatatataaaggatattgttctaatattttatctaaatatataaggaattttgggatccctagacaatattttatcttccatccatcaactcatgtgctagtttaaataccactccaacctttacttttacttgtttatttcctcaatgatcaccatcttttgtcaatgatttgacccccttccactttcttaattctttctaaaatagcataatcccttatatatacgtacagagggagtattcattttatccattacggtttctgattctttgctcgccgtaaacggctaaacataaccgggcatataaacaatactgtactaacttcgtcctttaaaaaaaatctagacataatttggccaatcctaatcatcagccaataacacccctatctcgtgttttgtttaatatcaacttattgccctaccaaaattttagtaactttaataatagcaagtgcatatttggtttgttaccaaattttgtccacaatagtttaaattcaacactacccaatttggtagtgctaaaacttaccaatattttggcgctaccaagattttggtagggcaaaaattgacttcaaaccaaacaagcccttacatatcgaagtttattgttccctgctccctgtgcgcacgcatgccatcggcggtcctcggtgtgccggtcacccagacgggtaggccttgtgcaattgtgcaggtaggttacatgccggttggtgcagttgattgtataaaagattgtacacatttgtagtactaaatatcatatattatatttaattttttataaggacagagtaaatactttttttatataaaaaaacttaatagaaaatataaccccttctatatagcaaatctcgataaaaaagattgtctattttaccaggtggggtcatcttttagttcgatttttttttaaaagaagggagtagagttaatccgtcgtagtacagcgcaaattccaagttatcacgtctcattgacctccacgcttgccgaccacactgctccagtgctcagtcaaagcactgcctcactctcacccctctggctattctcaacaggccaatcagaccaaaaaaaaaaaaaaacactgacgtcgatctgatccaaacaacgcgcggaattaattgagcacacacggagaaggagatcggccggctgtttcccggcgcatatccatccacccgaccgcgaccagcggcgtcgtcatcacgtacgcggcgggcgagtggatgtggatttggctgcgctgcggtggtctcgccgaccaatccgtcgagcagcagccgccgttccaaaaaaccggataataagcaagctagcaaagcaagcgctggcggcttggaagggatacttcaccgatggtgtccctatcgcattcttcccacttgtcgcggtttatggtggctcgcgcgcggttttgccgcgctgctcaggtgtcgggtgcagtggattggatccgactctttcaccgggttaattgcagatttgagtcaaaaatgttcacctccactagacaggaaaccacacacccgggtttctgcgtactttttctactgtatatttagagtctcatagtaaataggtaatggtatctcatggcatcttcttaagaatcgtaaaattgcttttatttagctagatttcaactatggttgtgtttagttcacactgaagtttggaaatttggttgaaattagtacgatgtgatagaaaatttgtgtgtatgaaaaggtttgatgtgataaaaagttagaagtttgaaaaaaaaaatttagaactaaacatggcctatgcacaacgggatttttcctgtgtttcaggagtagggagtactgtacttgtgggcatgaattcagtgcgaatttggccctggaaaaaaaatgaatgggaaagaaaggagcagcagtaaatgcggcgagaagacgacacaggatgtgttcggatacgacaaaggggattcattacttcctcgtcgtattgtcagattcgctgtgcttgagccattccagaagcttccaaacactgcgatctcgaagcagagcgtctccgctcgaggtaagcagcttgccttttgcaacgaaacggtttctagaagccacgaacattccaactgtactgaaacaaacaaacacaagctgcgaaaaggcgtgtgtttgttacaaacacacactgtcatttgatcaaaaatttcaaaattgatacactcgtttaaccattttttttcctcgcaaaagttgctgtacaaactcgaactctgctactcacacatatgtgatatgtacatagatggatacacaattatacacggaatttagtttctgtaatacgcttcagatttctagaaggcaggcggcctggacgtgcccggagaactcgggcggcgccggcgcgcgcgcccacgacgcgggcttgccggcctcctcccgcagcgtgtacaccgtctggtcgccgccgtggcagtcggacccgatgaccacgacgcggccgtcggggatgacggaaacggccgccgcggtgcgcgcgtcctccggcaccggcgccacgggccgccacgccgcgggggcggaggagatggcgccgtggcgcgccacgaggtgcccgtcgcggagcatgtacatgcggtctccggcctcgggggcggcgctgcaggttctcgggcacgcgccgtcgtcgacgaagccttcttggacggcggaccaggtggacgtcgccgggtcgaaccactcggcggagccgacgaatcgcccctgcgccggcgtcgggtacccgccgacgaccaggaacttgccgtcgacgcagagcccgcgcggctcgtcgcgctcctccgccatgtcggggagcgcggcccacgcgtcggcgtccgggtcgtacgccagcgccgatcgaagggcgttcttctcctcgtcgtggccaccggcgacgaacaccttcccgccgacggcggcgcacgcgaagaacgaccggcgcgggcccggcatggccgcgccacggcgccacgcgcccgtgaggaagtcatacacgagcaccgagtccgtcggcgcccacgtctccgggtcccagccgccgacgaccaccagccgcttcctcccctccacaccgccatccaccgccgccacctggcagaacagcggcaagctcccactcgctccacccacctccggcagcggcgtccacctcccctccgccgggtccaacagcaccatccggtacgagttccccggcacaccgccggccgacgactgcttgtccgccgccgggcccgcctcggcgagctcacgccgcgcctgcaccagcgcgagcgccgggcgcgccaggccctccgccttcctcaggcggttgtacgccggcgactccacctccgccttccactggcgcgagatgcggcgcaccgccggcagctggtcgaaccccacccggatgaggcactccctcgccacctcctccggcaaccccggaatcagctcgttgtaacccatgatgctcaatcgagctggaattcgagcaagaaatgcgtgagatgatgatgatttcttggcttctcttctcttctcttgtctgagcttggtgtgtttgatgtgttttgtgtaaggcagagtggcgggagtggcatccgctacttatacaaggggaaagaagggaacggactgcggatggagggatggatggattgcgtgatttttttggggggtttatgtgggccccgttgcttgcacggctatggtttatgtttctttcagtttggctttttctagttttttttttgactctgtgacgtgtaaaattgagtagattagctcttttgagactaatctaccagtagatgatatggtttgttttattttgggagactctgtttcgggtaagaatgccacatcggatgcagtatcctttttatgttggccgaggtaaagggatgaggctgtttgtgggaattgcctgtttgtgtggaggtttatctcaaccgtcgtcatgcttagttcaacttcgtttggctaacgaactgcttagtactccactatacgacatggaaactgttgcttcgttctgcaatctgcaccaggaaaacagcaaaaatccttcgtcgggtgttgccaacttcacaggaagtaaaacaagaacgacatgacacgaccattacaattttactagtagtactgtacacgcaaatgcaacaaaagaccgagctgttatagttctacggacacctgtgccaacaaattgggcccacatgacctccaaaaatccgtgcgcttggatttggggattccggattccccttgtcaccctcctcacactttccgccggtcttctacaaacacacgtactagtagcaataagagtagtaaacacgctctgtgcaatcatgtttccatatttcaatttcactactgctactactagtagcacggtttttatttcggttagcactgtctcctctccacgcagtcgcacacgtgtagggctcagcgcaggtatcgcgcgcgtgccgcccgtggagtcgcgccactgaacaggttgatgtgccgcgtcccgtgaagctgtatacgctttgcggcgagccgggtgccgtctctgaacgctacggttttctctcctcctggccacacgtcggagactcggaggctcattattgccgaagagtgtgcacgcgtcacggcgtcaggagcagaagccgccgcggccaagctaaggtcagaccgggttcggcctgcctccatgaacgaacggatcgatcccgcgatcgagcagccgcgcggccgccggccggcgccacacgtcaagtccagcgagccggacggcgcgtgaacgtgcttgctgccgaactagcggcgtcgtgtcaagttcattgctaaacgccgggaccgggaaggattactatagtagtactaggcatcatgaccacaccgagaattgtttgctgtgcctgtgctgtgcacgcagttccgctacaccacgcgcaacgtcgcgccgcccccgggatttttagcgacagcgacgtacgcgagattagactattagagagcgaaagaaaataaacgggaggagaaaaacaacgggtgggtttctccggtgatccggacagccgcctgcctgcatgcctgcctagttgccctcgcagggcccggtagtaacgcaagtggaacggaatcaccgcgcgcgcgttcgcgggtggtgtcgggaagtggtaagccctatccgctaatcccacctcgctcgcgctgccttatctcgtctcgtctcgccacgccagggcccaggggccccccgcgtctcgcgcagccggcctcaccctcgcgattgattctggctggctctcgcgcgcgcgagcggtggggaagggtaaaaaagaaaaatctggaggcgcgcgacgaggcgtcgccgtcgtgggcgggggaggctgtgacgattgacgaacggtggcggagcggtcgctagctagcttgccacgcaatcgcgcgtggtgatgcggcgcgcgcgtcggatcgatcgaatcgaacggcggcggcacagcgcttatgtatccggaattccggatccaccatacggcctgacggtttcgatacggctctcccgctgttttttctcttcgtttttttttatgacgggagtgtgctgggagcctgcgatttctgtctcttgccacgccattaagccacagcaatcttttctaataactcgcgtctttttccgaagtctagcttaagtaagaagcgtattcttagccaacatatggaattatggataacgcttggaagaacagaagccttgctgccgtcaaaccgaaatgggagacgagcttgggttgccaagttgtttctagaatcattgaaccagctagttcgaaataaagaacgagttcactgagtgatattatctggagtccgttggtctcaagtaagacaagctgactgcagagtatgttaaacagagcaagcaatacgaactggcaaacagagtatggctaacccggtggtgttgattagtgcattaaccaatatcaaacattatgggacgtgggtatgctaaaaaatttaaaagacccaaaacagcgatggaatcaaaaaacgaagatgtcgtaaaagacgggctcgcttggtcgattcaatggtcgtcatctccatgaccatccaaccgtgtgattggtttaaggggaactggtgaagagggaatgaaagtttgaggttatgtaggaaccagaggcggctgaacctcagaatgtagtggacggccccgctcgttcgcgggtggtattgagaagtggtaatcctatccgctaatccccccgacctcgcgctgccttatctcgtctcgcctcacgctctcaccaccacgcgcccgtgttggcgcgcgggggaagagaggcgagaaaaagaaaaatctggaggcgcgacgaggcgtcgccgtcgggcggtcgggtggcggagcgcgtggtgatgcggcgcgtcggggtcgatccgctcggcagtgcgcctgccggtttcgttacgactcccgctgtttttctccccttcgttttcccgtttttcgatccgttcctagcagcgtgccgcccctttccgttgaaagccaccgcaaacctgcgtcgttttcggaggattagcttatgttggaagcgtattctttagccaacatatggataggcttggaagaacagaagctagctgctgtcaaagctaaaacaagagagcgtcctaaggtttgccacgttgttcataaaatcgctacagctcaaaataaagaatgagttcggtgagtgacaactgcgaatccgttggtctcaagccaaacaagcggactgcagaagtgcagagtatgtcaaagtcaaacagagcctgtttagttttaaacttttcctttaagctttcaattttttcaccacatcaaaactttcctacacatacaaactttcaacttttccgtcacatcgtttcaattttacctaaacctccaattttagcgtgaactaaacacacggggagtaagaaaaaaaaccgtgaagcagagtatgttaatggcttctacatcggacggcaccaaattcagatttcccaaaaaccgtatagtttcaaaaactaataagaatatcgtacccggtaaacatgattgccataagcgaggtagaacttcatcgtttggcctaataaatcaaaacaaaagccaaaatttaaatttttaaaattaaatttaatacattttcaacttaattcttttaaacattggtttttaagtcgttacgaacaaatatataaaagtttaacctagaaattaacttttattttctaataaactattttgccttattagaaaatatgggtaagtaatgaggctcgtattcgcgtgatattgcaaactctgaccctatgccaatccaaagtaaagaggtgcatcaaactcagaggatttcctttcctcactcttgttttatgaagctctttctactaccacctggaacatttggaaggagaaaaataaacttaaatttaagatattttcaacttaatttttttaagtattggcttttaagtcgctacgaaggtgtaaattgatggaatcgagaaaagaaggtgtctcgattaatggtcgttgtctccttcatccaagcgctctacacacggggcgacgctaatgggcgatcgatccccatcccctatacgctcctctcccccttcctcctccccttcttctcttcctactacaccataatttttttaaaaaaataaaaaatataaagttggaaaaaattatgtatagaaatactataaataaaaaatatttgaatttaaattcaaatttgaaacgggtatgtaaacttttgacttataaactttgggtctataaactaatatttgaattcagattcaaattcaaatttgaatcgggtatgtaaactttgggtctataaattttaggtgtatagaaaaactatatataaaaaaatgtgaattcaaattcaaattaatatttgaattcaaattcaaatttgaatcgggtatataaacttttgacttataaaatttgggtctataaacttgaggtgtataaactttagatgtatagaaatactatatataaaaagtatttgaattcaaattcaaatttgaattgggtatataaacttttgacttataaactttgaatctctaatcattaggtgtataaactttagatgtgtaaacttaaggtgtacaaactttaggtgtataaatttactaaaataggaaagtaatgcggtgtcaaaaaagaaagccagccatatggggaggggtgatcgcccaggtaagggtgggcagaaaaagaccaaaccgaaaaaacggagaccgagaaattcggtcagtacttcggtcttatgtgctagatgaccgaattttattcggttaattcggtcatcaccctcgattaaccgaattgaccgaatttcacagaaagcccaatatcagcccaagaaagcaagtccaacattaataaaaccctagctccctctctgtttccttctcctcatccacccagccgccacacccgagcgctc

SEQ ID NO: 57988 - DNA, 1746 bp, Oryza sativa
atagcccaacaggaattttgctacacacgaccattcgatcacggcccgcagccgaagtggtagaaccagcgtcccgcggcgccgctggtgggttgagccgttgagcgccattcggccgcatgatgggcaaatggtccggttaagctttggagtccatcgtaaacagccaagattggatcgctaccaatgggcttacgcgtcgtaggaggctcatgggctgaacaaacccgcgccgagaaaatgagtcggatataaagcccaaacattccgtgagatggtaagtttcggcatgtttaggcatcccaggtactacaagtttgctgtgaaaatcatacatttaactcaacctcagcagctaatggctcaagaactgatgccaccttacccatgtccacgccttccagtgttgctggcttccactttggtttctacagatctatctatatctctattgctggctttgtctgccagaatcagaaaatttaatctttttcaactagcccaatttctagtagaaaaagaaatttggctatacattcaagagcattctactgattcttttttcaaattccagacacacatagccactccgtcacaatttcggcgtcgcaatgcttttcacaataacttgtgtcattttctgaagtttagcttaggtaggagccattatcttagccaacttatggataatgcttggagtaacagaagcttagctgcagtacttttgcacaaacgcctcatctactgtgaaacaactttgttggtctcgaaccgggaaggaggctccattgctgctctcaaggcaggcaaaatttgtactgtgcaaaccagctttgtctatcttcctcagaagcagctgaagcctgaagatgaacaaaaaattcttggttacgcagcacaaagggaaggagctggcatcgaacaggcgcttgcttgttggcttgctgtggcatcgggtgcccagacatggaccatctcgaacgaagcgaacagatgccgatgccggcatcccgtgcagtgccaggggggcttgtctttcatcagagtaaaggtgcagagcagaatggaatcaaaacgaaagcttaagcttgtgctttgccactactattctctgcgcattgtcgtctctttcgttcctgcacattcttggagattggtggcagccggggatcgtggacgatcgaagcagtgacattctgcgctctccggccgctcaatcgccggcgccgggggggagatcgagcgatggagtcggtggccgtgaacgcggcgcggcgggtggtcagcaaggcgctgagcccgctgtccggagggttcgtggaggcgtgggtggccagcaaggagctcggccccaacgtcggcgccgtcaagatggagctgctgtacgcgcaggggatgctcgacaacgcccgtggcaccggcggcagggaggcccgcagccccgcgctgaggcagctgctcctggagctgcgtggcctcgcccacgacgcgtcgacgccgaggacgtgctcgacgagctcgactacttccgcatccaggacgagctcgacggcacctgcgaggccgccgacgagcacgccaagggctgcgtcgtccacaacctcttcctcaacactcgccatacagccctcagcgtcgcgagcaacctagtgctcctcccgtgcgctggtgatgatcaccctgacgctgacggtcggcggtcgggagaaacaagaaccgtcagatcggctcctcgtgtgctggtgg

SEQ ID NO: 57989 - DNA, 2351 bp, Oryza sativa
tagagttgttggaatcaaatcgcagcattggccagtacattgccatgagtctcaatgccgagttttccaagaaaccagggcatgcacctgttcttccaagcggttttgctatcagtcggcctatgaccacttcagagtttacagatcctacagtttatgggagaatggatgaaaaaaaatacaactattaaaaacattactcatggtgattactgtgacaaggacctgaccatcattccaattgttggtccaggggggatagggaagacaactctcgcacagtatatatacaaagaagtacataactactttgatgttaccgtctgggtttgtgtaactcccaatttcaatgtgtatagattgaaagaagacattgccaagtcgatccctcaactcaaagatgagaaaaacagtggtccgcatgatttgattgtgcaaagcttgggatcaaagtttttacttgtcttggatgatatgtggaattgtggccacgaggatgaatggaaatatctattagcatctctcaaaaaaggacaaaccaagggaaacataattctagtcaccactcattttctagcagtggtagaaatggttaaaacaattgatagtccaatacaactaaaagggcttgatcctcaagagttttgggaattattcaaagcatctgtgtttggtgatgagaaatcagcaaatgatcatgctaatttacttgagactggaaaaatgatatcaaaaaaatctgaagggttcccctttggcagcgaaaacagttgggaggttactgaaaaatcaccttgatttggaacattggacaagtgtcctggaaagtaaagaatgggaattacaaaccggtgagaatgatattatgccagcattaaagcttagctacgattatctcccttttcatctgcaacaatgttttacatattgtgctatgttccctgaagaccataaatttgctagtgatgagataattcacttatggataggactagacatcctacattcacaggatcaaaacaagaaaattgaagacattggattgagccgattgaatgatttggttagctatggattttttgaaaaacatgtagaagatgggtcttcatactacgttatgcatgacctactacatgagttagcattgaaggtttcatcgtatgaatgtcttaccatatgtagttcaaatgtcaaatctatacaaattctaccatctataagacacttatctattgtggttgatgacatggacgtaaatgatagagtgacttttgaaaacatcaagaaggatttcatcacattaagtaagagactagatgttggaaaactgcactcattgatgctatttggacaataccatggaagctttatcacccctttcagtgatttgttaagaaaagcacgtgcactccgcatagtcttgttgtctatgccatcttatgctatagtcagtatgttgcataacttttcaaaacttgtccatctacgctacttaaggatcaatggaggaaaattttcagaattaagtctacccaacatcatatcaagattttaacacttgaggaaaattttcagaattaagtctacccaacatcatatcaagattttaccacttgagaatccttgatgtacgacaatgcaagggtcattttggtttaccaagagatatgaataaccttgtaaaactgcggcattttgttgtccaagatgataaactctactctgacattgctaatgtgggtaagataaagtgtttacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggttgggtcctaacttatctatcaaaggtttgcaatcactttgtataaacggtgtatgttgggacaagtttccacctctaggggggttgtggttagttaacaagcatggtgaaaaattcctggcttgtgcaagtggccgcagcttccagtatttaaaaaggttagagctagttgctataccaagactagcaaaatgggccggaaatgatgcttgttgtgtgctctccctgttggaggagtttattgtaagagagtgcccacaactcatagagttgccattttcacattccacttgt

SEQ ID NO: 57990 - DNA, 1129 bp, Oryza sativa
gtacccacgaattcagaaccccagagtccgcacatcctcaaatacaaagcacttccctattagatgtaggttagacttgccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccctgttgtcctcctctggggcaacaaacagcagccgagttggctctggccggaaaggtgaccaaatacacggc

SEQ ID NO: 57991 - DNA, 14883 bp, Oryza sativa
catacagtgacaattttatcccggtatattaatcaccattcagtatattcattcatattccataactgtgcatttactatcttcttggatctgtaaagtgtataaagagtgcatgtctagttaagaagttgattatctgcagctaatttgattagtagcatacatatgcttatattcgctgttgatcaaatatccaattctttgatttagtagttgtacgggtatttgctcacttaacatttttttggggtgtttctttaaggtccactatacctctgagaatgttgttgagggcaagagtgctgccaaaaaggcattgcaacagaggcttggactacagcaaactgatacccctgttgttggaattatcagtcgtctgacagtccagaagggaattcaccttatcaaacatgcaatttatcgaactcttgaacgcaatgggcaggtctatatcttgctcatagatgccacactgtttgatgcatatgtttcttgccatctatctgttattctatttttcaatactgaaacacattggctttcttaaataggtggttttactaggctcagctccagatcatcgcatacaaggtgactttaccaacttagctagtaaactgcatggcgaataccatggtcgtgtaaagctttgtttaacctatgatgagccactatctcatttggtaagtttcacactctaccaatagcaacttatgttagaactggaaaactgatttatagttgtgtactaaatctatggttctactgtattgtagatttatgctggtgccgacttcatccttgttccttccatgtttgaaccttgtggtttaacccagcttactgctatgcgttatggatctatcccaatagttcggaaaactggaggtgcgttgtcatcttgatatctccctgacattgcattgccttttggtatttctagcatcgataaaagatacgccgagcattatgcaggcctttatgacaccgtttttgacgtcgacgatgataaggatcgagctcgagaacaaggtcttgagccaaacgggttcagtttcgaaggagctgacagcaacggtgtggattacgcccttgacaggtaagtataacccataggagttaacacaaattttaatgctacgacgttaataattcattcttttgctatccaatttcagagcgatcaccacatggtatgatgctcgcgattggttccactccctctgcaagagggtgatggagcaagattggacatggaaccgacctgctctggactatatggaattgtaccattccgctcgcaagaactgagacctttctagccccaagaacacatggattttgggaagtaggtttccccaggtttctgggacatgccggcatcccagtacataccctttctctgggtaccattctttagacagaaagaaaatgaggagaatccaatcccggcttctacattgatctccagcgtcagtaagagatcaattaatctttccgttatcctgcggttgtgagttcgccatcgtacggcgcccgtgcgtatgtgacatgcaggaagctcatcgtgcttaaagccagttttgcaaacatgtaccatgcaaatatgttccattttacgattctgcagtgtttcggatgtacatatgtaaggcagattagatttgtagggcggatgttctctctggtttattttctgctcactcggagaaggaatgaagtgcgagcagaatggcatgtgacggcctgtgtagctttttaatttctcgtgctgacatctcaaaattgatttcaaattggcagcgtgaaccaaaccatcaattgaatactctaaaagtttcaaagtttttaagccaatatcatccatgctcattatattactggcattattttgtatacaatcattagtcacacacatatcaaacacaaatccgtctctccatctgggttcacatgtatagatgataaatatacgtccacggttcacgttgtgcttcacttagcgtagccgatgctgacgccggcgacggtgaccgaatcgcagccacacctcggcacgatcgacacgacgatcgtcttgtcgccgtcggcgccgatgtcgtccagcaagtcgcatatgccgaacctcgcctccgtcttcctcggcgacagctgcccctcgcggtggatcccgtgcggcgccagcgcgacgctgccggcgcacgtcgccgcgcacgtcgccgcgccgtccccgctctcgggcgcgttcacgaacacgtcgaacttgacgtacgtggagtggtcggggatctcgacctcctcctcctcctccttctcctcgcggctcctcgacgccctgggcctcgtcacggccacccgcacggtcttgtccagggtcgccgggaacgcgccggccgcgggcgccggcgtgctggctgctcccgtggacggcttggcgttcagccacgggagacccacgtcctggtacgtgaagcgcagcgccgacgggtcgagggtgtcgcggacgcggacgcggacgaggcgggcctcctcgtcgtagaagaagaagctggcgtcgagccagtcggggtcggtgaagtcggtgtcgccggggaagaggaggccgcggcggatgtgccacatgcggtcgacgttgccgtggtgcgcgaagaacaccgggtcgcgcgccgccgagtagaagatgcccatgtcctcgccgttcggctgcctcgggtcgccggtccatctgtggacggggttgtgcggcacgctctcgacggtgcccgcccccggctccggctggtcgccggcgcggtacggctgccccatgaacagctccgccttcctagctcccgaaatcatctgaaacatcataaaattttgttcgtccaatcttaactcataagtcgattaatttggagtttttgtcatctattattatttatatcaaaatttgtatgtgattactggcctggcggtacatgatgttgaggttctgatcgatcagctggtctttcgggatgttcgtgtcggttccactgtagtcgaggtcgagcgggaacggtggcaggtgagcctggttgcgccgcgggtcgtacagcggcgaccacctgttggcgtacatcgcggggaacgacatgccgtccggcgcgtcccagttccagaacggcagcgcgaacgtctcgtcgccgatcagcttgcccagtatcctctcatggaagtacaggtacatcctgcacgtacgttcacacgcatgcgtccagcgttcacagaatctcatgagccactcaaataatcctctcatttttacatgtcaagtaaaaagtcatcaaaaaaattaaaaaaatatagcagtatagatcaatattacatcaatatataatatgttatttcacaaacatacaaattcaaattcaacttatacaagtagaaacaaaaataacaaatttaactgcgtaaatcacggtcaaatttgttgtttttgtttcgaattgtataagtcgaattttaactcgtatgtttgcgaaaaagatataccgtatattgatctatcttgacaaattttttaaattttttgataactttttgaatgacatgtacaaaataagaggaagtcgtaaaaaatccactccccatatatatcatgcatgcaactgtacacgaacaacgcgagacgtgaacgtgatgcagccatgttgtcacaatgtcacgtacctgtgccatgggaagaagagccagcagctgtgtatctggatctccaagccggggaagccgacctggtcgtacgcgccgtcgcagtaggcgcagtggacgcgccactgctgctcgaagctgcgggggtcgtcggcggggagcttcttcatgagcgacacggccctctcgtacttggccaggtacgccctgtccgccaggtgagccgccggccgcacgcggagcggcgaggacgccggcggcggcgcgaagtcgacggcgacggtgccggcgctgtacgtcgggcagcagttgatcgccggcgccgtggcggggacgtccacgggctggtggcagtcgccgaggtccggggcctggatgggcgccgcgagcgcgccgccgccgccctgcgtggccaccatggcggccgcgccgctgatgccgaggagcacgtcgcggcggtcgaccctgcaggacacgttccgcggcttccaccccttcgtcttgcggtgcaagagcaggttgttgtagcgaagggtactctggaggttggtgatgcacggcggcggcggcggcggcgccatgcgaggcgtagcggttgttcctggtgctacgttgatgctctccatggcggcactgcgctgtgaacttgcacttgcaaagttgcaatagcgtgtgtatttatagggcaatgtgtatactactatactgtagtagcccactggttgtttggtactttggtgtgaccgtttgcagggccgcgcactaacaatttgggagactgactattataaaataggatcttattcataaaaaatactaatcacacatattccctccatcccaaaatataagtatttttagactctaacaagatttccgagatgttactttaactaacaatatctataaaagtaggatgttttaaataaaaaggttatatattataataatttgtttaatgatacatctagtaacatcaattttatatgagtgatatttttttctattaatagttagagttgaaaatgtttgatctatcactatactaaaaatgcttatattctaagacgaagggagtaatgtaccaagactgtataattttttaatatattggaatgggtctctacactaccactgctctttgattaatcttcatgacaactagtggccctccaactatacattaggaaaactagtatcaatctaatgcttagctattgttgtagtaattaagtttctcactaaatagaaaattgagatatgattcttattacctggaaaacacattcttatcatagtcacggaatacagttcatcttatcatcgaacatttattggagcagagagaaaataattctttctactcgattcagtggaacagaaagaggaaatttgaaaaaacgaagtgaaattaaaagatcacatcgaaatatattaattaaaataggaacacacaccgatcaccttctactggtgtcgtgtcacactgtcactttgctacatctctacctagtgcacattagcaccacatataccaagtcaaacatatatccgtcacttaagcaatcccgttgagagatatcatgtcagctcgaagtagttcagagattaacctttcacccagcggctcgaaattgtcaagtgaaccagttaataactatgcacccgtcaacaacagtttcactgtcgttacgcaaatcggaaagctcccaaacgacctgacctacgagagcgttgggcgaaacactccatcatcctgtgcgtgaatcgtctgaatatacacgcaattcatccggccaactccgctacggaatcacggatatgcatggatgatggaggcagttcatcccaggtcaactaacccttgcctaaaacggccggagtttcagttcaggccgggcggcgtacgtcgtttggacgctgcaactagatgactgatgacttgtcggcgtcgttccgccgtccccggcgaaaaaaatggatggctgacaaaaactgcgacggtgaagaacgagcgaacgtcgttgatcatatcgggtcctttaccataataacaatatcattagagacactgatatgtgaaacaataggagagtaagacttattccctccgttctataatataagagatgtgacatatcctagcactatgaatctagacgggctctctatacagattcatgtattagaatgtgtcatactccttccgtttcaaaatgtttgacaccgttgactttttagtacatgtttaaccattcgtcttattcaaaaaattttaagtaattatttattcttttcatatcatttgatttattgttaaatatactttcatgtacacatataattttacatatttcacaaattttttgaataagacgaacggtcaaacatgtgctaaaaagtcaacgatgtcaaatattttaaaacggagggagtatttctttaaaatctcttatattatggaacgaaggaagtacataacagtcattgtaatgatagtgatattatgttagaggatcctcacccaatcagatcagatgtatgcgatgtgtcaaacacgtggcagcaacacttatagagctattttggtttgaagccgtaccaaaattttggtattgccaaatcttgggctagttttggcactaccaaaaattttggtagggctatgttgcttctaactctattgaattagtaagatttaacctcaatctaaatagctaacaagtactacaacactactaccaaataattggtagggcaagaattggttttaatccaaacatacctttaagttcttaaaggttgacataaacggggttggtgtgcagtgtgctctgcctcgttgccctgatggcttgtttgggcctcagactggtccttccacatgtataggccaggagattgaacttaaattttggcccatatacataaagagagaattacttatataccactagaatttgaccagttcccttatatgacacttaaaattggcttctctctagttcaagtttttccaaccttttatgcaactcccaccactatagtgttagttgactgttagtaaaggatagttttttttcgtaaatgaccaatatgccctctcaactaaaaaatgtgtaaacttcaaaaaatcataactaatttattttaaatcttttttgagtgaacaaaattttgtcagaactagtgaaaaatgctctttatattaaaaatattgttggaaaactgcatgattcatgcttacattgaaaatttatttgtgatggtaatggctaaaattgcatgtgatgcagaaaaaaatcaattttcatatgttgtatccagtagttatattagtactaaaatacctattattggttgtatactaattcttaagggcaattgcgtctttttacaatgaagttaacggtcaactgacggtggactgacggcaatagcataaaagggaggagaaacttgaaccgatggcataaaagggagaagtcaatttaaagtggcatataagaaaaccggttaatttagagtggcatataaggaattctctcatacataaatggtctgggagtgtggcccatccgaacgaggcctgactagcgaaaaggatagagcactgcagtcagcatagagaataagagagtgggcctagaattgctgctgaatggatcgagctgggccgagccaggtcatcgttgacactcctcgtgaacttaaggaaaaagtgtatttcaaatccttcaactatggtcgaatttaattcacatctctcaactgtaaaaccatatatatgttatcctctaaatttttaaaacggtgcaaataaaatcactcgacaatattatattgatccagttttttagttttcaataaaaaaagttagatgaaaccctcgtataagtctctcgaacaaaaataaagaaaaatagtagaaccttttttcctctccctccctccagtctctctccccttaattttctcaacacctcctagggggtggcattgagggacctaggggataagaggatatcattgccatggaaccgaggagatctgtctgacggtagaggtgggcattagggccaggatgatatcatgatagagatgggttcaggactccacaccttgggcactatagcagtgtgtcccagcctcatcaagaaacccaagtatcaacgtaggaaaaaaaatgatgctccgatatccatagttcgtgtagctttaggtgggcccaccaccattgttttaggttggccccaccacgaaaattactatcatcgtcatctccttcctggagcaacatctcccacacccacctccccaacctccgccgcttgttccccatttctctctcttgtcctctccctcacttggcttcccacgacggtgcctcccgccccctcctcctctccgtcctctcccatggcgacgactcccccgccccccctctcctcccaccggcgccgcttgggagaagacgcggcggcaccgggccctctccccttcctctccctagcggatctgttggcagcgagggtgatgacagcgagcgcctctccccttcctctccggacttctccctcggctatcccgagcccacgcggtggcgacggccttcctgagtctccagtcaatgccgccgtcagtcccctcctcaggtgacacagatcgggagctcggccgacggcagcttcctcgacagtggcatcatcgttctctactgctcaatggtggcggaaatattggaggagaggagctgaagcttcctacccctttccgaaggcgcgacatatatcttcttgcttttttttggcaatgctagctgaccgggaacaagtgtctctcttttaatgtgcgggctttaggtgagtagcatcagaggcaaacatggcaccgtatttttcaacgtttcatgctcgggctgaatgacaaatcggcgcaccgtaaacacccataagtagtaacaacggcgttttaggcatagggatgagcaggggagtggtcaacgctcccctacgagctgtgctgctgcttggtcgcgggtgctcggagtcagttccgttattatgggcggtcgctaaccaagtcacaacccccaccaccaccaccaccaccaccaccttgaagcagaagctgcacaccgtttagatcacgcaaaaattgaaagtttggttgaaattggaacgatgtgatgaaaaaattagaaatttatgtgtgtaaaaaagtttcgatgtaatggaaaaattaaaagtttgaaaaaaaagtttagaactaaacaaggcccaagtcgccggatctcactggagccgaatgggttcagtttcgaaggagctgacaacaatggcattacggctactccatcgaagtacgcccttgacaggcaagtacaacgttaaacattccttcattagccatccaatggcttttgtcctgctattgcaaattcgcgaccatgcgacgccccgtacggatggacatgctgattctgcccaaagttctgcgattctgcagtctcagatctactacatgttaccccttaaaaaaaagtggattaagtcttggatattcatgtcacgcttttcaaactattaaacggcacgttttctgtgaaaattttctatatgaaaattgttctaaaattttctatcagaataatccatttttcaagttcgcaataattaaaactcaattaatcacacgttattaccaactcgttttgtgtgaaacacttcattttcatctttatctttatcttcatattcaggggattcaaacaccacctctgtaactcaaagattagattctttggacgcaggcccggcttagagctacggcgaggagtgcgacggcctagggcccaacgtaagtaggggcccaagatcaggtaagtaagtacgaactggtatgccgtatacgtgcgtttacctttagaaactacatacgtatatactgcgagcaaatgcgtggcgattgtttgtggtgacggagcaaccgtgtccaactgatcacgtcattgctgcctccgtggaaacatgacctcacaaccttcagttttcaggtactattcttgagtgagtttgtattcaagtaagaagtaactaaggagtatgtctcttaactatctcatctgctcggtgaaaggccaaattaccacgagaacatactatgtttaggccctatgacaaggcttggctgtgtgctaagttgagaagaatgtgatggataatattaatctcattacattttttaaagattttgcatcaaaaatgtttaaaggagtgtatttttttcgtgagaagccatggatatttgtaatctctttatttgtgaggtattattgatagagtcgttagacagttagagtttgacctttattcaaggtattcatattagctccattttgatgttctttagttatatacagaagatgttcaatgtttatttcatcagaaaatatatggtttaaaaatatataaatagaaaacacatattaagagcctacaccatcaagctcgccctaaggcccttcaaattgtagagccggccctgtttggacggatgctctctttagcttatcttctacccatcttaagagcgtgcatgcctaatggcatgccatctgatctctgaagccttaattcctcgggttgttatctgaaaaaatgatttcaaattggcagcggttaccaaatcatcagttcatgcacgctgatgcacgcattatttttatacaatcatatcctataatactatataagtgatccttacttagtgtagttattagcaattctctttgttcttatgcttccacgtcaccaccctcttttctttcagccattcgatgttaattaagcgtctagcgtcacatgctaggaacgttgcacccaacgctacatgcattccgcacgcttgccgctgccgtcttcaattctatcagggaatgatacgttttctgcgcagctcgatgattaatgacatacgggtaactaatgtggccgaaactgccaaggatccaagtagtccaatacgatataagtgattgcactaccgttttccccaagaggagctcaaaagtcatgtctatcctataaaacagaagcatattcattcagggaaaggggttacaagttcaatcgattggatgttcctctcatcaccttgatcatcgttatccctaaaatcctaactaccaccggtgggcattgaggttgccatgcttgcaaagtctgggagcttcgctcaagttgcctcatgtagatcaacatcacatcgccgatcaatcaccggtcaaattgcaatttccttctgacttgggcagttgggggtacaaaattgaaggagataatctctgtaatcatattctatttatttctaccggatatatcaactttaccgatgtacaaatacatggtaacaatatccctttctgttgcattagtttatttttaaaagaaaaaaacaaaaggttgttatacatatattagctagattgttgtttgtcttcaccactatatatatgcagctaagtaaggccgacaacatcatttctgatcactatcggctaaatcgtccattcggtctggtcagataagacatgagaggtgctattttacaccgcggcccttttgttaattattattttacaatttttaagttggtttccttgcaaattatatattctcaatccattaatttgaactgtttgaactgagttttttatttgacaatcgattataacaaaagccagtactgatcgagaccaaattacatcatgtatagtttttatcattgatcaatcatcaacgatgtggaccatcaagtttttcattgagttttatgccttacactcaattggattcatacctactttgttatttggcttttcttttgtaatgatattaatttaatcctgtaaggcagttaaacaagatgttagcggtagttcaacacgatgttagcggcggttcaacaagttcacatctctaaaatgatttgtatatcccgcagcaacgcgcggggtatcattttttaatgacagacccacacgcgcctacaccattacacacgcaacatcacactcatacaatcattaatcacacgtcacacattgtacataaacgtattcttacgttcacgttgtacttcacttagcgtacgtagccgatgctgacgcccgagactctgaccgaatcgcagccggacctcggcacgatcgagacgacgatcgtcttgtggccgtcggcgccgatatcttcgagcaagtcggagatgccgaacctcgccaccgtctttctcggagaacgcttcctctcctcgcggtggaccccgtgtggcgtcagcgcgacgcgacgtcggcgttctcgggcgcgttcacgaacacgtcgaacttaacgtacgcggagtggtcggggacctcgatcccctcgatgacaggcgcctcctcctcggcgtccttctccttgcggctcctcgacgtcttgggcctcgtcaaggccacccgcacggtcttgtccagggtccccggcagggcgccggcgggtcccgtggacggcttggcgttcagccacggcagggggccaacgtcctggtacgtgtaccgcagcgcggcctcgtcgagggagtcgcggacgcgaacgcggactaggcgggcctcctcgtcgtagaacaggaaggtcgcgtcgagccagtcggggtcggtgaagtcggtgtcgcgggggaagaggccgtggcgaatgtaccacatgcggtcgacgttgccgtggtgcgcgaagaacaccgggtcgcgcgccgccgagtagaacatgcccatgtcctcgccgttcggctgcctcgggtcgccggtccagttgtggacggtgttgtgcagcacgaactcgacggtgcccgcccccggtttcggctggtcgccggcgctgtacggatgtcccatgaacagctctttcttcctagcccccgaaatcatctgatacatcataaattatactgttcatattagacacgcgatccaatttaaagtcgactaattaatttggagtttgctatctacggttttcagtagctacttcaattaattcctagtttgtgtcaaactgtgtatgtgattactggcctggcggtacatgatcttgaggttctgatcgatcagctgatcttccgggatggttgggtcgtgtggagattatggatatcccatatctacacggcgatgatatttggactgaatataggataccgaatatagatagaatatcttatgtgtatcctgggtttgtttcttaacttgtacatcaaggaaacaccttgagacttagtcggtcacgactgtattttatctgtatttacatattccgttagggatatagattatcttttgtaacacggactctttcccatatataaggggggtccgggtgcctctaggggcggaggttggattttctccaaatcatacaatcaataacacactcggcggattcatccccggacaggagtagggtattacttcttttgtaagaaggcctgaacctgtataaatcctttgtctccaaacccatacactttcctagcttgatagccacccccttttattattgccgaaatctagtttcgacagttggcgcgccaggtaggggtagcgtcaagcttttcgccgatcagtgcaatgggtttcgtctccggcatcgacgacctcgtcttcccgcccgggcagacgtttcggttcggcagcctcgacttcgtcaccaacaacttcggcaagatttctctcctcgactcggaatcagaccagtcgggagagaaccggatttcggtcccgtttggattcccgaacgcggctgaaagctacttcaagaccatctcaaccgagtcggacttcaaaccactcggccgagatcgcatcttctccaacgacaccagatcaagatgatggggcttacccaccagtcctgatgaagctccccgacgatttagcggccgtttccaccacgacaacgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcgacggaagccttgatgacaactacacccctctctactttggcgttttcatggccaataatgagacggaggagcaacgccaagcctgggagaccgaagaacgtcgccgactggaggaggagcatcaagcacaagaacaagacggctacggcgtgagcagcaggaccgtgagcggaccgcgaaggaggctgaggatcgacgtcagcgagctttggaagcagggcgccgagcgcgtgatctcatcgaccagcaagatgtcgaagggacaccggttttccgcacccctcaacagaatgcggttgccgcgatcacccttctcgacaccctcctcaaccaaaacgagctcaatcaatccgatcacgtcgtcaacatcttgaaccagacgaagaccatgattgcggcttcggtcccagttaactccgaaagcgtccacacgccgactggcagccgagtcccccacttccgatctcatgactaccgtcatccaagcctcagcatcaccggcgcgggatccaatcgcaggagcaggggtcacgacgagcggtccattcactcacctcccgaccaatatagggagcgccgagtggaacggcctcgctcaccacctcgtcgccgccccgtcgatcttcgcgacacaatcatacagcgccgagcagctcgaggccatcatcattcgccgaaccgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagacaacaaggccatggcgaactatttaccagtggctttagcggattcggcccgatcttggctccatggattaccccgtggtacaattggatcttgggctgaattacgcgaccacttcatcgccaacttccaaggcacctttgagcgacccggcacacaatacgacctcta

SEQ ID NO: 57992 - DNA, 1644 bp, Oryza sativa
tgacagtcaagcttatgtttaaaaaagccaacgagtacgccaaggctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgctcgcaccatcctaactccaaccacgtggccaaagattgtttcgtctacaagcaattcgcggatcaatacaccaagactgcacggaagaattctgacgaagaacaaagcacgtcgaggaagaaggacgacggcgacaccccggcaggttttcaagatcaccgcaaggagctcaatcatatcttcggcggccccctggcttatgagtctaaacggaagcagaagttgactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcactccgagttaaaaccaagcaatgcgccttttcacggagtgattccaggattatccgcaactccactcggccagatcaccctcccagtcacttttggcactcgggaaaactttcgcacagagaacatcagctttgaagtcgctgatttcgagacagcataccatgccatactcggacgcccggcgttagccaagttcatggccgtcccgcactacacttacatgatgatgaagatgcctggtccccgaggagtcctatccctacggagtgacatcaagcaagccgtcacatgcgacaaggagagttgcgacatggcccaaactcgcgagatggcgtctgcccgagaggatatccgactggctgcagccacggcgagcgaaggagaagagcccgctaccaagatttcaaagagtggagaaagcgaagccaagactaagaagattcccctagatccctctgatcctgctaaaactgctgtaataggcgccgagttagattgtaaataggaaagcgcgctcatcacctttcttcagaacaataaagatatctttgcgtggaaaccatctgatatgcccggtattcctagagaggtgattgagcattccttacatgtcaaagaagacgccaagcctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattataccgacctcaacaaatcctgccctaaagatccttttgggttgcctcgcattgaccaggtagttgactcgaccgccggccgtgagcttctcagttttttggattgctactcggggtatcatcagatccgactgaagg

SEQ ID NO: 57993 - DNA, 1736 bp, Oryza sativa
cctgcagccctgctgcaatagttaaccatggggcaaagattctatgaagtattcctttcacatctcaatatactatcagatacgggtctacatactaggatatacaatccatccagctcagctcagtgcagtgcatgcgttgttgttgctgttcgtcagaagacaaggatcagtcatcctacgggggataaggacggcagcaacgacggggcagtgtgatgtggacaagtagagcattatgcaagcacgacgaacacacgcttgctcgtgaaggttgcgtcacgtctgacgaaatgaaagaaaaatagagatttgtgcatctgtagaattgtagaaatggagtggcaatacacagtggttggagttggactgaattactgtacttgatcttgatcgatcgatcaatttggtttcttttggattcacccgagttcatctgtaagacagaaaaaaatccttgcaaaaaggaggacgaataattagagagaggttaactctattccctgctgcactgcaggatgcagacagtacacttgatactgaaagaaccttcagaaccaactgatgaaaacgccagcgtatagccccacgcttagcttctaatctagctgacgataagtctcgatttcgatttggatgattaacaaaacatcacatcggtttggatcttaaatgtaagattgattttgatcgaacttaacagcttatagtttatactgcaacgaaaactgaagaaagcaagcttgctcgctacagtagtaggaactaaatttaatcaggccttggccaaagaagatttagcacataaatgttggcccaaatatcttactcaggccgtgcttactcagtacactccggttgtaatggggttcggtgactaaaaccacggaggaacgggccgttagattcggcccatctctcaccaggtcgaaaggccccaccgcacagtcacacaacgccgttaggaaaaagtctactccgactcccttcagaaggaggccactctaattcgtaccccttaactagaaaactggatcagatgactccttaactattgaaaccagtgcaatttgactccctcagaggttttggagggcgattttgctgacgtggcggtgttaatctagtcttcatcccacgtgacacttatgtggcattagaattaacaaaaatatctgtaggacccatctgtcattcacactcaaatatattgtgggacccacaaccatcctctctctccaacccctcttcctcccccctctctctctcccttatcccaacatgtgaggggggacctcaccaggagactgcgcatggggaaggagctcgctggccagtcgtgcgctggggaggatctcgctgggaggtcgtgctctgagaggagtcgtcagttgggcacgcgcagaggagaatcttcccaactaagcacgcgtgtgggaggagttcacgatgtcattgtgggtgaggttcctcacataccaagcaacgcaattcgtgtcactctctgttgccgcctcctcaccgacggctgtggcccttccaccaaagttttcctcacctctctgtgcccctttcgtcacccttccccacatccgactcccaccaccgactctgtctctatcacccggtagcgttgtcgacgtcccacgtccatgttgcttgggagcttagtgacgccgctcgcgatgcttctgtccatctccgtcgcgggagacccttgctgcttgggagcatga

SEQ ID NO: 57994 - DNA, 2747 bp, Oryza sativa
cgccgctgttgttgcctcgcctggccgccgcgcgcagcctctgcaccgatgctagatgaggataaggggagaagccaagggaagaagggttggagagagaggatgggggtcttgcaatatgttttgagagtgatggtaaatggatcccacataattttttttaattctaataccacataagcccccacatgggacgaaaatcaggtcaacaccaccacgtcagtaaaaaccgttctccaaaactgctagagaagttaaaaccatcctccaaaatcgctggggagttaaattacactggtttcaatacttcgagaaactatccagtttactcgcttagggataggaattagttgcggcatattttaaggttgtcaaatggacttttttccgcgccgttatcccccaccacctctgttaactgaccccaccccgtctcgctcgccgcatcacgcgccgcgcgacacaatcagttcaccaccgcagccacccctagctaaatccctcggcggcgggggaggtggcggcgtgcgtgggcatctcggcgggggtcgtacgctcatgtcggcgctggtaaactccattccttcctctctctctctctctctctctctctctctctctctctctctctctcgtggtgatgttatgcctggatgatctgggtagggtgcggggggaggagatttggggggagttgggactgttgggagtagggttctgggagggatactggctgtactgaacctgcagatttcttatttgtttctcgctgggggaggttgcgggagttcatagctgcgagcctatcttcctggttggtccgtgaaactgaaaaattagtccattttattttaagaggtgaaatgctcaagcctgtctcaactatagggggtgctggattggatgatgtgtgtcgacaggagtcgcacgcaggcctcatgccttccggaagttcagctgcgcgtgaaaacatcgttttttaaatttacccttttttaatgcaatttatcctgtcttgtgagttcctttcgtttgctacgtttagaacgtattgactttggaagataagtcttcttttgggggggaggttaaatttcatatcgaaacactgtgaggttgattacttgccatctactctgacatggtagttgtgtgggacaatgtatacaggtttggctctgcgtattggttttaagtggatttcctgtgcacaatgtcatcgattcttcgatccattcagctgaggaacagtatatggagtagcttccctgtcagatttcttaagcaacaagccggattatcaactgtagaattgcttgatcctagaagctgtgggaaacgacatttcacaacacaagtacaggaacatgggaaggaagttgcggcggcagcaactattctagtttttgatcttgagactactggctatttccataaggatcatagaatagttgagtttgcactctgtgatctttctggaggaaagaatagcacttttgaaactcttgttaatcctgaaaggactgttcctgactacgttgaacatctcattaaaattggcactgatctcgtgtgcaggcctggtatcccaaggtgtgttttgcatccaacgaatccatattattcctaatctcttcatcacatgtcttgataacagtcgtcgtcaacatgccctgatgtatttgtcactcaacatgatgctgtgaacagaccatagtattgaattagttatggaaaatgtatgcaatagctctgtattccctctttttcacaagcatgcatgccattaaggcaggttttattgtaaattatttgcttgtaggaataagttagtttttgcaatggaaaactggttatgcatatctcacttcaccaacagttaatttactatttcacttattctgaatgttatcttaatatgactaccacaggtttagtgatgtaatcccactactattggcattcgttcgaagtcgccaagctcctggcaagccagttctgtgggttgctcataacgcaaaacaatttgatgctcgtttccttgctcaggagtttgatcgttgttcagcaccacttcctgcagattggctgttttttgacacccttctcttggcaaaaaagatggtgaaagcagagggtaagtactctcactctaagtcttttgcatgtgaagatactgtatattttggggtcaatttgatttgagcatgcgaaaaaaaggacacacttctcgcagcattttggagtgtgtcattctcactatcttcatccttttaagctagattcttcatttaattacgactcactatctgcttgccaggagcatattgagtaagatgaaacccacacttcatcttttaaccatgcaaaaagagtgcttctgttaggatgttgtgtatggtttagtagtacaactcagtttccatgtttctgctattagcaaatccgtagttcttggaatttgctgaccgttcttgaggtttttatatgacattgtattgtttgtcgaaaagcgaacatattattcttttctggaagttcccgtatgtactgctttgagtgtatgtcataatgaggattaacagaaaagtgaaatgctgatatattgtcctagttaggagcagtagcttggagctgtacatatgttggggcccagttagggacacatctcattttattttgttctgccttactgttttcatttctcaattagttccctatctgtgctatttggtctattcatttaa

SEQ ID NO: 57995 - DNA, 6329 bp, Oryza sativa
agatcaatacatcctggtggaagttagttgggacctgttattcaatctaacttcagttcaataggatacagcggctgcatttcctgcattagtcattggtttctctaatttagtagtatgattgatttgtagtagaatgaagaagcgctttagtgtttattttgtcactgtcaactctgtttgctaattttggtatcttgtatgactttggatgcaaccaactttctcgtctgagctcttgtttctggtatggtgctgatgccatgttggaattgcatgttctgaatgttacaagcgtcagtgttttacaatcttgttgtagccctgtgcaccatgacttatttttgttccacttgattagagagcgctgcagaaattacttgtttcaatcgcatattattcatcccctttgtgaccatatgtttgtcattttttgcttccctacgatacttgttgaatactgctcagttgaaatatactagggactgtaatgcttggcctttttcttgttgccagctcccgttccatgtgttctgtgattctgtctgcttgctttttctatggaccagtttcgaacagcagtctgaaccagagagagaagaaatttagatgtctcggaggtaattcttttttcagatcttaagctacctattcccaattaccctgctctctccagtttgactggagtattaatagttctttttgtggatttaattgctggtaaaatatatttgaagatattgttcattgaacttttctgagtgtgttcctctgtttcaatttctgttttctatcatgtgcttctctgctccaaacccgataaattgcaaacatgttaatttcttgattatttccatgtatctatcgacgtttttttttaaaaaaaagaaaaacatttacatggctatttgttttgaacccaatctcgctaatcgtcttcattcgttatctggtgagcagcgacctagtactctagtaggtggatattggtgggttccatttgcatgatcaattaagattatctgtttggttttgaggccatggcctcagatgccacttcaacagttgagctatctcacgtttacctagaattgcatgtatattgtagcacctattgcagtttaaattggttatagaatcgcttgcatattgtagcacctactgcactttaaactggttatagaattgcttgcacattgtagcacctactgcactttaaactggtttactttgacgatatcgctttgcgtataatcaactagctttccaaggtcagctggctggttctcttccttgtgttccccttgtgcatgcatctttacactagtcatgctcttttagcgtgttggttagatgatgtgccagtagacagatgcttctagaccccttctttttctcccaaccaaattaaaagcaaccttcgtgctttagccatgtgtccctcgtttctttgaggtagaagcgctttgccctgatctttagagtcaatagcttaaaccggccatattagcatagtggcaccggacaaagttagttgtggcgaggggtcgatcggtcccatgtgcgtgtgacaacaatgctttaccggctcatatgtcaaatatgcttctcacgctaagtgtccgttaggtttgcacacgatcaacggatcaagccatcaaggtacatgggatgatgggagggaaacctggtacccgtacgccctcttgcagcatgagaaatggacctgcaggatcagctatagcacatgcatgttttgctcccagttggttgcagcttcaacacatgggaaacgggcggctccacatccatcttgcgctgaccgcgtcctgcatgtatggcgccagcatcggccacgaggcttcgatttcttcttcctggcccgccatgacccgcactccttccgattgcacgctagcttatttactctttatcgaacttaacaaaggttgatcaaatttatagaaaaaaaattaacatctaaaatatgaaattagttttattaaacttaaaattgaatgtagtttgataacatgtttgttttgtgttggaaacactactatattttactataatttgatcgaatttaaataagtttgactataaaaaagtcaaacgatttataatatatatctcaaaataaataagcctagtttaaaatgttaataatcctaatactagtcctgattcgtaggaaaaatattttcaaccactagataccatgacatctaggtatatgcatgcggtctaaatagttatataaaatttttataaaatttgacaagaaatattatgatattataagactccacgcaatcatgcaaatctaaatttgatatatgcataaaaaaacaaattttatctgatttgtacatatactattctctacttgattttattattttttttctctagttatgaattaaatttagtcttgcgtgtctgtctataggcttatgtcatcccaattgatgttttcaatcttaatgtaaatggagggtgccttccctttgatacaaaaataattttctttatgtttacattttttaaaaatatatataattatttaagtcaaatgcaaataatgggtgatatgtggtacctaagtgtaaaaattccttgtttcaaattcgtagtaatatctttaattttggaacgggagaaatcacggggcccgtgaaaattacaccgtcggtactcggtacacgtccgtgttggctggaactgcactccagccgagtagtagcttctccgactccgagcgccacaccagtagagttcctacgtactcctcgggacacacaccaactgcgcctcgcgcgcgcgcgtccgcgtgatccactcgttttcctgcagcccaccggccgggctgcgcgcgtgtttggcgtggtctcgctcacgcgcgcgctcgggcgtcgcagggtgaagcatccgtcggtcgatcactcgatcccctcgcgcgtgagcgcgcaacacaacgactctctcgcgtgccgctgccgcgcgctccctccgtcgtctcgtcgccaaggacggcgcgagaccccgcgcgcgcggctgcgcgcaacagagaaaggcagaggttggtggaaactggtacagcacgtaggaggcgctggtgctcgctgcattggcggccgtactatgtcgtcgatcttgtattttcacgcacgcgtttttttaattgctaaacggtgtttttttaaaaaaatttatatacgaaatttacttagaaaattatattgatctattttttaaaaaaatagctaatacctaattaattatacgctaatgaactactccgtagccttgatgccacggacaaattgccaatcgacgggtgaggtgacaataggtgagggatcccgccgacggagtgatccggccagagtgccgaccggctaacagatgggttgatgagtttcttcctccatgtgcagcgagaaaagccgagattcgtcgaaatgagcaggtggcactggcagttcgctccagccatggagggcctcctgcttctgaggaagctgtcactttctcgcttacaacttacaacgacgaaattaagcatcgtgtatagctagcctcgattcttatcctcccatttacgtgataaatcattcagagctgaacttattattattattaatcatctaaagtgccaactactctctccgtcccataatattaaaaccttgaactggatgggacatttcatcgtacaacgaatctagacagataaatgtccagattcattgtactataaaacatcacatccaattcgaggttgtaatattatgggacggagggagtagctactagtactagctaagattaatggcctactgtttggggacctcgtgatttgatttcgacttctagcaatgataagaaactcatattagctctcgtgtttggtttcatcaagcagttggtccgagctccatggaaagaaatataattaaggtggcgtgccatgcatgtcactagcaaggtagtaatcgttctttcagtgtctgtgttgatggcatgatcgtccagctggccagaaaagcgccaacacgtactgcgtgaagctttgtccttagtcctcggaacaagacgaaatggccacgggaacacgatattccctcgggaaaatgacggcgaataattgacagattaactacgcgcgctcatccgtttcaacgatataatgatcatctctatatttgccgcatcctctgaataatgcactgtagatcacgtctctgttaaaagtctaaattatgtgataatatcaactggtgatattctgaatattacgtgttctgaattaattaacgagattaacgtcgtcctccgaaaatgagagagagagagagagagagagagagagagagagagagacttttttgtgcataattccctcgtgtcttatctccgtgtacagatagagagcagatgcagcgacgcgatcgtttgtggtggcgaatttgttttaattttctgttctttcggatagcgagagcctaatggtctgtgcgttggatgaaatgatggccccggttaggccaggccaggccacggtatctggccccatcacgcacgtctttctcggtccttctcaaatcgtttttgcatgcgtagctagttgtcgccaatctacgagcacgaggctagcagtgggttcataggcggtccaatgataaacgggcacgaaactatataggtctgtttggacaacttctgacagcggtagggccggtagccggtagcttcttttaaaatttttcagttgcgaagctttctcaaccgtctagatttttatttaaattttgagaatatatagttatataatttagaaaatgaacttaaccttttcatatccttaccggtagctttttaaaattttatgatcttccaaacatatccacagtgacttgaacagtttttacgcgttcacgaaaaataaaaaaaaaaactgtactagtacgtcaattagacaatcattaatttgccatcttgttactgtactccagtcgtgatcgtgatgctgtttgctccagtcgatatcaacctttccagtgaatatgttcttcctacgatttgagaattctttttggatcgacgggtttcaagatatacatgccagttagtactacgtattatataactttttgaaatatcagataaactaaagtttgtttttttcggaaggggatctcttctctgtgaaacggtgctaatgcatggtttgtgagaacggagaagagatggtcctccttgtgataattttcctcccaatttttgtgttgcatgcaatgataagctgtggaaatgcaactggtgacgtgtcaatggaatgagtcagagtggtgaattaagttccttttgattttgatttttcgagttgctccttgttagataaatgtgcaagtggctctcatatgcaaaaggggtatagttaaggagaggattaaaaaaacgtgttacctataaatgcacctttaccaggtcaagaaaataaaacgaccgtcctctgattgtgtgttgcatcatcaatgaactcaccatggaagacgaaaggtattaagtatttttaaaattaatcatgggacaattggaggaagatatacctagttaaattccaacgtccaatgacatgtctcatctgtgcaggacatgtctcatctgtgcagtttgtgctcctccaattgtagtaccatctagtggagccattgggtgttattgtatcacacaaatgaccttggatgagcacagatgacattacattattattcggtatgaaacttttttataaactcgagggcttcccgtgagatttgcagatgtttcacgtgaaattgttcagtttttgcataatacaatactgttacgagttctagcctggctataaaaagacgtgcatgcgtgtgtgggtgtgtggtggagtgagtaaaaagtgaagtgtatgtatcgtgtgcgtccgtttatactttaattaaatataaaaagaaaaaaaataatttaagacaaaacagtactagagtactccctccgttgaatgacttacattgtgaaacggagggtgtacaatcttaaaaattacttagtagaccctattgtacacgatgattatgtacgatttacggttgtgtatttcatagtagggtgtaaatgtacgctgaaaatatcgtcagatgtgcggtcaccaacgtttcgggcgacgtggcgtcgatccggaccgtccaatccagatcaacggtgaagatatgtcgggtttggtggggtggcccccacgtagccggtaagctgaccctggtggtgcacgtaaccccctggaaaaggaa

SEQ ID NO: 57996 - DNA, 1253 bp, Oryza sativa
tgcccctgctattgcaataatgcctcctaggggtcgatagtgcaattacgagctgaggtaaactactatatttacttagatgttagtgatactatgtttttttccttcaatactatttataggacagtcatttgcaatacttttttttttgtaattttgatgaaaactggatatctgagttgactaattacatgttcgtagttttgatgaaataatggatatttgaactgattaatgatggatttattcatctttctgaagccataaacattagccatacttatttgagatgcgtaaattattctcctgtcacttccttagctttttgggctacccaataagtctaacttaaaaagctcgccatgtctttcagctctctgcaaaggagtacctgaagttccaagcttcatatgccacagttcttaaagcccatatgcacgctttgaagaagagggagaggaaagacaagaagaaggctgcagaggttgagaagataccagagaaggcaccgaagaagcagaagaaagcaccgtcttcaaagaaatctgcagggtccaagtcgtaagttactgaaagaatttgctaagcccttttttggccacaggcctgagtaagatgggtgtagtcaagacattatcctccattttactcttattcatgtctgcgagatgaagcatgtgaatacctttatagagctgtgccgtcgacattagcaatttttgaagcagctttggttgtctagatgtaagccgccctggaattttctatttctatcatagaaaggcatctcttaaactgtgcctgatctgatcgtcaagttagtgcaactttcaattgacagaattacgtctggaacatgaagttatgcaactaagactgcagaaggaaattgcagaactgttatctggatgtctgtgttccttcaattttgtttttctggttggggagaaaaagtgtgaaggtatgtctgtgtcacgattcccacatgcaagtggtgatcagaatataagcagattccatgtttaggttggtgcataagcaaacggcgtactactatgggcctatttggtagagcttcaactctggattttagctctaggagttgggtctggagtggagttgtagagctgcctgaacctagctctatctctgagattttcacccttctattttaagtggagctgaggtgccaaacaggccctatctctcagcaattgctgcatcaacatggagcattggagggccgtatgccc

SEQ ID NO: 57997 - DNA, 1348 bp, Oryza sativa
ttcaccaacgaccgcggcggcgccatcgacgactccgtcgttaccaaggtcaccgaccagcacatctacctcgtcgtcaacgccgggtgcagggacaaggatctcgcccacattggggagcacatggaggccttcaacaagaagggcggcgacgtcaagtggcacgtccacgatgagcgctcgcttcttgcattgcaggtgagcggtttctgtttcttgccctctttcatctggggaatctgttggtgattttagtttgcttaattgattgcctcaattgattatacatttcggaaagggatttagcaattgattatttctgggatttgggaatgtcatgctttgagatgagtagtcaatacatggataaaaggtccattcctgtcagatataaggtgggatgtgtagtcactagttagtggatgatggtaagcgaagaaagattcgcttcatatgaagtagtaattttcttgcctacttgaagaaaaactacatatcgtttttattagctggaggattagagaatataagctgttaggcttgtttctttctgcagttttatttgttatattgtcaacgcagggtagaagataaggcttttttcccaggatgcacaatgccttgatgtgcatatgagcaataggtagtaaggcagatgtttgaattttgatggcgtgttggtggaaacatgcggtgacttattatttgttgtttaatgtttagtggcattttcatgatcagtaaatttgatttctggttgtcaaacaatagttctttgctaaatcattattttatttgttatagtgcttttttggaactgactatatattgatttgttgaggtagtggttgagcaagtttgtgtgtccttttcttggttggtggaagtaaagcttcttctagtcctgtgggtttatttttagtgtaatacagaagtgtctaggccatattgtcacaaaacaaactttaagtttcctatgcaatcacgatacaatacacataacctggtttcccttctatagcaactaatttcatcaagaaagaggcagatggatgtctgtgcaaatgtatattcatggatagaaacattgcgcgacatattttgtactttcaaattttcatgcaagattgctgcagaacttgtccctcaattcctactccctcagcctttgtggggttttatcatagtgatcagctttcactattacagcacgtagaaatttaatttttcctgacggcattacttgtttttcacacgaacagggacctcttgctgcaccaactctccagttgctgacaaaagaagatttaagcaaaatgtatttcagtgacttaagatgattgacatc

SEQ ID NO: 57998 - DNA, 4722 bp, Oryza sativa
gccatctaataatatgaaatgtgatatgcagtatggatcctttcccacggtaacccatattttgtcttcagaactggttgtctgcgttggcagttgcaaggccaataggccatgttccccgtctgcaacatagatgtcgcagaaagcaaaattcagcatctatttgcctcctgtgttgtctataaactcagatgttcttcaagaaaagaacacttgatagccaaacattaaggaaatcgagacctgtagttccttgatgcaaaagagaataagaaatgtagagagaaaacaaccatgaacttgcagaaaaacagtggacacggttccaattcatagatctgggtgattctgcgtcagcatgataattccacttcagcgagaggctgaagaagctctagggaagaagctgctgaactgttgcgaccgggcctactggtgatggcaccacaggtcagtgaagcaagccatcggtttaaaggggctgtttagttcatgaaaagaaaatttttgggtgtcacatcagatctttgaccagatgtcggaagggctttttggacacgaatgaaaaaaataatttcataacccgtctagaaactgcgagacgaatcttttgagcctaattaatccatcattagcacatgtgggttactgtagcacttatagctaatcatgaactaattaggcttaaaagatttgtctcgcgatttcccccctaactatgtaattagtttttttatttatctatatttaatgcttcatgcatgtgttcaaagatgtgatgtgatgtttttaggaaaaaaatttggggtactaaacagggcctaaggtttaccttcctcttcgtctactgtccgattaaacttaggcggctgagattgagggagaaccagaggtaaaggtgtctttgcattgggaccctcatacaataccgtattgctttacactactaggtccccaaaaagttggatgtccaaatgtcgttctcgccatataccgtccgatctcacataggcggtggatattatgttgggggactcggagtaacgtggcggtgacttttcatagcaactctcgtactgcactgtatgcgtagagcataaaagttggatagctaccaacggtagcgatccagattgccttcaacatgaacaccccacctcacgcagtcacgctcacgagctcacagcaatttgggttgttaagttgtttgggggattgggatcctctgtcgtagcatgtaatacaacagatagttatagtatattgtatatagtatatagtagtccctcctttcctaaatgtttaacgtcgttgattttttaaacatgtttgaccgttcgtcttattcaaaaaatttaagcaattattaattcttttcctaccatttgattcattgctaaatatacttttatgtatacatatagctttacatatttcacaaaagtttttgaataaaacgaacggtcaaacatatttaaaaaagtcaacggcgtcaaacatttagggaatgagggagtattagaggtattgtgtatttttgaatgtgattatagatggccatatggcatgaggcccatggcccggtccaaggcacgccaatttggcccggcccaagtacggcacggcccgacagccagaccatgcttgggccgctcccttggcacggtgggctggcccggcacgtcactgatcgaaaaaaatagtagaggaacgtaaaatagacttaattaaccatataaggcgaggcccaaagacatgaggaatacaaatagacttatttccaactatatgtgcataacccacagagtttagggagcaaaaatatacttattctgtggagtaaagtgctactattcttttcttttcagaaaaaaaactgtgtttattaatcaaggacaattacatgagttacattttctagtgggtaaagttgagagaatagctagttttacataaaagcccctaagtgatgggtaaatacacttcaagaataacatatacgaaaaaaagacctacaaagataaaataaaaagcaatcaaatccttgcaacaaccacataggcgatggcaagatcctcgcagacgacgacggcaggagcaaaagaaacatgtttagttgcaatgggtagagccaaggagcatacccgaacgaggcctcttgatagaggttgaagccaccttggcccataggagaaatcatcagccacattttgcaaaacaaccgtcagagacgaattagacaaccactataagtatgtgagacttgctgaatatggagtaaacaaccgatgcaaccttttgttagacatgctagaggacaagctttcaacccaaagcaaaactcccaattgaaagcattggaggtgaacccaacattcactaggcagaaagatgacgctagcaagaacgtcaatgaggttcgccatgtccatcaagctgagacataaaaatcgaacgtcggtgaccctcttgaggtacacaaagaatgggatgaacccgagaacgaaaaagatctgactaaacctaaacctatctctagtagtgggaggaaggaaccagaaccctctctcctccacccacacacacaccacacgatgaccagaaggccaccggagaaggaaggaaatgggcaagtagtcgagttttttctgcttaagacacctagagcttttaaggcgaagggatcaaagtgctactactttactgcatttattcactgttctcctcgcatcaacaatccccctctaggttactatagaggaaccggatcattgtttaggcgagacgattcttcccctcccgggaagaaccgaagaagcgcgctctttcaacgccgcactgtcactatcagagctagggatggcaatcgggcgctgcgggcacgggtatgggtaggtgtgcccatgagattatttgtgcctgtgggtatacccattattacatgacgggtaaggatggttgcccatgcccatcgcccgcgggcgccttgtgcccgcggtcatgcccgtttacccaccacaacaaaagcagtggaacaaaaagtctacaagcttctaagttcgaatcgaacttaaaacatcaaatattctccgcctcggtgtggtatctctcctctggcggcgatagagtaagggggagagaaataataagggaaataaaagggaaaccgtagaaaacaaagaacgtggcttatgtattctagtggattttgctcttagcctacatataagttagattttgcgggtaaacgggcaaagcgggcatgggtagtgattaccaatacccatgcccatttactcatcgggcatagcttttgacccaataagatacccatgggtataaaatagagaataaacctaaccctaatagagtttttacccacgagtaaacggacaaacgggcacaattgccatccctaatcagggcgggcaccccacgactcaggcccggggcatattcagatattctcgtgccaccggtacggtgtgccaccaagtctgccagctacacggaattgggcaaatagcgcgctgcagcccaggccaggcgcacagaccacgacgactcgaaggcaacagcggcggccgcgcctgacctcctgcgctagcctcaccaggccgcgcacgcgtgtggcgtcctcgtcaattccgcgagctcattggcacgcgtgtacgatctgtcgcgccaagctaggctgcaccacgccccgttgccgcggaagcctcacaactcacagcgcaggtaggtcgatcggttgggctccgtctctgcacaattagtcgtgcgcccacatgcacgcgacactactacctgcgatcgagccagtggtgtggccgctgccgcttgtgggcgatgcgtgcaactgcacccgcgggccgcggcgccgatgacccaagtctcgcttcgcgggcgcatgcacgatgatgcgactggttgcattgcgaggtgcgggtgtcagtggtgtgtgggcgatgcgtgcaagtgcaacctgccgcagacagccacagaggagggggggtctacaagctgcgcggccggcgcaggggagaggcagaggcaggatcgcggtccatcactccactcgtgagcacgagtacatgccatgcttgcttaattaccctgcctgacatcgttcactcgccgggggtccaaacgtacgcacgccgcctcccccggcccctgccaacttatgcttcgtgtcgggcaccaaactctacgattccggagtaaattttctgactaaagttactcggatatatatcaaccttaattttgcatcctctgttctgtttgttccaactgagtcatggtcaatgcaactcgagcacatatctcgtctgatgccatgttgcttccaacatgggaatattttcgattcctatcaaaattggaactatcttgttacagcatccctccttaaatataagagattttgattgaatgtgacacattctaatacaacgaatctagacataaagcctgtctaaattcgttgtacttggataaatcatattcaaccaaaatcatgtgtatttaggaacagaggaagtaatttcaagccgaattcaagaaaaccttaaccgcgaaacactagtaccgcttccaccacctctctcctggatttttcacattttggtccttttaaaaaacttatttcgcaaatagacccctgaaaaaacttatcccagaaatggtcctttttggggcgccagagtggctggc

SEQ ID NO: 57999 - DNA, 986 bp, Oryza sativa
gggcgccagccatgctggcgccgccccagggaggagggcgccagcatggctggcgccgccgcctctattcctgtttctctgtatggagttgcaacggtgtcatttttattttattttttgatgttttttcacactcaggatcacgatacaaccaaccacaaaaaaatttaaactcgaactaccacttaactaagtctgaaaatatctagcataccacttagtctactttgcaccttcactaaaattagaccataactcctttagtaaaactctttgatcaacatgttaaacataatgcactataccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggataaaatatgtgacatgcagaattttctaaaactctaccgaaacggacaaaatatgtcatctattaaaataggcgtaactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttggaaaattccacgtgccacatattttgtccgtttgagtttattttttacatggttggttcctgtgagttcctaagtgtgaaaaaaatatcaaaaaaataaaataaaaataaaaaagttgcacatctctctcctctgcactagttcggagagaggagaggagaggaaaaattctacatgtcatatattacgtccatttgagttcaatttttctatggttggtttttgtgtgtccctaagcgtgaaaaaaatatcaaacaaataaaaca

SEQ ID NO: 58000 - DNA, 1263 bp, Oryza sativa
caaagtctattctcctcaaatcccctaattgctcgttgtctctcatctctacgacgttagagggcgtcctagctagcctgccgagtttaggacaaaccaatgcacgttcaccttaacgaggtccttcccggctgttcgttcggcggcatctacctactccctacggcggcgtgtctgcgcgtgtgtgtctccgtgttgcacatagcgtgcttaaggtgtggcggcacaattatacgtcaacactagcaaatgtatttttcctgaactgaagagtactactccgttccaacttagtttaaacttttttcccaaataacaaactcctaccttcttccgtaaattgagaaatttcattcctccatatctctcatatacgcatccaccaatataatttttctattaattaggggtatttttatcttttgtctttctgcttaagttctttttgggatgttactagttttaaaaaaatggacagagggagttggcagtagcaaacgataaccagcagtcaggttttacagtggaggtcacccttaatttagtccacatcatcaactcattaattaagaggcaatatatacaacaaattacctctagtacacttgccccaatacacaatattaattttactttatttgtttcctatcaattcattggtctcttgttctcatctctcttggagtttgtgtagaagttgctctttgcataagaggtggctcgttctctctcttctttcatatctctcatccacattatcgtgtgagcttaagcatggcacctaggggcaagtgcgtagaggtttatagtacttgcccttagagtgctagcagcaacagcgtcatgcatgtattatcatgcaatgtgccattctatttcttagagcaaatataataggaggctttaaaccgactaaatactgaggtggaggagagagaggagaagcgggctgtaaacttacagccggcttggacacaagaaccaagaaactatgtgagagagacaagtggtccctgtattaattataacgagttaactattatatgagtgggttgagagaatgttgcaaataaccttatagccaacaagtcagctatattattagccttgctctcaagggaagttgtaataggagaggttggagctagtagtcaaaagagatcattaacttaagcacatactccctccgtaaaaaaaaagtaaatctagaaatgatgttatatattatagtacaatgaatctggacagatgtatgtccatggg

SEQ ID NO: 58001 - DNA, 737 bp, Oryza sativa
atcctcctgtgaaaatttctcctaacctttgtgattgtttgcctggtttctcttttattcttgcatgtgttgtttcagtttcttgtagcgtgattcttggagataatttacaaggatgagggttttctgttatttcttcccgaatctttgggatcagtcagatctgttctttttcactgtacagttcatcagtaatactgttggagcttcgattggaatcaaagtttagattctgcaaaccattcttcttgattgcatggcttcatttaatcatgcttcttctttttcttcagtttttttaaactgtactgtactagaggcagttagagtataactgttaatggatgaacttggtggctgaacttctaatggtgatgacttgagcagagaaatggagctaatcacaaacgtctccgagtatgagcagcttgcaaagcagaagctgccgaagatgatctacgactactacgcctctggtgcagaagatcaatggactctcaaggagaacagggaggccttctcaagaattctgtaagctaccttccaaaatagtaggctttatctctagaaaatatattagacttttagctagctgtttctatctggtagcacactgctggatgaactgtgtttgttttatttacatcagcagataataattgagcttaaagtagtgcaattgaaaagttcttggaaatatttttttcaaaaggatcccagttccatattttttttga

SEQ ID NO: 58002 - DNA, 1168 bp, Oryza sativa
tatgttgctagccaagttgaccgctctctgtctggacggtatatgcttcgataccatccttagttttgtgcaccaaacaatgaatcagaaactgggatactgtcctggttcttctggcacttctctgtggcaatgagatgctgatgctactgatgcacaatgcaggacgtgaagtggctacagacaatcacctcgttgccgatcttagtgaaaggagtcatgactgcagaagatagtaagtgcagtttcagagttctggttgctcattgttcattgttatggcatgccatggtctgatggctgatgatcacatgaatttggtgcaaaatgcagctaggcttgctgtcgaaagtggcgcggccggtatcatcgtgtccaaccatggagctcgccagctagattatgttcctgcaactatcagctgcctggaagaggtatatgctattaattgctaacccagctactgtcataaaatgcacttgtaaacatcttcagaggaatcttcagtgcaactgacatattcagaaattctagcaagaaacttccctgaacttccatgatctatactgaaagtgtcgagcaaactcaggtcgtcagggaggcaaaggggcggctgccggtgttcctcgacggcggcgtccgccgtggcacggacgtgttcaaggccctggcgctgggagcttcaggagtatttgtttgtccccagagcctgcattttcaatcaagttagtacagtaccatctgaatttacagcccgcttaacgccatgagcatttgggtgttcgtcagattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgta

SEQ ID NO: 58003 - DNA, 2795 bp, Oryza sativa
tttattttaaaatttaaagataaacccttccaaaacttatttccaaaatataaaccttctcatcacatcagccagagtaacgtggccaaataacgctgccatgtcagcgagattggcgtgacaatattgttttgccacatcagttcagctagcatggtcaaaatgttcggattttgaaaataagtttgtgtagggtctatttttaaaattgaaaattaaaggttaaaaagattaaaaaaaattctctgttcatagctcaggaaatcgtttgctctctgataaatgggccccaggcccactgtcagtttcacatacactcctccccagtcacctacgaattccgccagcggcagtggcggcggcggcgctcctcgccgccggccgctcgccgcctcaccgatgccgttcccgcgcctccccgcggtgtaggtccagttcctagcagccagcgcttgctgcctgctggcctttcaactgcctccaaggctccaaccctagcgcggcgccatcatcatcccaatcgtccgctacagcctacaaatcgcggtgatggtcgcgtcagcgtcgcaagctaccgaactagcgccgcttcgtcgtcctgccgctgcggcttgcagggagagacagcgagagctgtgctgatgaagtgatgaaacttgtgggcttgcggcttccaggaccaaactgcaggtaccagcaccaatttttattccaagaacacgcgtgatactctcctctagtaaaatacttcagatatcagtcaatctttggtgtcttgctgatggggaaaatctgattcttgaatacaaaattagtacacaagtaaagatccttcctacctccaagatattctcccctgtcactgtcggtagatcaccactctcttcctcatccacacagatgaacacaaagaggaaagagcataaaaaagccccccaattcctccttccagttcaagagtacaagaaagacacaagcacagacaaaattcctgagccctgccccccgttgcttagtaaacagtgagtcctcttgctgatctatcgtgcagaaattccaaaactacacctttggttttagtatacttctttttcatgcatgtcttttaatttgatggatttgtgtggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtgtcctttgtggataaatgatgttaggtttcagccggttgtattggttgatgtgtcctgtatcgacatgtctatgagtgtcttaggctacaatatttccatgcccattatgattgctcctacggctttgcacaaattggcacatcctgaaggttctggtttgctacctttatatctttcttttggcaatcgcatatttcaatgagaagttcctttagggatatttatctggaatgcaggagagcttgctactgccagagctgcagctgctgcagaaactataatggtttgaaagatcgtaacaaattttatgcattttgatatctacgtctgacacattgattcaccaactagtcatattttcagacattgtcttcatggtcatcttgtagtattgaagaggttaatttggcagggcctggagttcgtttcttccaactttcagtattacactattttctttcttagattcttcacctttcttctttaggatttatgctcccttacttcttatcaatgtcttgttcagatatacaaggacaggaacttagtgcaacagcttatccaaagggctgaaaaggctggctataaggcaattgtactgactgttgatgctccatggcttggtcgcagggaagctgatgtcaagaacaggtcctcatcgtgcaaccgtagtgtttgacttgtgcattatgcattatttaatgaaaatctgtaccctgcatcaatatccttttcttaaaggcacctttattgaaagaagaaactccaccgcaaactcattatctgcattatactttacattacattctaggttcaccttgcctcaaaatgtcatgttgaagatctttgaggggctggatcaagggaagatagatgaggttgtctaaaaactagtgccattgtgtgaagtagtcatgattctgtttaacaatgccctgaatcattctatttatctgatgtttcagacgaatggttctggtcttgctgcctatgtcgctagccagattgaccgctctttttcttggaaggtattgcagtgacactatgacttgtaatttccagataacaaccagtt

SEQ ID NO: 58004 - DNA, 1631 bp, Oryza sativa
ttccaaaataatcaacctataattacgtaatcatgtgtacgtaagatcaaattgtttaatacgaacaaaataattatgatgtgtatcagatgatttcgggagcaaggaagacggagctgttcatggggcagccgtaccgtaccatgccggcgaccagccggaaccgaggctgggcaccgttgagcactcgagcatgtgccgcacggccccgtccaccaatggaccggcgatcagaggcagccgaacgacgaggacatgggcgcgcaccttactcggcggcacgcgacccggttttcttcgcgcaccacggcaacatcgaacgcctgtggtattaatagagcaggagaaaattatattgagatatatacatggttagatttttttagataatggaatataatatcccggcctttgctcaaaagagctacagggttagatgaaaaaaacgaaacaaataacctgcaaaaggagaggcaaaaggcagagattaagtgatatctcccaaaatttcaaactcctgcaggatagaagcccctgctttgacccatgctctctcttcctccttgatctttgctaggattgaggatagcgaatatgcattgttgcggaagattcttgcgttcctttcgcaccagatttcccacgagattaaaatcaccagggtcctgagaggtttgcgtggagtgtttggagatttcgttacaagtgtccaccattactcgactgagtgatagctatgccagttgttcatctgaaggtcagtcccggtccatctctgcatttctgcccatatcctctctgtgagtcacatttggccaggaggtacagggccgattcatcaacattgtagcaaagtaggcaaatcttttggttttgccatcctcttttttctagcctgtctgccgtccatactctattttacgtgactagctaagagaagaacttgcacttcagcggcgcccatgtctttcagattgactgatagaagatagatttggcagcccttgccttcctttaaaaaaatcgagcgcctgtggtacatccgccgtggccttctcttccccggcaacaccaacttcaccgtgctcgacgcgagcttccacttttacaacgaggatgcccgcctcatctgcgtccgcgactccctcgacgcggcgcgctgcgcttcacgtactaggatgtgggtctcccgtggctgatcaacgccagctgtccacaccggcgcccacgacaggcgcctgccggggaatctggacaagaccgtgcgggtggcagtgatgaggcccaagacgtcgaggagccgcaaggagaaggacgccgaggaggaggtgcttgtcatcgaggggatcgaggtcagccgaccactccacgtacattaagttcgacgtgttcgtgttgaacgcgccagcgagagcgggaacatcgcggcggcgagtacgtgcaccgggagcgtcgtgctaacgcagacagtgtccaccacgacgagaggatgcgttctccgaggaagacggtggcgaggtcactactataaaactaattttcgcagtggccaaaactaatttttatagatgggagagaggtccgcctacaccacaacgactgcgaaaatcatcgatttttgcagttggggc

SEQ ID NO: 58005 - DNA, 8330 bp, Oryza sativa
ccggccagatctaggagggaggggggtagccgccgccgccgcccggcccgcgccatcgctgccctcgccagcctcccccctccctcctccggccagatctgggagggagggggagggcagccgccgtcgccgcccagcccgcgctgtcgtcaccgccgccctcgccggcctctcccctccctcctccggccagatctgggagggagggggcaggggagctgctgtcgtggctgggagccgcgcctcctcgccgatgtcgccctccgccgccaccggccgccgcgctcccccctccccccctgcgcccctctagatctgggagggacgggccgggccatgccgccctcctccgtcgccctccttggccgcgccgcctcgcctcctcgccgctgccgcccttcgccgccaccgcctgccgccgtcggggagtgtagaagtgaggggaggggaaaggaggagatgtgtgaggacttagaaaaaaattacggcccgcaagtctatttatatctctatctctactacttaaaaaataagagatgcttccatcgtccgaaaaaacccagcgaaaaaaccggacgagagagaaaaaaaccggacggaaaaaccgtaactgtccggcgaaaaaataatccgattctgtgaaaaaaaaagggcgaaaaaccggtgaaaaaaaccgtaactgtccgataaaaaaaggcaaaaaaaaagtccgattccgtgaaaaaaagggcgacaaaaaaccgccccaagaaaaccggacgagcgagaaaaaaaacggaactgcccgatcccaaaaaaaaatccgattccgtgcaaaaaaaaagtgaaaaaaaatctctatctctatctctacttgtctatctctatctctacacttaaaaaataataaaagatgttttcttcgtccgtaaaaaaaagctaaaaaaaataaaataaaaagtccgacttctatccgattccctctcataaacggaaaaaaaactccgactatagatccgattctcaatctataccgtgatatctcacagatcttggtgaaacaaaatgatgtgtcggattgaagatctgtttaataaacggaacctacaggtcgatagcattccatttttatatgatttcaatttttgggtttgtacttttgcttttgagtccctgtaatttttatatttacatttgagtccctataatcctgcaataaggtacttgaggccgtgtttgttaaaaataataataaaagagagagaacaaaaacagaaacgtgcatctctactacttaaaaaataagaggtgcttccatcgtccgtaaaaaaagtggacgaaaaaaagaaaaaaaccaaacatatccgattaaaaaaaccagaaaaagaaaaaccaaacgtaaaatagggggcaataaaaaaaaccagatcggtccgataaaaaaaccagaaaaagaaaaagaaaaagaaaaaccaaacgtaaaaaaaagggcgataaaaaagaaaaagaccagatcggtccaataaaaaaaaccggaaaaagaaaaagaaaaccaaatgtaaaaaaagggcgataaaaagaaaaaaaaaagatcggtccgataaaaaaatcccgggcgaaaaaaccgggaggaaaaaaatgggcgaaaaaaataatccaattccgtgaaaaacaaggcgaaaaaaataaaaaaaaaagaatcggtccgattctaaaaaaacgaaatcgggcgaaaaaaaacccgtgaaaaaaaatcaggcgaaaaaaagaatccgattttgtgtaaaaaagggcgaaaaaataaaaaaagaatcggtcgaattaaaaaaaaaagaaatcgggcgaaaaaaatcgggtgaaaaaaccgggcaaaaaaaatccgactatgtggacgcggtaaaaaaaggcgaaaaaaataaaaatgaatatgtctaatttgatcaaagaacgtgggtctgattttttaaattaaaacccgttggataaactcctgagtagactcgaaaaataaattctaaatcatatactaattcatcaaattagtctcggttctacctatttgttaatatatcaaattaaacttgatttttaccgatttgaggtttttaaggtgtcacattatcaaacggtgtttctcccgttgcaacgcacgggcactattgctagtaaaaagaaaaaggaaagctgcacaaaaaaaaaagaaaaataacaacaacaaaagttccgttttcccttagtggcgaaaaaaaaattgtagatccgaaccaaaaaaatccgagtcctataaaaggcaaaaaaaaagtggtgaaaaaaaaatactagattcaattcctttaaaaaccggaaaaaaagtctgattcctataaaagcaaaaaaaaaactgaaaatacatctaaaaaagtttgtccgattccctaagaaagtggcgaaaaaaatagttcgaaaaaaataaaaagcttgttcgtataaaataaaaaatgcacactagaaaaaaattgaaagggcgaaacaaagtctgatttctaatcgatatatatctcttctctatctctaatataatctgactatttaaaaagataaaatacacgagaaaataaaaacggttcaaataaacgcgtgagaaaaaagtcagaaaaagtgcaaaaaaacaaacactccaaaaaggttttccatcttccataaaaaaaataaaaaaacgggcgagaaaaattatttccatcgtcggtaatttttttaaagaaaacatgcgaggaaaaaacagtcagaaaaaacgcgccaatttaacaaatggttttaaaaaaccgtgcaagaaaaaaacaccgtctattaaaaaaatcgctctgagtcggatatgatccatcgatgtttttgccacctactacacggcttttatttcgtcatatattctccttactgaaaaaaaaagaaaaaagaacatttgaaaaaaaaacaagcaaaaaaacgcgcgagaaaataattggcaaaaaaaaggcaaaaaaacacacgagaaaagaaaagcaaaaaatggagaaaaatatggttttcgttgtaaataaaaaagcaaaaaatacatgctagaaaaaaacttttaagaaagaaatacgccattcaacttttaagaaagaaatgcgccatttctgaatggtttgagaaaattgggcaagaaaaaaacaccgtttataaaaatacaagccgctcattaaaatacaaacattgtcattgacatgattattcatgaaaaatatatattatcattagaattttttcacccgttgcaacgcacgggcatttttgctagttcaagtctattttcgcaggtgccgtcgcaggcggacattaaatttcatcccgatttctatttttataggcggtaatttggttctaagggtcatgtccgcttgcgaaaataatacaccgtgtctgaaaaaatgatttttctattagtggttcggcatcggcaacttgctcgatgacatcggcgccgacggcgaccggacgatcgtcgtctcgatcgtgacgaggtccggctgcgattcggtcaccatagtgtttgatgtgtaactaatgaataatacggtataaataatgacataattactgactagtcgttctttgattaaatggcgtcattagtcgttctttgattgaatagcgtcaatagactcccatgacgtaacgttgttccttagtacccgtactacttgttgtaattaataaggaaataaatattgactcgtcgttctttgaatttaaatggtgtcaatggtcaataaaaaccttaggggatgattaaaatggaatggaaggagtaattagtaatgtcaagacctaaaaaccttaggggatgattaaaatggaatggagggagtaattagtaataccattgcaaatatagaagcatagtaagaaagaaaaaagtgggcgctacactacagtatacacactagagtggattctaaattcttaggatcaggcattctttcgttatttgcatatcatccaaattattatgaaaaaaattaaaaaaatttaactaaatagattaatatgtgatagatcattccataagcatgcaagttaaaattcaaccattacatgttaaaaaaaattaagctataaatagttaacgtatattcatagttaaattttgttttttttccattacaatctgtagaagttaattttggtattgcatgtttatggagtgattgatcatatattaatttattttattgattttttttaaaaaaaatttataaccatttagatgagatgtaaataacgagtgatctattctcaatagtttagattaatagtttctcgtatacacacgcattgccctataaaatacacacaccactgcaagaactagtttacagctgaatgccgccatggagagcatcaatgtagcacgaggtgcatccgtgacgcctcgcatggcgctgccgtgcatcagcaacctccagacccttcactacaacctgctcttgcaccgcaaccgcaagacgaacgggaggaaactgcggagcgtgtcatgcagggcgagcgccggccgaggcggcggccgcggcctcgaccgccgcgacgtgctccttggcataggcgcagcggccgccatggtggccacgcagggcggcggcggcgcgctcgcggcgccaatccaggccccggacctcggccactgccacgagcccgtggacctccccgaccccgacacagcgccggagatcagctgctgcccgacgtacagcgccggcaccgtcgccgtcgacttcacgccgccgccggcgtcctcgccgctccgcgtgcggccggcggcgcacctggtggacattgcgtacttgaccaagtacgagagggccgtgtcgctcatgaagaagctccccgccgatgatccccgcagcttcaagcagcagtggcgcgtgcactgcgcctactgcgacggcgcgtacgaccaggtcggcttcccgggtctggagattcagatacacagctgctggttcttttttccatggcataggtacggtacgtgacaacaacattatactccgtcccaaaaaaacaaatttctagctacgaaactagacacatacacatgtgtccagattcgtaggttggattgatattttattagacggaggaggtatatacggagacgtccgtcgatgattcttacataccacttaccacttactagtaaatagctataaattttctaaaataattaataagaaaatatgagatatatcatttcacaaattaacacataagctcaaatttgaaatctacaaattgtaaaaaaaagagagagataaattattaaaactagtcaacttacatccgcacctttatttttttttctgttgtaaaatatagaagttgtgtttgaacttatataaaaaagtaatactccagctaatgttaatttatcttatttttaaaattttctgttgtaaaatgtagaagttgaggggtatattagccttttgagtatatctcacgttaatttatcttattttttaaattgtctgttaactatatattaaattaaatgacatgaaaaagaagggatacccctcaaaaggctaataaagacactttccccaaatatacatcccgtctcgtctggttcgtgtacgggcatccagctatatgtgctgatgtggctgtgattctctgcatgcactggacccatgcgtatgaacgtgcaggatgtacctgtacttccacgagagaatactgggcaagctcatcggcgacgagacgtttgcgctgccgttctggaactgggacgcgccggccggcatgtcgttcccggcgatctacgccaactgcaggctgtcgtcgctgtacgacccaaggcgaaatcaggcgcaccagccaccgttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaacttatcatgccaagacctgccgagtagcgaagacgaagactgtaaagggcgaaaagataaaaatatggtgcatcgaatagatgcacctaattaggtgtagcccccaactatgtgattagttaacgaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatataacataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaagtactgttcaggcctaggcccatttgctcctccgatacccttaacaagaaatcccgagatccaagcaacgcttcgtctcccccgccggaactctcgccattttccccactccttgctacagtgcagaactgcgccggcgaactagggttcaccactccactcaaatccaccttcgaaaaaatgcatcaaaatccttcccgtgatccaccgcctcaattcctcacctctcccaagccatccctcgaatcaaatcagcgcattcggggaaaatcgatggcggaggaaaaagaaagctttgaaggccagtgggcgccatccgacgtaacggaagagaacctgaaggagatggtggcgcacggcgttctccctgccaaggagatcatcgggtggcggccagcgtgcggtgagacttttccgacccccgatacacatgagattgtggtcttctctcatttcttctatggcggcttcgcccttccgacctcgaaatttttccgcgggatattaagcttctatggaatcagcttgcatcacctaaacccgaattccatagtccatatcgccaatttcatccatgtttgtgaagcctttttggaatttaggccccacttcgctctgttttgccggatcttctttctcaagccccaactgaacaagaataagccatgtgtagtcggaggggcaggatttcagttgaggggaactctgagtcagaagtacttctctatgcccttcaagacctcaaacaaagggtggcatgcgaactggttttatgttcagaatcctgagcctgctcttcccgagtattcttgtcttcctccggtgtaccaagatacttggaactctcttccaatcggagatgaagctgcccaagctttggaattgttggatcgcatgttaaaactcaaagaacaaggcttgcaaggagagcagatcactcggcatttcatcaaatgccgactggcgccaattaaagaaagatcccgtacagcttttgagtttgacggcaagcatgatcctaatcgcgaagaaccagactctctggatttcaaaatcatgaaggagagaatgtataaaatcttctcaaatgccatcgtcgtcagctactcacatcagctgccagttgtgccatataatgcattcaatccgcctccgcaggtatgcatctgaaatcttcaatctatgaccaaaacattatcttgtcttcatgttgaattaattaaccgtggaagcatctca

SEQ ID NO: 58006 - DNA, 34319 bp, Oryza sativa
  unsure (1)..(34319): unsure at all n locations
ccatctgcataccaccaatcaccatccttttcatatgatttgattaatttttcagcaatagagagcccatcactccaattattgtaaccgccatgcatccaaatctcagtgttatgcattagcggtcttgagcttctgttgtagaacaatttgaccctatcccctgctttgtatgtgtgaggctctatataccatagattatcagcatatctgctggctgaatttaataaattttgcaacttattcttgttcatctcgacttcagcctttgcttgtgccctgtcagcctccattgcagccctttcttcctccttacgacgctcctcctcagcctgtcttttcctttcagcttcttctgcagcaagcctttcaagctctctttgtttttcttcaaccaagaagtcctcaaatgagtgttcattgatttcgctttctatttgtaggacgaaatcattatgattgttattttcgtagatggtgtcaccattaaagaatacaaaatctaatctgtaagcctgcttgggtatatggagtttgcagcaccaccaatcccctgttaactcacttttatgcattttttgggtaaattttttccatctccaaccattgaatgcccctttgataagaatatcaggctcactggctaaggctgacatgctatggttcaagtaaagatcaatgaccgaatccgcctgtactacttcaggaaaaacaaaacacttattcccagccaaataatttttctcagcaagctcttcaagccgcctcctgagcacttgtggatccacatcatcctgtactggtgctatatcaggttcatactgttcatccttgattatcctagggtcatcatcagcaaacagaactttctcagtttctctacttaatggttccctctcaatactcttgccagttatctcttctggtgcttcttcggtgacatcttgtccactaataatggttttctcttctgttggattttgtccactgacaccactacttggctggctttgttcgggaacagagacaattgatctatcttgctcatggaaactaactacagatttttcttgttcatgaaaaccaacaattgatctgtcctgtacatgagtgctagaaactgatgtaggttcaggtttcgaacttattagtgcacttattttaccacggtattcatcaagttttctgtcaattgcatcatcatccatagattcagaagacagttctggagactgattttgctcgacctcttcttcagtctcagcttcaaaagcatcatccattccctccaagaatacactgctcgatacatttccagagaagtccacctccgatgattcttctacattactagtttgctctgttgcttcactactgagcttcccattgcttgtgccaagatcaccttcatctgtgccgctttgtccaatcttcttcatgctggattcaacagtaggtctcggagcatatgttctagaggcagcacctttaggtttcggagtggaggctctccttgggtttctcttagaataatctgaacaatgcaatgtcaggaaaaaaaaaacatgatcaaagaagtaccacataaagacagttgtgctttgaacaaaaccattccaccaacctgcacttgccaccaagcatcggagaagccttgtccttgtaaatctcctgcaccttatgatcggctggggaaaaaaaaacagaaaatggtacatgtgtgtgagtgcagatcatttacctttcctgaactaatcgtacttaatacatgcatttcagtgaaaatatccctgaagcagaaccgcacaatccaaattcccacccaagctacaaaaatttccgacaatgttcaatgcgtggagcaaatcagcaaaattgtcataaagttcacttcagtcttcagatacacacaaagcctgaaatgaaccaaccgaccggaacaaattctactcctagaaagtagaaaccaatcaaaggaacggaacaaaacgcctcgaccacgcatggcctcatcttctaaagcggcatggcctctcagtggtagcaccaattaaatcagaacccggagaacacgaacaaggaggaggccaaaaccgacacagccgcacccaaacagctccagagacgcacctgcgcgaagccagtggcggccgtcgccgggcggacgacgagcaccggccggctccgggagcagagcgggctatgcgccatctccattgccagcgccaaaacctccctcctctccccctgatcccctcctcctccctccctctccctctccctcctcagagctgactcccttcccttctttttcttttctggtttccaaaaactcgcatcgaaatgcgcagctgtgtgctgtccgcagacacacacacgcgcgcacgctcgatcgaaggagaaagaaaggctcccgtgctttcccgtgaaattttcgcgatctttttcttttttattttctgcggcgagagggaggatttgtgcgggatttgtgtggacggtgtagggtgccgaggtggtggggccctgagcgcagggagacaggagcaaaaggctacaaatcccaaaggagggggccgcggggttgcaaacggccaaacctggcgcgtcagtgagtgggccagggggcgttgcaacggacggctgctcttggttgggggagatatggatggggacatcggatggatggcgagagccgtgtatgccttcgccgttccggtggatcggcatctctccctgctgggttctggaacattccatgttagatctcgccgactgcccagtttcaagcagtcacctgttaacgtctatactgactttaagatagctataacttttttttcagaatcaaaagtttgcccaagcaatttaacatttcgtctagaatataaaaatatgtagttgtagatttcagaagataaactagaaaccagattcatagaaactagctatcaactaactacttcttagaatattaaactcctaaacagacccttagtcagtgaaatctattaataatattgctgctacactgatctaggcttctagttgtagtgtattagtactacagtgctttaacaaaatcaagaatcagacacgtgatttccaccataagagcaagaagtgtcttaaagtatcactagtgttgtctcacaatccaagagcatgaatacattatgacatgaataacacaatcgagaaattaaacattcatcttttctacatatatgacaaatgcattagtacgttgtggtactacattgtcagattcattctgcttaactttttagacaaaagattaattttcattggcccagcttttaggagaaagccaaaagaattcatacagaagttcgtcctgcttattgtttagtaacactgaagttatatttgaagcaaacaaaagataagggaagaaagaaacgtatctgagttgcttctcagctctcacggtctcacctagtcagttctcgactcgtctaatgtccatgatgcatccagcagttgtgcctgaatcattgcttgtaaagatcttgattgattgatggcttatcctctcctaaaataacagcaaaggggggcaagctgttcttgtcctcatgttaggtccatctcctgcaagtccaaatggaagtaagacagaatagtagcagcaacaactcaggactcaaatacgtccaagttccagaatcattgtacagagaaaccgtcgacattgaacaagattgcttattgctgaagcgtgtatcaggttaactgtagaacgtaggccgtaaagtagcagttacatggaaacagattagttgagtgcataacaaattcagaagaaaaaaaaaacgtaactcaggaaacacaaactgtctgtcctttttcattgcagcataacaaatacccgattcatgcttagaagttcagtaaacagattgatggggagcatatggtcattggaagagttctatgagttagcaatactaattttgctgcctagaattccactttcattctgttagctgaaagactaagagaatgcaacagttctgccatattatttttcttttgtagtgtgaggccgtggaacataaataggtcttcaaattaatgagacaagataagaacatgagtgaagaaatttgatttcaggccaatctgcaaattacacatggcaatattaggccgtctaaagaccttcctgagtcctgacattgactagagaacgataataccctaacagtatagtcacaagacaatcatttgtgggctttctatgagttcttatgagctaaagaccagaacaaaaataaatgcacaaaaaacagtaggcaccattatactataagcattcaatcaccacatcagtattgttcatgggtttaaccacatcaggtggcccaaattcgaaagcactaacagactgaaacttgagatttgttcaaggtatcaccatacttgcagacagtaattgcaagcatcatgctaacatgactaattaactaagatgtgatataaactgagaagaaaataatgtcattaattacaaaaggcggataggcattaagcagctcctactagggaaatactcgaaggattgcgacatttgcacttcaacagaaaaacttttagcaattatgccaagatgtaaatgattcaacagcaacacaccatggaaatcaatgtcgaccagaccaattcataaatggatcagtaatatcagttgataatatgtaaaaccccactgcttactaaagcgatcaactataaacttaacaagatgcaaaagaaggaaacacaataaagaagcgaagtagaacgtaccatccgttcttaattgtcttaattagcagtaccctacgattcacctcactatacaaactaaatgaagaaagtagaaatggctggtccgaaaacgaatcatgttccaacaaaacagtggaacaccattatgtatacaagtcatagatggtatataacagcaatgcatgacataagcccaactcacatttctcagaagttggaacttgaaagcatcaaattgattgctatggatgacgacatcacgacactaatggctgcagttgaagatgctccatgttagtagtcaccgagaacaaatgaacctaatacatcagtcacagaaaaggcaatatcatcaaaaccaagcgagaatttggaaaacatcctgaatatgctcccaaccattcaatgtgaatttagcataagccactattgctgcaagtgaactgataacagagtattttcacaatctgggcagaatgaagttctattaagagcatacgaaatgtaagagaaaaacatgaccaaagttaattcgaaggcagctctgactaatgattttggttactagcagttacaaccaagaaagcatactaagatttatgtcagataagagggtagttgccaaacaaatttacttactgtagacaaatagctttcaatttctgaagtaataccagctcctctttactttcacacggcaatgaaaaatacaacatgctatacccattgaaaaatcaagaacaaaatagcttcaattcacagagcattcaatgatcacagtaagagcatccagtcatattgcaactcttttctgtcactttcgtatttttttagcaaatcaaagcataagtattcttttttgtctttgttttcacatatcagtacaaccaaacaaggaaaaaaaaaatcataaaccacaaaactatcgaaacaagggagagctagatccccaaatctacaggtctatcgcagcaaatacatcacgatccgccctcctagtgagcggcgaccaccatgtccggcgagccgaggaactccatggccacctcgacgggcaggtccgggctcggcggcggcggcgcgaagagcatcaccctcttcgccgccgcgagcttcttccgctgggggcaccgcgggccgaggagcctcgatacgggcacgaagtacggcatcaccgcgccgccctcgccgtccccggccgcagcaggagggggagacgacgagggcgcggcgggggaaggcgaaggcgacgagggaggggcggggcgggagacggcggggttccggcgccggagcctggcgtcgcggaggcgggcgagggcgccggggcggaggaagcggtggtggtcgacgacgcccgcggcggcggcggccgacgaggaggagcggggcttgcgtgtggctgccatgtgggcccgaggtgtcagtgagagccggatgcgggaggcgcggattggtgggaggcggagggagcgggtgggggtatttgaaggggttagggttgggcggggacgcgcgagccttaggagggaaaaaggtttgtgccaaaaatgggatcgcgccttcgttgctggtgacgcgtttacactatgacgagtgggtcccgtatgtatgtgggtcccacatggcggtgggatagatggcgcgtgacgtggagggagtaaattggggggaccggttgctcacgttttgaaacgagcgggcggcggatggcgcgcgtgccgcgtgatcgatcgcgcgcctatcacggtaacccgaccgatcgtatgggccgggttcgttgaaagcgttggatcgcgagaagaaaaaagtccactttacatcccttacaaatggatcgagttttaataatataacttgaacgtaaaatcaggtatactgtgcaactcgagtaaaagtgcatcataggaattggatgcaagccttgtccacaattcaacagttcgactagaaatccatccacaattcaacagttcaaggaattggatgcaagccttgtccacaagtcaacagttcgactagaaatccatccacaattcaacagttcaagtagaagtgcatgatgttccataggccatatttgcataggaattgccgaattggatacaaagtgtgtctgcagcaatagtctaggataagaaaaacatttgagcgggcaacaaacagacggcatacttgatttgttctaaggatacaactgccggcacagtttgtttcacatataagaaagtagtgcataaaaaagggacctagaatacaaatgtggaccaaaactgcacaaaaacagtaacgaaaaggtgatcattacaatcttaaaatctggaaacaattgtgaacgatatctgaaagatggcaagttccacattataagctgaatcaaaaacatcaccggcatcccacatccatatttacattctttgaatcgaacacatcatcagatgaatccctcggcattctctggcttctttggagttttggtactgttcacatcagtagtggccgtgcagacaggaatcgttgcagggcttcctgggatatgggttttcgacaattcgctgtacgggttcctgtgcttttcacttttcgcggccatcgtgaaacttccaggtatatcggccttaggtaaatcagcctcctgatgcttatgctccttcccggttatttgggcattttcttgcgcatgggctgttgggattgcggcctcctgattttccagctcccgtttacccatttcaggtttttctggcatgttcttctttggtcgttcaccttcctgatgcttgccctcttgtacaaactctttagagcttataggagaatagtcctttgccggtttatcatcttgatgcttgtcatcntgctcagccaccaccatttcctttgattttgctccagcatcagttgcagtggttgcaaccttgctataggcatcggttacccatgctgcccctgtaaggatgtatctgttactcatgattgcagagccagcagtagagactgtctgttctgcagctgctaatgctgatttggtcttctctgcaacctggtatttctgatccatttctttcatcttctcatttaccactaaggtaccagtgctgaacttctggcttagacccatcttcctatcaagcgaggtaactttcgcagttgcggtggatgtgagctgatgcttttcatcaaaagacttggccctttcaagggcatccttcccaaggacaaatcctttggccaacatggaaacaacagcatcctccgccttccgaagtgcagattccatgccaccagcgttcttagactaacagttcaaagataataaagtctagttactgaaagcaatttgcgaaccaaaccagagatgcaaaaattccatagttctacctcaatatcagctaaaacggctgccggcagctgataattagtggccggtgttatgatgacagacatatccactatagtcgcaccctgcaccagaaaagtacagttttacatcatatagagagcacaaccaataagacaaattttgaatccatagcttcttattacattaagtcaattaggcaatgtataggtgctaaagcacaaaagcacatcattatcaattactggaagaaaagaccgttacatattaccgtgagaagcatagccctctctgctccttcgtcatcttcgaaggtgatgtaggcaaactgagaccgctcgtcaccactgaaaagcattgcaaaaaggttagagccatatatcctccttcgtgagctgtctttgaaggttagttgctctgtataaataataagagatgtcatgaaggacatagcactaacctttgcatttcaacatgtacgatgacaccggaaaaggaaaagaactccctgatatcttgttctgatgcttcaagtgagacattgtggacctttattgtgctaaccatgcttgctttcaaaaaagagcataaacagaaaggcactaatcagcacactggttagggttttccatttttagatgcctctctagttagaaaaccaggacggtgtagaatgaacttcctcttttagtaaacaaatgaattttatggatcaatcaatttgggaactttctcacagacacacaaccgagaaattaattttatgcaaaactatgttacttgtcagcaagcgttatcaatggatcatgtcttcatcaaataaggttgaaactcacccaatttcatgaaagtaatacatttgaatggtgcttaacaagtaaaagagggagtgccagtattacatgcattattgggtctcagtttctaacagcttttgaaaatggaacagtcaacatgtgctcatttctgtgaacaaaatatagtatggaagagacagacatatatgttaagactaaaagaagaatgaaacattaaaagatcttctaaattttataaactggcaaaatatatcatgatggagtggtaaaaaaaatgtgacatgccaaagatttatagtgcaggtaaggatactaccgatctatgcagcagacaaccttttttagatgcattagatgttagaaacttagaatcatggtattacattgtgcaaattgccaaaacaacatgcatcgggtagcacatcaggaataaataaatcaacatatactagaaaaaagaactttagacatccagaatttcagagtaccaatgctgtctcttttcctcacatgcgagaagctgcagcaataatattcagacaaacatcacaacgaccagaaagtatgagccctaaagaatgtctaaccatgcaaccaaatgagttccaacaaagaatcataggacgagagcacttcgatctcgaactcacacggcatcaggaacaacgggtggtaggttcctcacctcaaacgagaaattgtgcgctcgcctccacggacccaatccgatccgagcagcgctcgctccggactccaatcgctatctcgaactggggagagggagagggtcgacggaaacgggatccgttgcgcgcgcgcattttgccgccggtttcgtcggatcagagtggtggtgatgccgaaaccctggaggaggttggcaacgtggcgacgcgcaggggacccgatccaatgggccgtgggccttcttcttctcttgggccgcctcaaagcccaatgcctcgctcatcaagcacacgcttcctccggtggtcggcggcgagccgaggcggcggagggatgggtggggggatgatctgagcggcggcggaggacctggcgcggagccggccggtggcgctgtcgctgtacaggcggatcctgcgggcgctgaactcgccggagctgccgctggggcacgcggcgcggctggcgaagaaggcggagtgccgcgccatcttcgtcttcggcgccgaggagaggtcgctccacaacatccgcgacctcgtcgacgccgcgcgccacaccctcggcctcctccaccgcggccgcctcccttgagttgggagaagaagcaagctcgcgagctacagctatggtattattacgcgtctatttcagtgttttttttcttagccattctagattgtaagattcagttcgtccctgtgtgacatgaactgtgttggagtgaactagtatatgcccgattttagatttttctgctatgtatgtgtaccacgcataacatatctattccaaaccgaaaaacggttagcattatgaatttatttccactggagtcaatttgatgttgttcttagatttgagatgtaaagttctcgatggtacgaactgataaaaagaaaatttgaaacattcaagcactagcatagatagataatgtttccagattccttgcacaactcctaacaatttcatgcagccatagccttgctagacataggactacaagaaataggcggggacgttcgatttctgacagaccaatgaagctgcaacttcatatttacacctttgtgatccgaggtaacagcaattctctcagcaacattgttgatcgatattactaatactgtaccaagctatgaaaattatttactcttcatttctgtgaaataaataactgtcaccctgttaacgttgttacaacttgcaaaatggaatcttaaatgtaatgaggcttctaaataaaaagcagttctctgttcaatgtaacggaactgttctaaattacagattgagtggatttatggttccttacagaaggtatactcagtgaattcaagatgcatgcatgaggctacaggccaatcttgcacgtaaagcccagctttaagtgatttcaaagctttggttcacagttggttttgctgaaattattttggatgtagattttttttagccaagattatgttgatcttagtgatatatatttggtcaggacttaaacattcttagatatctcaaaatagaaatatcacaaatacctctacaattaccatcaactgattcatttttattccatctcatatatacacttataccatctcatagagactcatttttattccatctctaggctgcgttctttaccgctggttcccaacccatctctctcgtttttcgcgcgcacgattttcaaactgctaaacggtatgtttttttgcaaaaaaaagtttatatatgaaagttgcttaaaaaaatcaaattaatccattttttaaaaaaatagctaatactcaattaatcacgcgctaatggatcgctccgttttccgtacggagatgataggttcccaaccccaactaacataataatctgataaaattatacatttatacaacattttctagtgccaacctaaatttggccctgtacacaaattctcctatccagttgtccatcttgagcagatgattgcaacgcatccagtttttcctctttcttctgctcgcgtgcatctccattgtcacccctacttcttgttgcacatggttccttttctggagacgaatcaatagccgtaacgacttacgaaggccaagaatcaagatatgttgcagatcgtttcttgattatagcaccatgcagtaatatgcaggaacatcttttaacacaaacaaaaacatgcagacaaacaatggccattgagtactgcagcagcattgcagcatggggagaaggaagataaccatgaatggctaaaacagtaatttgactgaacactgctgcttctttatgtctatattatacatcataatggatctcacagtagcctatcaaatggaatcaatatcaccaggactacagtgagatacagaagcagcaatgctccagctggcccacaaaggccaacctgatctttttcttcagtactgtagtgcatacattacaagttaccctaaaacaagagaaatgaagcatggaaatactcttggaattattccttggattaaattctaggcttacaatgttttccctattcggtggtcgtggcaactctagatcttctgcttgagcacttgccggagctggaccttctggctctccatccgtgcctccatgagcttggatttcaggctgtgcttctgggatgtccgtgggtactccatgcagcccttgaagccccggttgaattgcatgctcattgaatccggggagctccattgccctatgctcggcgagctgaggcctatttcttgaatgccactgtcaatggtagaatgggtcccaacggatagccgaacattagatgatcttccattgatcgtctccacagcatctttcttgcagacgtcattgttctttggacgggacgacttccagagctttgataaggctgattctttcttcttgggttggttcatgtttgtcaggtatatatcagtcgaatcatccttcagtttctcagcttccttgtactcaaaatcgtttcggctcgtccaagagatgcttccatcacagatcttgttaactgacggttcacttccatccggtgaaccacttgaagcctgcatatcttcatggcttattgtctcccagctgctgccatcttcagtgtcactctcattctgagggcttttacttgagtacaccttggttggcttttccaggaatatatcagtcattgggctagcctcttggatttctgattcgcacatagcagagttgttcttgtagcatggctcaatctcctttatgacaggctcttcacttggacgcagctcttcaaaaatggaaaatatgtcttctgattgtgccggtggctcatatctgaattcaatatcttgtgctctaacagatttgatcgcctgtattatgttctctgcttcttccacaaccataatgtctcctctagcacaactgcatgcagcaataaaagcctcaacatcctgttgcagtttgctcaattgtgtgtatttggcatcaagagtaagttttgcatcaacaagcttcatctgcacccgttcttcacgccaaacctcagccatctgtagcatcttgcgctcctcatcaacctcctctcgcagcttgagggaatcatgtttcaaggcttcaatctcggctttgtcttcctccacctcccttgccagttcattgcacacctcctcagtgagctcgcgtgctttcctctcattatcatattcttgcagtagctgctttgctgacatcttggcttccttcaactcattgacaagcttcaagttaatcatctccaggcgtctcctgtttttcttctcatggtcaagatctgccttcatatcttcaagaattgcgcgcactttctcatgctctctactccgccaagctgccttttcctctgcaagtttcttgaacaagtgatccagcttcttcttagccgcacgtcgctcggtttccagttcacttacccgatcacgtgcttgctggagctccatctggaggttagcaacataagttgcatcttgctgctcgttgagaagatttagttgactagctatcagataggcatcatgtgcttccattccctccaagctctctggctcccattttgttgccttctccatagcggtgactggtagcacagctgtagcagcatgaagcggtacctgcagaattaaatagatcagtgatcttacatgctggtgcagcaaaaagtatacagaggttttaacctcagtgcctcaccttatggagctctccactctttcgttccaaaacagaaattgggcttgaaatctcattcttaagggtttggtgatgaaccaaattattctgtttaataagctggacttgtagatgtcttgggatatgctgtcacaaaggcacatgcacaaataagttacaagaaaaatagatccaccagattttacagcaaatccatccagaattccagaaagcaggcccctcccccctagatatgtataaattcatgttactgtttaccactggggctattccatatataacaaaacagtgaattgtcatgggacgtcatccgaaacacagagaatccagaggggcccaaactatcatgacagatagacccctctaaaacagaaacatatgcactgaacctaaagtccaacctacatgaccacacttgtagcgttggtaacatcgatctcatttgttggctaggattccccatcagacctaaggttcaaagttcaaaaaccatttgatgtagctaggatagactccaattggatgagacaagaagctgtatggtcagctagtggctcacaagggaccacatagctgaacccagcttgcatatgtttgttgctgcacgggataagagttcaatcatttggctcatcggatccctcttaaaccaatcaacccaaccaagatccaaattccaaatcacacacttccaatgcaccattcatttccgtaaaacggagataagctactaccgttttcaccaacgaaatggcctaagccatacggacaattcatttgtagccatacgggcaattcgattgtactagttgcacgagcatggagaatccaatgactggggcccgaccaggttcacatgaggggatccgggagcaggaaatgcaactgccctttttggatcagtaaatttatgcgacaaggatcacggccatcgcccaatgggctcagcacggcagctctccataaatgtccatgcttctgagcgacgcatcctgcgcttacgacgaccactgaatgcgtcgatgctgagcgactgacactagtactgctaagcacttcaatgaggagaatggattaatggatttgactacggcagtcggcaggcgagtttaaggcagaaataagcagatgaagctagcaggcagatggtacatgctcctgcatggtgtaatgaagaaatcgcccagaaggcgaactccgaaatgttttgcgtgagatctgaacatctctgcaacaaatgagtgcgttttgacctggaatcttagcattttggtagtaatggattagtcaaaaaaaggataaacatgaccctagccaaagtttttgtttgttttttctttgattcaagctgaaatagcatgagaccggaacaaatccatcaaaaagcattgaaaatgcgcgctttcttagctggacttgactaggagattgacgaacgatacagcaaatcagctcagcgaaaaagcagacgaagcacgagcttctagtgagctcaccagcactgcaacgcatatttgttgggggaaaaaatcaaaaacgaaaaaggggaaagggtttaagcctccgtgcacgtacctcgaggccgacgtgaaccctcctcctctccccgctccccgcggcggcgcccccggccaccgcctccggcggccgcagccgccacactccagccgcgagcctcctcaccgacacatcccgcgccgcagccgccttctccgacgggccacctgccttctcgccgccgccaccccccttctccgcgccattccccacatcccacttgagcagcggcgtggcgggcccgctccgccgccccccaccgccaccgccaccgccaccggaccccgacgccgtcttcagcgggcgcctccgcagccttcgaggcgtccggacagcagacggcggcgccgccgcaggagcagcggcggcggcggcggagcggtgcttggagctcatctgcgacggagggtgcggctcgggtggagagcgcgctccggcggcatcggctcggagacaagacagggagagagacgcgcacgcagtggagctgaacagcagaggagagcggagaagcagggacgggagagagacgttgggggtggctggctacttggctagtgaggaggcgttgggaaacgggaggtaaattagagagagagagagggggtggtggtggggagaagtaaactagagaggggaggtgtggagtttttggggagtgtgtggagatagtggaaggacggatctgggcctggccgcggtttaacgtgggtaaggctgtgtttggttccatgttaaaataaaattggaagtttaaagaaattaaaataatgtgataaaaagttagaagtttatgtgtgtattaaagtttgatgtgacgaaaaaattagaatttaaacagagcctaaatggatggggagattttggatgcacgcacggctttgttttgttatcaactctcttgatgttgcaacaaaaaaaaactgtctacgatttttgggtgtgtgatctactgcagtacactataggttcaccaagaggctgtcatgtgagtttttcttaaaaataatccattgttctcatgtcaaaattgatcaatatttaagcatggtctcaaaatagcatatatgtgtttttacggatcagatcctctatagtaatgcataggggcactgtttatgtgaggagtacagtaatgcaatgcagtgaacaatgtcgattcattgtagcaacaataacgaaacacattgtatagcactattgagtattgcggtagatttactgtagcacgcacgatttggacggtctccattccccctaataccggatattgtaaatcctctccattacaacatgtaatgcagaggatcttgattcgtatttctacgttaacgtttctctacatctttacaaaatatctcaataaccactcctttataaaatgtagtacttatcttattacgagaacaacgagttactacttctccatcagaatgtgaaggaaaggaactatggctgtgtttagttccttccaaagttataaatttgggttgaaattggtatgatgtgactgaaaagttgcgtgtgtacgacaagttgatgtgatggaaaaagttggaagtttggatctacacagcatatgtgttggtacggtacatcttccgtggtggaaattcagacaacttttatgtgttggtacggtatggttacaaacttaaaaacacgttacgtcctctagtatttattgtgtgagaaaaaatatacgaagttaacaaaacaaaagcaaattaatcacataaaagaacatcaattaacttaggggacaaggtccaatctcagatgacgcctcctatatctctagaaagcgcaacagcacgtcacatgacatatcgccgtcaccggctcaccgccgcaggtccccctccaaaacggagggcaataacggaacagccctcacaccccgcacgtcgccgttgaagattgaagaacccatcatcaaatgatcaacaaaatcccaaatccaactgcttcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatctcgtccttctccatccatcgcggccgcggggagcagtaaaaaaaaaaatgggtctcgccgggaggaagacgacgacgaggccgtgcgcccgtgtcgacgcaacgcacgcagcgctatgactttttctctttttttttttgacagcagcgcctgtgattcttctgcgagcgtaacagtggagggtgaattcaaaatttaaaccttgccgcaaaggtaaaaaacgcaaaccggcaaaaccccattgtgatctgtgaattcttcaactttttttctctgtgttcggagctctcctcttcagattctttccctggttcatgtggatggatccgattcatcacccatcaagcgtggagacagctcgttcgtaaacaataacgccgtgtctgtgataaggatctagcaggagagaatactatgccgcagcagtagtagcagcatccgagctttctcatcaagggggaagaaagaatacgatgtagcactagcagcagcgtgcagcatgcttgacccgacacacacatgaagatgagcatttttaactgcagatcctctcgtgctcgtgctgcgtggagtatgcatgtggcgtagtcgaatgctctacgggggtctaggctagtagtagaataattctctttgtatcaaaataaaccaatatcgtatcggatatgatacatcgttcaaattcatcgtataaaaatatgttacatctaatattatattggtttattttgaaacggagagattagtatagagcctgttcactttgatgtaaaaaaaaaccttttttggtaaagttgtcaaaatttcagtaggatttcttatatagttaccaaaatttaatagcaaactaaatgtagctattttttttataacttaactaaaatttggttagattgaaaatgtgaacatgcccatagatttgcctcgctggtcggctcggtgccgacttctgagctccgacgaagatcaggtaggtgtagttcaggtcaggtcgcatgattagtcttggagcggcgttttgctccgtaattatggctgcagatcgatcggtcaaggcgtaccgcgtacagtatgtactactcgtatagtctactgtagaagtaacatgctggtggttggcgatgccttgttaatcttgggggcacggtggttagatcatgattcggaaatggtagttgggcttgcagaggagacaaagcaattacatgtgtaaaggggagcgattttttcttgcaggtacaggaatgccttttcaactggtgtagtacgcattagtagctcggttgttgcgtattctttggattccccctatttatgttctgtattgtgttgctctcgacgctgcttgttctttgggcttaggattccccttaagtattttatgtttatcctgtattattattgcggagaagcaaagcttgaaacttcctggaaggagtacaaaaatctagaattcggcctgccttgatgtggctgagaacgttggcccaacttagcccaaacaaatttaactggctttggcccatacaggattcaaggtttttgggtcccacggaaaacgaactgaatgtatctctatctctgtcaaagttaaaaatatttctaccacaattttagtacgtcatccgtatttgagttagttataaatccatacttaatttgaatgtctaaaataactagtatatacttttagggaccacctattatgcagttaattgaaaaaaacgaaatcatcagttgattttggtatagcgttcaaatccaacggttgttgagtaaaacaacccaactcaactagctcaacctttctctctcccaccctaactcgaccgacccataccatcccatgcgtctccaatcgacgccacgtgcaccttctccgaccggcggtctttttctctcgctaatcctgaccctctccctctacttccaatctcatctcttttctttttttttctcttcgaaattcctcttctcataaatattttccttttgaatttatcattgtttaaaatgtgaaatgtagtaagtttgttacattgcaaatacctttccatctagagtaaaagaatgtttactaatgaataaacaaaatttcaacatttgattgacgaggtatagtaaaatgcgtcaacttatgtaatagacacttgattgatttgtgagattatagaaaagtgtacataagggattgttcgttccatgatgcatgaagcacgtgtaacccgcaatgctatacatggtttctaactttatttgctgttgttttatttgtctattttcgatttttatcaatcgtataagttatctcactggttaaaacgcatacatttttgctggttcgataaaaactgcgaaaaaaagagcagtggcgatcgagactcttcgaattcgttcgattccctccacgaaatttgcccaaaaaacagttctcccgccaaagcgtgaatcccccggccaaattttccccaccggatcttcatcctgcgaccgcggctcaatcccaatcccatgccgatcccctcctgcttcctctctcaaatctccctgccgcaaccctagcctcgccgccgccgccgccgcctccggctcgccggctcccccctcccccgcggatccaagctatccaccaaatccctccctcgccgtcgccggcggatggacttcactgccccttccttctccctcggctccgagttcgacgagccagaggaggcggtagggtatacggcgcccgatgccccgtccttctctctcggaatcgatttcgagggcgacggcgacgagtcccacctcaccgatgccggcaatggaggggaggagcagaagcgttatgaggctcccgatgcgccatccttctctgtcggcatcgattccggcagcgacggcggtgaggagcgccgccgggaggagcaacggcgaagttacgaggctcccgacgcgccctccttctccctcggtatcgactccgatggcgacggcggcgacgagccccacctcaccaacggaggccaccgggaggagcagcagcggcgttacgaggcgcccgacgcgccctctttctccctcggcatcgacttcggcgacggcgacgacgaaccccgcctccccaacgcaagccgccaagctccgcgctacgaggcgcccgatgcaccctccttctccctcgggttcgatgacgacgaagacgatgttctcatcggcggcagccgtcacgagctcgggactgtcgaggaggaggacgacgacttcgtcctcgccgacggccaacagcaacagcaacggcggcacgaaactgttgtccccgacccggcgccgccgccgccagagatgaatcgattcaagcggctgcggagaggccccgcgccgccatctcaagcgccaacaccacctcctcataggacaccagcgccggctacgatggaggcttctccggtggtgagctcgaaggccgtcttgggggatattgggagctttgaggatgagatcgaggatttcaccgacgaggagagattcatgcgaggtgagggaaccactgaccctactttcttgaatttttgtgcttacttatctttctaggcatttccgtttcttattctgaatctagtaatacacacgtacacactcctggtcaatgaatttgtaatttggcttcttcaaaaagctgaaggttagccaaattactggaaccagcacagcacacactagacatccaccaaaacttgcagtctgaaaaatagagagagtgatttctagcgatttggagtcacatgcctgttcatgtaacataagagtaatccagtagtcaaccataaaaccacacactcagtagatctccaaaataacactggtcagattacactgaagactgaacaacccgtagtacttcctcaatcttcagaactaacttcagacaagaaattagctgggatatcctcaaccaggcttgctgccatttcacaccaattatgccttcagatttgttgtatttgttgcttgattgcttgaaatcctattaatatatttttctggtatcgccccttgactagacattccaacatgtgctgtgtacatctgctggatgaggaacttatgccccttccaataccatcctgtttgttgtcagccaaagagcccaacaaagagctagcagcccgtataacataatagtttttttggctaactttttagcttcccatgtctcatctgttctttggaaaattcagaaatagagttaggaacactgcaaatttgccatagagcgctgaaacaaagaaaatgtggccagcagcacccaattatccacacaatttctattgtgattattcattcatcatgtatgtggtatatttgtctgcagctggctaatctctatattttacggaactttcttcatttccttgtgtggattgtggaacatgtaacaacttctctgcttgcagacgtaccgccgtctgttggtagctgcatcacttctagcagctcaaggttctctcatgccagcaattcaaagttctcgctgatgaaccatggtgtcctgatgagccaatcaacaagtaaatcaaagaaatttgcacaaacacctaattattctgcttcaaaatctatggaagaaagcagcaccaagaaactgctccctaagacagcattgagcccaatgaggaaaattcatttgcttgattcagatagtgactcggatgataacaaggaaatgcctggtttgcagcaaaactgcaaatccaaagtgagcactgttcaacataagggcaaggctgagatgaatgacagttgggcgacacctgctcttgatgagttctgcaatgagtatttcaaatccgtggaagactcgagaccatctcagcagaaagaaggcaacagtttttgtggccccaaagtcatacgttctaactactctgttagtgaaactggaggacattttccacatcaatccactccaagtggggctgtactagaggacaatcagacagatagtcatcctcctgcaatgcattattttttccaccatgaccagttggttcgtgacctggtccgtcaaagactcaagcattttgttcctgttggagtagacagcagaggaaatgagcaagatggaacacaaaatctccagtacaggtaattgcggttcacacatcaacaaattcacaatcatatcctgcagtcctctgtgcaatgtcttcgctgatcttggttactctgtttcatcatccttctacaggagtcagaccggccggtgtgctgctgaaaatgatcggtgggtgactccgaacaagaggatgcctgttgcaactcaagttggcagaagaagagtaaatcctgctggaatgtctggctctggccattggttgactggagacgatgggaagaaggtaaacctgcatgtttgttttcaacactctagttgatttcttgatggaaaaaaggctctgtcgcatatgcactgtttttcattatggaggccgacctgtttccccctgtattttggttacgtattcatcgttgtgctccattggatttgggctgcaggtctatatctccaaagatggccaggagttaactggaagggttgcttaccgacaataccaaagggtgatatgctcattcctttatgattaatttcaaagcattatccttgtttgcaccacactagtttcatacacaatattagcatattttgatttattttcaatttaagcatatagtggttacatatgcctagagttgcacaaatatatttagtttggaattcatagtgaacctggcatgaggatgttatttttactgcatggtggcatgccatctaatttaacaaatctgtgcggaacaggaaagtggcaagggatttcgccagtcgaagaagaaaagttcggctggaactagagcaaagaaagccactactaaggtgaaacaagagaaaactagagcaaaaagaaagcgctgaattcaagacgtgctggcctcgtattcacagacgaggtggtgccaatgtaattagtcaatgagaaatcatagtcattatttgttcaatccatttcataaggagttgttaaaaacatagagcagagtagaatgacatggtttatgtcggagaatataatcacataacaaagcttcaactgttcttctttgataaggtaatttgggtgactagttatttgttaacttgatcaggctttgctactattttacacgtcgtgctcgtggttctctcatagcactaatgcaggaacacaaggccttggggctttgaagctgttcactgctgggtgaaccttgattggcaaacgaggtctccatggagtcatggagagaagaaaacggtcagacaatagcggctgcgcagcctgggcattcgtgaccgtggctgatagctgcggcgcactggtgttggcctccctgtttcgcgcttaaggtgttgtttcttcactagatgagctgaattcgctaggatacgtagcagccaaactagtaggcctaaatgggccttaacatttatttcacaagaaaagcttcaactgcagctctccttggataaggtgatttgggtgacgattgacttgtactccctcttccctctgtccaaaaaaaaaaaaaataaacccaactataaaaaatttttatataagacggacagttaaagttggacatagaaacttagagtttatcttttttttttttggacggagaaagtacgtcgtacgcgtggttctctcctgttgccacactcaattgtttacttacccttgattagttgtttgtcgtgtcgtgtcgtgcccgtggttctctcctgttgctgcactccatgtctattgtttttaccctcggtcaattgtttgggaacccacggtatcgagctgttcgccagccgaatcgtaagttagtacagagctaatgcagacagcaaacatggttgcggaacatggccatcagcagttcagcactccccaacgttctcacgcgttctccaacccttctgccagagcaattctcacgcgtgcacgcgtcaggccttcgatttgtttatgttgtgcacttgtgcttgtgcgtgcggtgtgccggagtttcgccggccactctttccactccataaccataatctctccgttttgacagtccacccgcggaagggaaatgcctggaggcgcggctcgtgtgctggcctgcccagtggccgagtgcttccacgccgtgcgcttgcttccagtggccgagtggcctttgcctttgctatgatcaagatgagcgcaatgacgggacgtgcagctgcatcgttcccgcgccgcgcgtccaacggctaacgcctccaaccgccaacgaaatccagagtcctaactaatctcgcgcagggttcggttaccttacctgcactgagctgccgaccgattattggtagaccggccggaacaattcaagtccatatttaaattttaaattgcatgatctacagattccgtgcaacatatatgttgaggtggatctatagaaaaaaatgttatgcattacatcatctctactctctagtagtatcctctactttagagtccctaagagcacccgcaatggtaaagtaaggtgctctctataaaacatgtacatctcagcaatagactagataatagtaaactacttcaatagtatgtctacatgggtatctatagctctctaatgcattgcctcgtttttctctatagactatctccaggttagtagatagctgtgctctctctcttcatttaatctcttccaagtaggaaaatatgctgacatggatctcttgtagagagcctatatataaccattgtgggtgccttaacaatcaaatgggggttgcctccaattctttaaaaccttaaatatgccatcaactttagtagtagccctcatattttagctcctatttcttttcctcttttattttagcatataatttatgtttatatatagtttaacaccaaaagtttgaattttaagttttgaagtcaggaaggcggattattttttaacctgggtttatcggcagtgatcggctcgttatccgtggaaaccagtttttcaattcaaaatgttattatattcaaacttttgtccacaacaactggccaattaccggtattttttttcacggaacttcaccgtagcatggcaccacgggtccacgaccgtacatggcccgagtcgcgactcgcgagccccggcccccgcacatggcacaccaccctgcgcgcgcgtcatctttcgacggtgtcggtaaccagtgaccacgcgcgagccaacatccgccgcccacccgctcgtctgatcggccggtgtcccgtatgacgcgccgatgcttgcgtgcaccgtgcactgtgcgggcgggtgcatgtccatatcgatatcgagcatcaccaacaatctacttatcttattccaaaactaatttttcgagattttagttaaaaaaacagttccaatatatacctactctcctacccgaattttgagttcccttctctcgattcctcactctatttatatgcgggtgtgaaactcactcccaatcttgcactccgcctctctctctccagttaccgcgtgggagatagcgatccttacatgtgtgaaagaaaaaaatggaatattctattagtagtttgacagaagggcccatttttaagttttagacggttgaatttaggcggttggagggatgagtctttcactttttattttcagtttagaaaaccaaaaatacttttttttttggaatgtgatgctcaccaaagctggattgaaacggctctccatcaatggcctgagcgctaaattttgcgaggaagttttggcggatgggaaccggtcgataaaacagagacgatcatgctacccgatacaacgctgccacatgttagagcaggagtttgtcagtttttggctaaacgggcaggattaccggtttcaaccgatgtatttggtgtaaagagaacttttacggtacaatctcttagtatatactagtagtatatagaagacatgttatctatgatcgggatcagacatgctgtgaaagttaagctatcggaaatagaaaaagtctatacgtactaaatttttcttacaaaatgtttacaaactctgatatgtcaaactgtgagtaaatctagatttcttacaactttcatctagttaaatcaaacggttgagaaatttgttagtaaaagttttgtaagaaaattttagtacgtgtagcagtactctcggaaataagcaagtaactaatcaggatttgatcccaaggatcgtatctacagattacagaatctgtacgaattacgtataactgttaatacgaaacccttaacagcatcatcttccaaatgctacagtagtagtactacattatatgttcactcgccattattgcgttggaccttgcttgatcgcgcgttcgggaccttgattaatttgttctggtgtacccgagttcagtcggtactcggcagtgacgtggttgcagcaacgtgagaaatccaaactgcctcctctccagcggccgctcgcccgtccatctgctttgcccatcccaccccgagggaccgagagcgtgacaagcagggcaacctgctctcccagccgccaccaccatcaaagtggccggggcccgagccgcgcacggcgcagcgcacggttcgcccctcgtccgcgggacgctgaccgcgcgcgcgacatctaccgatccgcgcgggcgtcacggtgcgtgctgcccaaccgatcgtgcattcgcgctcctccccgctgtgcgctagcttcctctggccacaggccgcgcgcccgtcccccggccgtttctgccacaccccatcccaattcccaccccgcttcccctcgtgcagtcgcgtggccagtgcccggtgaaaacgttgcatacgcgacgcgacgctgctacttccaccgtgcctcccgcgggaggcccctcgctcgctcgtctgatccgccagcttcgtctcccggcgttgtgcggtgccaccctctcatgcgtgcgattccatcgatcgatcggtgcgccactgcgtgccggccagtggccgaacgagaaagtgagcaaccagccgaccgggcgcgctcgtttttttgcacaaggccgccgcccgtacgtacgtctacaccgctctaaccaagttggatcggaatggctccttcagtggccctctgcccctctcgctctaaatttcgcgagggggtttcgatggaaagggacccgggtcggccgagcaaaccgagacacgacgtgttacctgacgcgacggtgccacaagtttaaagttagctagaccaggtgtttgtagctaaacgggcactgcttagatacacgtgatccggatcgaggcagcccatcagggggctccaaatggcgtccatagaaggggcagatggaccatcgacaggtttccatcgttttcgaatccaaatgctactgaagaacttgttccccttcaccacaattgcggtggacctgacctgttattagcttgcggagttgtggtatcagtctctcttcgaactttccagattttcttcctctcggcaggtgatgtacgtgtgtcagtgtgtggtcctgacgggctgaattaatcccctaacaacggcatgcatgcatggattgatggatacgccattaaacactgaacatccgatactttgttttcgcatatttattatctgacagtgtcggcgctccgggttatacaagtttaccatgtcggagaatttaaggggagagcggttccattcttctctctcattctctcttcctcaatactaaggtgtgcttggtttgttactatgccaaaatattggtaaccaaaatctaggcaagtttttgtagtgtcaatattttggtaactttttgtgtgctattggtagcaaaccaaacactattaaaatactaatcaaagtgctaaacaatttggtagggcacattttggcttcaaaccaaaatgaccctaaaaatatggacagagtgaagtccggtgtcggttgttagggttgagttttggacaatctcactgtagtttttttgttggccaagcgacgattggtcacgtttagcaatgatcggtccagtgttagctttctcacgagtttaagtgttaacgatgttggcgcgtggggtggttattattttttttttctggttacgatctttcaggactgtagtcttgtaaatttttttattccctattaacttcgtatttcgtattgtcttgtgcgagtgggtgaaaaaaaggttgtttcattctagacaggccttaaacaccttagttggaattctacgatattacggcgccagcttcagaaaaaactgtagtatactgcagtcctacacagatgcacaacaaataattttccatgtttatggcatgtgactagtcaaagtcctaacatactagcagccacctagcaaagcaaaacatttctagtatgatctccctatagtcaaacaaagcccttggagccactgacagtgggctccacttcacaaatacaaactccctggattaaataagcaccaccttaaatacgtgtccatcaacaatcaaaaccaaccaacacgctgttcaactccagaacctcactaagtttctggcaaggtctaatcttaaaataaattttcttaatgggtcaatttatcaaaattgctgccagaaccttctctattagctctccacaaccacacaaagcttcgcgccacgacgctctctcgcctctctgctgctttagcgttcgcgcgcgcgcgctgcggctggctggctggaccaagctaatagctatggacaccgtcgtggcggccgcgacgacgggatcgagacggtggctgccgtgggcgcggcggcaggcggcggcgtacctggcggcggccgggggaggcgacgacgggtgggcggcgtgcgcggcgtcggcggtgcggatcgtggtgtgcttcgtgtccatgatggcgacgacggcggcgtgggcggtggtgatgctgctgctgctgccgtggccctgcgcgcgcatccggcagggcaacctctacggccacgtcaccggccgcatgctggtaaccaacgctgcgagaagccaaccgatgtttcttggactatacgaattcagcgaagctgaataaactttttttttttgcttgcagatgtggattctggggaatccgatcaagctggaagggatggagaacctgaacacgaggggaatcttcatctgcaaccacgcttcgccgctcgacatcttcctcgtcatgtggctggctccgaccggcactgtcggaatcgccaaaaaggaggtagatagaactgtatatacacagttgtgctagcatgcaagagagtgagaaaatcatctgcctagattgtactaataacgtggctgaaattgcaatttatgcagatcatctggtacccactgttcgggcagctctacgtgctggccaatcacctccgcatccaccgctctaaccctgccgctgcaatcgagtcaatgaaagaggtataattaagttcagtgatgtttacacactcctgttcatgtcgatgcatcattgtgcttgtgcatttgtgctgtttcgtagcatgctcatatttcttctgccctgctgttcccaggttgctcgtgcagttaccaagaacaacctatcactgatcctgttcccagaggacacacggtccaaaaccggaaggctactccccttcaagaaggtactacaataccaatacagattcagcaactcctcatcatcatcgtaatatcagctgaaaaactcaccgatgaatctcgatgcgtggcacgcaggggttcgtgcacacggccctgcagacgaggctgccgatcgtgccgatggtggtgaccggcacgcacctggcgtggaggaagaacagcctgcgggtcaggccggcgccgctcaccgtgaaggtgctgccgccgatcgagacggacgggtgggtggaggagaggatcgacgagtatgtggagatggtgcactcgctgtacgccgacagcctcccggactcgcagaagccgctcgagcctgtgaacaccgggaagaagaagatgagctaagttcacggttagttaacgcacacacggtgacaatgggtgtagttttgtgcatacgcgctgtgctgattgttgtatagattggtgtgtgcgtgatatacatgcttgatttggggatttgtagatgcaacagaaggttaaaaaaaggttattgattttgtgagcacatgaagcattgagcttgtatttgggtgccaatgctgtcttcagcccttctgcggatcatattttcgttcttttctttgctcgctctccaagcgaaacactatctaaagaaaacagagctaaagaccgatacaatgttgtactcattttctccgtgcctggattccctttatgtaatttgattatcccaagctgcagccttcgtttcttgaaattgtatggagatttttttttaatattatcaactaaaatacgatttagcacttaatacactaagcattcccattaccaaatgctccaagatcaataaagtttacccagtgaaaatgactaatgcaagagatagtgagcaataataatggatgtccttgtcacaaattaagagatcgattgcattgatgagctcggtacaggtatactcagccgtttatagaaggaagaaaaaaaaaggcacaatcaacctttacgatccaattgaggaccaggcgttcttttgattatatatgtatacacaggtcagttatgcagcaaataccaatgttaggttcgtattggcagatgcttgcttcaaaactgagagttggaaatctttccaggcatttatcgacctggattccctgaacctagcagcaaaagaagaaatgtcgcattaattcataactgcaaaataaatatcaacgcataatagaaatgatggataatagtgatatattaccacatcatcatatagagtcctgtagtgatgactgatgaaataaatcattatcccaatttctgttttgagttacgcaaacacaccaagtcctcctagcgtaaccgttcagtcagttggtcagttgattgccattgggctctgggaaattaaagaaccgtttcaacttcagcaaactgaagtttacgtctatttaagtatggaatgtctttcccactgaaataggccagacttctcaacatcaccaagtgacaacacaggaaaacctgaaagcccagcactgaagctgttagaaaacataaccaggaggctttggcaggcctgctcttcttctaggtgctctgcctcattgcgatgcatagcaggatccttccaaggttgataataatgcctgggagaataaacatggttagatcctgcagtacaaaaatatctaatcataagagaagcatagacaaatgtaaatgatgtggttttacacactagaggccataccatctccatgcaggattagcttcagccggacattgtatctgtgagcacagcatttcgatttgtccatatcgccaatgaagtttctgataactgctttaagaaggttaaaaaaaatacgagtgcaaagcattagcaagacgggcgcatgttagacctagaattgatagattaaaaattcaaatcacggtaaacataccttgtttattggatctgtcaagaagcaacaagcaaagagcagccaccacagatggcaaaaaatctcggttcattttcagatgtttttgcaggtacagtataattatagctagtgcctcatctgcactgtgactgccaacagtttcaaccttttcatcatatgtatagttcaagaaagattcaagagatccaaaattgttggcatcccttgtaaggtctccacacttttcatgagagatgcaggagattttcccaagaattatggaagccactaaccagcgcagcatcttagaaagtaggcactcgttttttagtggctcttcatgtggcattttcagtacagatctttgttcatcacacaaccagaagatgttagaagttgcccatgaaacaacagttgctgtcatcgacttatcctgccattgtcacaaaaaatataatttataaatcccattacacaaaatgcatatgaagacaaaaaagaaacatgttactgcaaattatattaattatgaggtccacattgttcatggcactgcacattctcagttattaacagtaccacatggttaggcacaaaaatatatacagtaaaatcttataaattccacatgaatcaagagtatgcaagaatagggacagatagagacaaggcaaggcacaaatgaagtaccatttcagacaaaactggcagaggaccattcataagaatgacatcaatgccaagttgcattgcaagcttaacttctatgcttcttgagatgccaccaatagttcggcacaatttatgtatgccatggagggataaagagaaatgtggttggtaaatcttccttttcatagacaacctcatcgttgatgcaatcacatttagcactgaagttagcaatggaacatttcctttcaacaatttcatatcttcaacaaggacataaaggtatttagatattcttgagagttgctcaagggcggtttcttggagccattctgcaattaatcttgatgatgtcaaatcattcactacctggagagaggacataaaatcatatgtatagattaaaaagcagattcacaatactatcgtaaagaaaatgatgtgcaaaacattgctaaaaaaactctccaaatcataaaataatactagaccattgaacaatgtcgttctcatagaaaaacaaatgttataatctgtgatggttaatggtatgcaggtgacaaacggctaaaatagtgtgtttgtatcaatcctatgggttcattgactgttttctaaagatatgatttagtgactcatgtttcagtagtagttgcttgacagaaacaactgactggcattatcaggagtgtgagttgcaacctacttaacttgtctaaagaaacagcattactaatgagtgagaaacatatatttagaactgcatgcaccaattaatgttataaactaaactaggacagctgcaataattatatatacttttaaagtattgacacaaggaaacagcaaatatcactgcagagtgaatttgacttaaggaacaaaatcaacattaataaatcagtcagttctagtaatatcaagcaacggcaagaatcagtcccacaaagtagttagttgaaatgatcctcatggtcaccagcagagatcccatgaaagaaatgatgggctacaacctacaatcaagattcatgaaaaaatatgacaaatcctagagaaatggttctccaagtgtatatatgtgggtacatgcactgtcctgcccagttatagtgcttcaatatctgtgcaaaggtaacacgatagaatgaatggatagggaacatgggtggtttggtttgaattttgaagattttacaccaatctcaaggcatatgtttgactgcagtgatacatgcagaaaatacaataaccaactcgtacagtcaagaatctcatctataaaagtgtt

SEQ ID NO: 58007 - DNA, 803 bp, Oryza sativa
atttaagaatataagaaaatttttgttcatatatagatgcataagggttcagttttagataaaccttgtccatcttgccgagatccagcgcttcaaaattcttcaataccagatgtggaggtaagttgaatctgcaagacatcggaaattcagaatacatacttaagactgtaaagcccctgatgaaatgacagtatggaacgtggtaaagcatacagtaattgtgtacagagttgctagattaggacctgttcttgatgtcagcttccctgcgaccaagccttggagtgtcgacagtgagtgcaatcgccttaaaaccagccaattcagcccttctgacaagttgccgtactatattcctatccttgtaaacctagtaaagacagaggtaactcagctaaggtttagaaactgaaaacactgctcctcattacatcttaagtatttttgaagaaaaatatatacatagagttggaagaaacgtatccccggcgctgctgaattaacctcttcaacactagaagtggaccatgaagacaatgtctgaaaaaaaaaacataatgttgagccatagcatcagaacactgaattaatcattttgagaccaaaaaaaacataacaagcttttggatatctctcaaaccattattgttcctgcagcagaagctgctcttgcagtagcaagctctcctgcatgtcagataaacatctccatgagaaacattgctttgaaaaaaaaaataaagaggaaagaattaggtgaatgcaacttggataaaccttcggggtgggccattttctgc

SEQ ID NO: 58008 - DNA, 1066 bp, Oryza sativa
ccttgtttcagtttccatgcttattgttgttgcatgataatatttttggtacttgtttttccctaacatttatatgtgcagactggcaaactgagggaagaaactaaggaagacatttctattgcgaaggccattgcaattgttatggagagaaatccacacttgaggtttgtaccatccaatttctgcccatgtgcataggttatcctgatcttttggtcattttgcctgacctgtccttgttcacaacaggcaagaagggattgctcatgatgttcttcagtggtatttgtgccgcatggaaggttggtttgctactgatgcggacgcaatctctcttcagggttgggaccaggtaggactttggttcctgatatcagctacaattgccaatattttgctcatgatgtactcatgctagtttgattgctatgtctcatgttcgtactgtgctgtgggtgcaggaggtactgcttcctggtggccatggtctcatggttcgtggatatcgtccagtaataaatactctggcaaaaggcctagatatacgccttggccacaggtatgcatatccatttagtttttccttctcactttaaaagcaaaattcatggttccatccaccattccttattgctaatccacattattttcttttctttagggttgttgagattgttcgccacaggaatagggtggaggttactgtaagcagtggtaaaacatttgttgcggatgctgcagtcattgctgtccccttaggtgttcttaaagcaaacaccattaaatttgaacctaggctgccagagtggaaggaggaagcaataagagaactctcagttggagtcgagaacaaaataattctccacttcagcgaggttttctggcctaatgtggagttccttggagtagtttcatccaccacatatggctgcagctatttcctcaacctccacaaggctactggccatcctgttctagtttacatgcctgcgggtcggcttgcatgtgacattgaaaagctgtcagatgaggctgctgcccaatttgccttctctcagctgaa

SEQ ID NO: 58009 - DNA, 3461 bp, Oryza sativa
gaatagagcctgctggttgtagttgtgatacttggatttgatgattcagaattgaaaaccctggttgtgcatgattccctggttgagttcttccattgacattattggccccttctggtgcagtggttaaaggcacctaatcaagtaaacatatagaagtcaaataccgagatgtctcaggttactagacctaaagaagtaacaccttattaccgaaaatgtagtgtttgtcatgccaccaggcgtcgcaagacctagggagccaaggatatcccgaacactctgcagataacaggtgggaggaaatcacatcaataaacatataaaggttctggtccccatttagacaggtacatataacactagaacaaagcatataccctagccaggtcatctatcatcccctcagaatgcatagcctctataatttcctagaagagagttaatgaaaaagaattcaaagaaaattaaagttaacctgtagttgttgctaagagttaagcagattggaaattttaagtatacgagacaaagcgatgttagaagcataccctggagatatctcctaacagtccatttccagcaacattaactgcacgtaaaaagattatcagacccatacccagcatattgctgtaatatacctaaaatcaggtacagaggaaatacactctggtaccacaaaaggtagtgccagtcaatataacccaagttgatttgttatgctctatctatatattgtaataactagaaacacagtaatgcttacataaatacagttaaataatggtgtttttagttcacaaattaaatgaaaaataaagcgaaggactgttcaagccttcatctacttagcctgaaatgcttacctagctattttttacaataactagcaataactatttttctgcccttcaaagggcaataatattttatccagtatgagcttgacacaattaatatatagaacagacacatggaaacatggtattgaagagtgaaaacgcacataaattgtttacgatactacgaaaacttgtgcagcacatggctctgaggactaataggtcataggcatatcaggtgcgttctatattgatagtatactcttcaaagcaacccccaacttaacttaccattagcatgggtgttttcatcagaagtaccagaagaatgttggccttcagcagctgcacgccgagcaaccaaatgcaatgtgtacccatcttccaaatcttgaggttgtcaaagatataactatcacaactgtcgtgtttacaaacgaaatatcacaagaaaaccgaaaatgataaattacatcatgtggtgatgaaaatcgttgatccaaggaacccctcattaccaccaacgatgcagttaaatactggtgttcaaccacctcaacttaacaaatatcatcaaggtctacaatgatttgaggttcttgcccatatttgcaaagaattaatgcttagatacttcaatttgacattttactactttattttgtctcattggaaggccattatgaaatcactaccaaagcaagcagccctaatcccaacaaaagcatcaggcactctactcttctagcagtaacgaaatcacccttactggcccaaaagagttgtgtatcttcccggcctatttataactaagcaactaaagatgggaaacaaaatgcaggtaaatagtgtatatagctcaagttctcaacagcaacaagcgaggtgagtctctagatggtttgattgtcttcaagcattcaaaagaagaagcatgaacaaaaaggatacgatattctgatagcaggtgatcgtcctttaagactcttcctctaaaaatcaaccgctgttggtccacaggaaccccggttgcctctactatcttctctttaaggaccagaacaggtacctaaaaatttttcagtgattagattgtctcaaaacaagtacatgggagaattcatcttgtcgttctaactataaggaactgacattctatagcatttctagtatctctcaagcaagcaacactcaacagacacacagagacataatagcaaactgtcaaggtggggcgaagcatacattcttcttaacacggagcttatgaacttgtgaatccagggttttgatgttgatctcaatggtagcctctggatcatcgccagcttttactgttgaactgctggccccgacagacgcatcttcagacatcctacagaacgaggaactgaatagtatcagatgctgcataaaccacaagctacaaaattcgaaattatgattcctagacatgttcagaattcttcatagtcaactcactccacgcctaagattacacagccagttaaacccctgcatttaagcacaagatctcaacagagttccggcagcaacaagtagagcgccttccatctacgaagaaaccagtaccctcattcctagcttaacattagagaaaattccataattttaggttctaggactccatcaagcatttaaaagcagattacgggagaccctaatcgttctgtcctcttatcagaagacgctccgtaccgcaaataaaatttttagcagctcagaatggctaggaccgatcccttccaaaaggagaacttcgcaagcaattacagcctcaaaatcatatcccttccccccttagctctgaaatgcgtcgccattgtcctctccgccaagtcgcgtatgcccccaataggatgaggcttcaattcccgaataattaaaaaaaaaaaaagaagaaaaagaaaagcagaagatcgagccatacgtggaatccggagagggcccgagccgccgaggccacaagtagagagtcggctgcgccccgcgcgaggcgagctgagctggcggcggcgttggggtgggggactagggttgctgggagcggaggggttggcaagcggcggatgaaccgggcgagaggcggcggcgaccggatcgggggccgatgcggcggttgctcctgcccgatggggggcagcgaggatttttccgtggcgatttttctttttccttttttgcgctttattagggttgcgagttgtgtgagaagtgagaactgagaagaggagggcgccgcagtgaaagaagaagaagaagaagaagaagagggggaggaggtgaggagggagggggcagtggggcacatgtccgggctgttccggaaagttccacggcggtttcgttcttggggatgctttgccttgcttatcactcgatccaataggagcagccaaatgccactcacgggagaaggctcaaaggctgattataattactttgttttttgtttaatgaaaaaaaccttaaaattagctccaaatttaaagttacgaatttatattttggttgataagtattagcataagcgaaaagataaggcctttcaaatttttttacatgcatcatttgttttatagaaatagatcacat

SEQ ID NO: 58010 - DNA, 4106 bp, Oryza sativa
tcgttagtatttttatgattaaaaaatttcatttggaaatagaaaaacttcatataagaaatttttgaacatggatacaaactttaactataaataaaacttcaacggaaaaacttccaatacgaaatattgagcatgagaaagttttgctataatttgagaaaccttttattttttagaaaacttcccattgtgttcagtgagctaatcttatgacttatgagacctatggagcggttggttatcctatgtgaagccacataacgagtgattatgcagaaggcaaaagaaaagccatgctgagttattacattaatatttctaggtaaaaattacacacataattatatcatatcgatctcacgtaaagggagaagttgtatcaggaaaattggttgtttaaccgatgatgatgaataatattaatgcgaaggttaaccttggcattcgttaccgtaagagactaatacaattagttggaggtaaggaaaggaataggatgtagctagagaaaattatagcttttagtccattacttttaagtaaatcaccactaaaatattagaatttttaattgtccagacatggtccaccttggtgggtctaatgcgcgaacgcgcgctagcatcgaacctagcgaacagaaaacgacaaaaagaaaaatagagccgcgcaaaaaaaattgttttcctgtttctcgttttcctttcacgcgatggtaaaagataatcttttcctttttatcgtttttctgttaggaggtttgatcagattggattatactttttttttgaaaaatatattagtatttttaggctgtgtttagttcacaccaaaattaaaagtttggttgaaattgaaacgatgtaacgaaaaagttgaaagtttgtgtatgtaggaaagttttgatatcatagaaaagttggaagtttaaagaattattttggaactaaaaacggcattagttttatatttctagtaaaatttatgcactaaactttttaattatagatttaatttgtatataaagtttgcatatacaaagtctacatatacaaagtttatatattcaaagtccatatatataaagtttacatatatgaagtctcactttatatagaaaagtttccccagaaattgtttgtatagaaaatttccgttaagaatatataaaaaatactatgtataacgaaaaaagaaatatgagaaataaacagaagtgaaggaaagaaatagaaatacctattacagaagaatcacgtaaaagatgcaacggattacataagagaatcacgtaaaagaagggaaaaaatgaaaacggaagaaaatgatgtgtcctcatgtttggcgtgtcccttctgactgattcgccggacacgaaacgttcgttttcgctccaccttcatcttctaataaccaaaaagcctgcattattcggtttgtcacccttcccatttccttcataccagtgatatgttcataccagtacttaccaattttagcgatcttgggcccagcccaccaacaaaagtacttatgatggcccagcagtagcctttttaggcccacacggcgatcgactcgcgtcttcgcctcactccgccgccacgtcaccggatcccccacgcctcgcttcccccaccgcgtatgccgccgccggcgaggagcccggccgccggcgtgcggaggcgaggcgcgctcctccccctcgctttcctcctcctcctcctcctcctgctgctgcacctgacctcctcgcctgcccgctcccccaactccccgctgctccgcggctccggcgacggggagccccggcagcgcgggccctgcgactacgcgtccggcgagtgggttcccgacgacgacgatcccgcggtgtccggcggcctgaggtacgaccagacgtgcagggagatcttcaaggggtggaactgcctcgccaacgggaagcgcaacggccgggagctgctccgatggcggtggaggccacgcgggtgcgagctccccaggctcgacccgctccgtttcctggagtgccacaggaacaccagcattggtccgtgctcgttcccatttcgtgtgttttttaccactgcagcttgttctatggtgactagaatagtagaacttgaggagggagttatgtgcaaggtaaatgtggcgctgcaatttacaagctagatgcagttcattctgtagcgaggatcatttgacattgccaatgaaggcatctttgtggagtgtagcaacgtgcattgtgcgtgccgcttttagcttggaaagatcagcatggaaggaacgtggtttccacctgattaatttgcaattcaaggtagtatattttgccatgcgtgaattgtatgtcaaatatatagaagacgtgtaaatttttacctgcaatcttgtagtttgattatgtggcggagcatgttcagttgttgaggctctcatacatgtaaagaatcttagttggacaagaagtctcgacttgctgttcatgatttatgtttaatggtttgttgcaggatttgtgggtgattcattgaaccggaatatgtttgtctcgttggtctgcatgcttaggggggcgagtggggaggttcgcaagtggcgtcctgcaggagcagaccggggtttcacattcctgcgctataacctcaccctcgcatcccacaggactaatcttttggtacgctatggtaggtaagaagtgtcatttgagtaataccaaattatagttctttggaagtatggtgtactccacatcatgcaattcccttttgtgttacaactgatttaattatataagtacaattctgtgcccagtagtacatatttttgttctgcagctttgggcatttgctatttggctttcagttttggactgtagctgttacttactagtagtattggaatgcttaccagtagccagtagtaaacttttctctggtctgttgacaacggttggtcttaatattttcattaatttttaaatatagtagactctgccgctttcttaatgtttttcactgcgtcatagtttttctttcatgaggttgtggctcatatattgctgaggttattactcaaacccgtataatgctgatgttgtaggtggtcagccagtccaaatgggggtcccctagaatttcttggatccaagcaaggctacagagtagacgttgatattcctgaccaaacatgggcagaggcaccaagcttccatgatgttcttattttcaacacagggcattggtatgtgaacatcaatcataagccagataacatttttttcacttagatgcccaattaagtagatcctgatccatgaatgttatttcatgtttgaaaactttgagtaaccagttaacagcagaaatttattacgttaatcttccttgtactgtagttccaatatttgccttctccctcaaacctcggatatctaactagatattatccaccaatcaagatttgtgttgctattgatctagcttattaactaatttttgccaggacatatagtaatttggaaatacgcctacctttaacaaacactttccaagtatgagaaattaagtctggaagcttctcttggatatgattggccaatgtttttgcaataatttttgtaagaaatgttacgaagacttgtaggtctataatcagcaggagtggcaggactggatattttttggaattaaaacaatgttggtagcgtccatacctttttgcaaatttaactgcattgtagaactcctgtaccattttggtgacatcattctcaatccattgccaagctgctctataaaacgccacatttagcccatctagtcctggagatgcatctcttcgcatttgtttgaggatctgaaaattttgctcctctgttggaacttccggtggctcaaaagtgtgttgcccttgctgatcttgagaggatgtgactccttaatctgtgtttgaagtctggaaaagatctaaataagagataaatgttgagcaatttcgtcaggatcagttgttagatgattattatgcatgacaattggtatcctgtttttccttccccttttttgagctgcttgctgaaagaaagctgtgtt

SEQ ID NO: 58011 - DNA, 4164 bp, Oryza sativa
taacaaataacttaaaacaagtgatttaagtaactttgatgcagaaagtttctagagaaatcatactattaaaagcatggtacgaataattcgcaaataatcctggccccatcaaccaaaaagaaaggggcccaacattggatgagctgacatgctggaatgcaacgaaattcaatctttgtaaataatctgtaataaatatcttaatatttattaaaacagggaatgtttgatatctagcaaaataacaagccagcaattgtttcaacatggcattatgtggcatgtgggatgtgcccggcttcccctttttctctgaaatcttgcttttgtgataagccagcaagcagtgtgtgggctatgtatatatatacatgggaaattgagatgtgtttatgtctctatcaaatggttactgttcggccatgagagcaaaaaagcatgggcaagtgcccacactttggcgacacaaacagtgactgcacactggcactttgctgggtaaagaattaacagcatacttagtttggtacatgtaaagattcttagaacaatatgccagtttgaaccaaaaaaaaggccctcaggaatatcatgctttaagtagctagtaacagaaaattgactataacaaatcaacaagatttactcttttctatcttttggggacaaggtttgttgtattgaggtgacaaaaaaggagaaaattaccggaggaattagtttgtgcttttctctgaataatcacgcacattgacagtcatttagaaagtagtcggaattattgccatagctggtcttgatgattgatctgtcacctcattctgaagtttacatgtttgccgaattgacacttgcctagattcaagatccgacaaggaggtcttgccgatcaacaagaggatgctgaacaatgacattaggctggcaatatctgaaaattcagagttcacaagcaaaaaacgctgtaaactatgatcgaaacaagcaggtaatgccgacgttgtgacgcgtatcgtcatctgatccttgaacaaacttcatcagaaatattcttccagggccaaaccagacaatgacaactcttgatcaaagtaaaataggttgaaaccttcattcatatccattgttcttggtcagatggaaacatagaatcaagtgtacaccgaacaaagaagatgcagcgtaagtagcaaaagaggacagaagtagcaacatcagatcagcctgttgcgtgatttggatcgataaacaatgccaatcgctgctcctttgtaagcttaattgcgacttttgctgtatgaactgctcgattcagagttaaaattaggtcatgtcattatattttaagatctcactgatgaagagattaagcgtaacatgtagtcgagttttccttgttggctttgtcgtttgtattaacttcatgcacaaagatataagaattttgcactcggattaccgacgccgcgtacaacaaatgcgttttcacatgattgatgctgaatgttttcagacgaggacttcactgaattactgcaaaaattacaagttttggtatgaatgttggactacagaattgcgaaaactgcagatgctaccacctgaaattcgtacagaatataataaaatgctgcgaagtcagacaaggaaacctggagtagtaaaagaactgaacaaacatttcgtttctcaccttgataacgtgttttacaactctcacaagttccattcttcggaagtaaatcacattaatcaggtgtctgaatgttgtttatacaaaaaaatatgctcacatttgaatgctttagtttaaacagaattgccagcgagcaaaacactgagttgaccagtatgataacattttagccttgaccactgaagatatatgcaagagcttctttagaaatccatatttgcaagagcatcttcagaaatccttttgatgtggccatcgtcagaattcttttccaagaacacatcttcagaactctgactagactcatatataagtactacttttacaaaaggcaaagtcagatttgagaagtgggagcaaaaaaaccacggataaaaacacggcgcacggcgatggcaatgcgctttttcagctggaatttgtctgttccagcgtcgtctcatgcagaactgcggagaattcaaaccaagatgtttataaactccacatttgtacacactgctcctgtcctgacaatcagagaggcagcaaagtcatgggattagattagaatcattagatattgttgagattagaatcattagatgttgttgggcgaggcattcaagtcagtccaggcaggtaggacgacaccactgaaagaaatgcaggtgcagccatggggttcaactgactgaaacaccgcaagagacaaggacatcagaggacagatgggactgtgagtctgtgacattcagtgtgagctcgagaaagtcagtgtgagtttatttttttctgctcccgtttgtccaaaattttaagtaatcattgtatcaaagtttgtcaaagtagagaatatcggagtagataatgcagggaatagttgtattacaatttgataaagtgagattattctattctttctcattttgtattggtatatgtaggatggcttaaaaatgaacttatttgtgacaaagtgagtacttaagtgagcactgtttgtttggaggacaagcaggtcacaggaactgccatcaattagtagacgatcgatgaatagtgtttgattttgttttactaatactaatatgccagttttgtgaggggcaggattgggtgatgcatgtatagcgaggtggtcaggttagcctgggatgctgagaaactgcaacgtaacgttgcattcagtagcggtcaatgtcagctggcagctgctcgtttggtttggtcaggaaccaatgcgaacgccgtctgtcgcgtaaacataagtgaaatatgtcaacggcttggcttggcttggggtggtcctgtagagtcacgggctggcattcatccatgcgtgtcaggaactcagtggtcagtaggagtagtaactcggtgcagttgctgggtgcaggtgagtcaaaccggcggtgggtcagcgtaacagcagcagcctcattgtttgttggatcggcccgcgctgccggccgtggtttcggttactgttcgcgtcaccgggcaccgcacactatagcagctagtcacgcacgcacacgctttttcccacctccttttcggcgtcggccggccgctctttgcctcttttccccggacaagccacggccccgttgccacacgcggcgcggcgcggccaccgcgccacgacccctcggcgctcgctgcgactgcgaggcgaggctgcagcgagtagcgacgcgcggtggcggcagcaagcaaattggcaaatgcgcgtgcgggtgggcgccgggctcgccaggacgggacatcatacggcggagtcgcggtcgatcggtcacgtgggtcgatcggccgtcgcgtcgcgtctcgatcggcgacgacctttttgactcggaggggaaggggacatgctggccaaaccagctacagtggctagctgcgctaatgctggtcttgggcttggcagcctggctgctaggggtacgtgcagatcacaggctcaacagtgacgactcaggggtgttcagtttaaggggctgtaaagttttgacgtgtcatatagggtatcgtatatggtgttcggatactaataaaagaaaactaattacagaattcgtcagtaaaccgcgagatgaatttattaagcctaattaatccatcattagctaatgtttactgtatcaccgcattgttaaatcatgtagcaattaggcttaaaagattcgtctcgtaaattagtcgcaatctgtgtaattaattattttattaacctatatttaatacttcatgcaggtgtttaaacgttcgatataatttttgtgtgtgaactaaacaggcctcagttacttcctactacagtactactagtactagagcaagtgtcaagtaccctacgtggtgtcatggtgtgactagagacatgagcagcaattccgtttgtagcgtggtactagacattagcatgccggctacagtagctgttttgcacgctgcagcatggcacgcggcagtgtacagtaccc

SEQ ID NO: 58012 - DNA, 820 bp, Oryza sativa
agaatgtatcttgtccaattataggttactcccttcttctcaaattgatcatcatataagggcaagtactataataccccatatgttgtccctaagagtgccatattaattgagtgatgaggtggaggagagaagtgagaagagagataatgagccacccctaaatcaagatacaacctccacacaaattttaaaaaggatgtgagagtattagagatattggtatttgtgtactagaggtgatacattgtatgggttgactcttagtttatgagtgaataaaatatataaaattagaggtggtaggcacctctagcatagcacttgccctaagtttatgcaccaagactaaggataatttaaatcacatcaaacaagacaccatgcacatattctcccacaatgtatgcatccattaaaaccccatgccaattacaccatagcatgcacacattctcccatactgcattaattgtattctgatgaaatccatatcatgcagttatatgatgatcaatttgagaaattttggattttattacatgatgatcaatttgggaaggagggagtatacaactgtggagtacatcggaatccggtgttttgtgcgaacacaggattccaaattaggtgctcttgctgctgtccacaaaggtttgcaaatggatataagagcaggtataacggatgagagagaagagtagcggggatacagaggaaagagaagagtagcggacaacacggactccaagatacaatttgtgtatgacagatgaactaaatattaatagtgtaatatatgtttataggtaactattat

SEQ ID NO: 58013 - DNA, 962 bp, Oryza sativa
agtgggcggtggatctcaaccacaagcctctgtaggtggtgttgctagcattccttctatagtggcacaggtaactgcacaagtagccaatgcattgagtgcaaatcaacaaggccaggtttcatcatctgcgcagaacacagtagatcagggatctcgctcggtcacaactaatggagttgacaatgtggattctctggtatcagcaagtacgcaactgcaaaatgagctgtcagattctaacaatggacgcacttcactaaatgcacaatctcttgtagctggagcaggtgcctttacattctttttaatgtatcgaacattttctctaatggaaaatgtactgaattgttcaccattcctgtttgttttaatttctctaatcaggtatttctccttcaaacacatctgatcccaatttagcatcggaagacagcagcactgaaaatgctcccaacatcggcagtattcaacaacatccagagatggaagggatccatgcagataatgtcagaaaaccttctgaggaatcaacaacagccaacttagtggggcagatcacaaccacctgtacagatgatatttctgtgaacagatcagcagaaaattcttcacagaagaacattccattggatggagtatctgcacagtccattaagccatctgcaagtagtaggtctgaaccagtaggtcttggtggaggtttgcagcctaaggtattagttaattattttagtgtttactttttagtaataatgtttcctgtaatttgattgtttagcctgcattttgttatccatatcttagcggggttagaatttgccatggttggcagcagtttagttgattggtttaatcacttcaccatttggtctgaatgaaaatggcagacattttactgttgagaaaacgtagtatgccattcatacatgattatttgtcccaaatatgatatgatcccc

SEQ ID NO: 58014 - DNA, 2794 bp, Oryza sativa
aaaattgtgatgattactaatacaccatatctggacaaatgttcattctaaagggttgagaatgtcatatgcaagactgacaaatggaaaacaatatcttttttttttaactttttgataattcataaactaccatcctgctttttcatgcacagattgatctacacaagctcgtgaacacattgagcaacatgactcccccagggatatcttcggtgcggtcctcgaaactgctgcacaggcttatggtgaagatgagagtattgaggacatgcttgaagagcttgtcagtgacccagaacttacagatgtatgtttccaaaatccccccatccaaatttagaataagctctaatgattttcataggatgccatatagttgataccgtagggtgagattgtttagaaacatacattaggagattatgttatactaatatgtatacatatataaaaaggcaagagatcattttgtggtaaaataagtggtatatgcttcttatatgatcttttgtcaaaataaataaaaaatctgataggattttgcagtaccttgtttgcctttttttttctttttagaaaactttgtttgccttctgattaaccctaaactgctgcaaatatatgctaggactacctgaaacttctgctccaacaagttcgccagaggatacagtcggcatctcaatccgggaaccagtcttgagcaatcatggcaaagaaggtgatccagatatagaggtgattgcataggcaaggtggttgaaccatgcaggtattcactgcagagtttatattttataagttgaaaatggacagaacccagtgtttggtttggtggtcatgattaggcgcctccgtggatgtacatgtgccgtgttctctaattttggcctcagagatgatgtttacaccacccactgcacttgctttaaatgttttacagattttgttagtggtacatagctatcatcaagagctttagatttcgtggaatttatgtggtttgctgatctgtcggtaatttaaaatcgtttgtcgaggtggtgttttttgtttgtcatcttgggaatcatgccaggttgccttgcaaattcaggttttggaaatgggcaagaggacaggctatataggccgtccacagggttgtgcttcacttacactttgatacgctagataaaaggactcctggagcttgaggtaatacgctaaagcaaaggtcgctgccctcatgcgaataccagctacaggcacaaaggcaatgggcagtgaaatgagcacacaaaactctgctcatgagataagtggggcgatgccacagacattgcactacagcgagcaaaagggcctggttacgggagtatagtgagtttcgtgatgggcaaagagtacgatcgccaacaaacagcccagctctgtaacgatcgtagcccgtaacgtttacaccgcgtgtcaacaaacccatgttgcctcatgggccaacgcggatgcttagctactttagaactgtaaactgttggggatgcattggagtgggcaccaggtgttgtagagcaagtttaagggcatatgttcaggggagcttttagctgctgcagtttcttccagaattagaagctcctccaaacagttcagcttttggtccagattctgagaagttgtagaatccagaaaatgaactagaagccaaaagctaggaaaccaagcttttccaaattctcagaagctggctactaatcaactgcttcttataattttaagcttgagaatacgactaaggcaaagagccaggatcacttggttaaagcatggagacgttaactctaaattcttccaaatcaaagcaaatggtagaaagagaaaaaatcacatacagatccttcaaactccagatggctttgctgtaactaaagatcaaaaggaggaagaattgaagcgttacttcacacaaaaattaggagcctttgctctcagaaatcagagattaaacttggctgctctcaatctccctacgcttgatctctcagatctcgatgataacttcactgaagaagaactcaaaaatacaatctctgacttgcctttggaaaaatctcctggaccagatggatttattggagcctttttcaaacaagcatgggacataataaaaacagatctcattcaagctatttccttctttggagatatgggatgtgcaagactgcaagaactcaattcggcacatatctgcctcatccctaaaaaggcggatgcaacaaaagcggaggatttccggccaataagtctaatgcatagttttgcaaaaatagtagctaaattactagcaaacagacttacaccaaaattagatgagctagtttctcaaagtcaaagtgcattcattaggaaaagagcaatgcatgacaatgtcctgtttgtgcagaacatgatcaaatcgtttcacaggaaaaaaaagcctactcttttcctcaaagttgacatatcgaaggctttcgacacagttaattgggcatacttgctagaggtccttcaaatctttggctttggacataaatggtgcaactggatttccaacctactgggtactttctcttctgcggttcttcttaatggtatcccaggtcaggaaatagaccatgctagaggtcttcagcagggcgatcccctttcccccatgcttttcatccttgcaatggaaccccggcacaaattattcaagaaagcagaggatcttggccttctctctagtctgcaaagacagcggcgcttcagatgttctctctacgcagat

SEQ ID NO: 58015 - DNA, 1724 bp, Oryza sativa
tttctattgaaaagccatttgtatttttctaataaatagtgaaaagtgaccggttttaaagcttatgttgtattttagactccaatgaaagtatagatatacaacaatggacttctatactatctataaatttgcaaaaaaaatcctataaagatccagtgaattttatgtattccaatgcaggccttattatactatactcctagctccaggggagcagccaaggagaaaacaatgagaccatcttaatttacatatacaatcgtcttaatataaggcagaaaaagaaacatcgatgatcagatgagccgcatacaactttgacataaataaatattttttcttaaagaagcacagcacttgcccatgtatagggaaacaaaacacaggcggcgcatgaaaaagttgggggtcggatttgattaattcgacaaggaattcttctggatcttgactagaaagtagtttgttgacttgcttatcactacgaaaagacgatttagtcttgttcgagcagtgttcctctgcctagctagagaacaaattaaaaatatcaaaattgattccagattctgctccggctttttaagtacacctagctagctgcgaacaaagcagcccaattagaggcgaaaaaaggtccttgcatgctggctaaacactctacagttgcagatgagcaaatcatcttccaaacatccgttcatcatatctagttatgaactatcgacgacaaagttaccatgatcactgagaaaatgttttttttctccctaaaagctatagacaaaacatggattataatcaggtctagatctaactagtacaattttttaaacaaaaggataattaacttccgatctactccctccatcaaaaaaaacctaaccatccatttcctagtataatgaatctggataatctttaggttgatatttgtcggtacagagggagtaattaagaatactacgtgtacactgaaatttaaaatttaatgagcggagtacatagatagttagatatgtacatccgacatgtattgggcaaatcgtttggtagaatacaaatgagaccgtacaacaaaaacccgtggtttacttacttttggcacatgtacgtgtgttcggtacctacaaggccaacgaggataggaaatcgaccgacaaaaccgtggattttaattgcaaaggctcgctaccgtccgtgagcgccaccggacattcggcgccgccataaattcgaatcccggtatgcaaactcaaaccgatatcctactacgatttcatttcacgcagttttttttttcaagtttcaaaatccatttggctccaaatactacagctactagcgatttctcgatctggtaccacttgctactgtacgtcttgcaacaatgtggggttcgtttcattcaagcgtacgacgacgtggcctgtcagatcagctggttgaaggggcttgaagtagtagagtacgagtgagtacgacgcagttgttgcctgaaaagttgaaatactatttctgctcttctacgaaacgtgcagtgccggtagttgcatgatgtctacgtgcttaattggagtattaaaagttgttgctgctgctgctgctgttgcttgttgctttgctgtccctccgtgtattctgttcttggaggaaacgacggatcgatcgatctgcggagattaattaacgacgatcagtacagcgagagattaactaag

SEQ ID NO: 58016 - DNA, 6233 bp, Oryza sativa
caggtacaatagcaggcagctgcaaacatattttaagcagataaatgagaagagagaatgacagcgggctacagatctgtagccagctgtaacacggactccaagacgcagtgtgtgtatgacaggtgggaccagatattaataatgtagtatgtaactatcgtatgaatgagctattagattgactatagatgaattggagccaatagtgagctatactattaaacttgctctaagatagggtactactgcttcctcgaaagaaaaaaaaaagggtgtagatcgatcacttttgttgtgtgcgcgcgccgtcgtcgtcgtcgaaacagttgtttgttgttgttgggctcaagaacagaacaaagtagtccgggtgacttgtggtgaagctgattttatgaccagactcgatgtgtgtttctgtagcaaaacggtttggtgaggttccagtttgagaaaattccctatatacccctgaaaatttactcaatcccttcaatacccctgaatttgacattatcccttatatacccatgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccaaaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataatctttttttattttaatgaaataatgttttattttcaaaaattcataacaaatatttagtaatttattccttattggttttcacaactcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggccctttcagttttcagttcagagtcggccggtccggcgtcagacaccgagcaatgcggcgttcttctccagatgcttaaagatatgtggttccagtatttctgggtttcattttggttagccttgactcttgactcgtgtgtttgacaagttcatcttctgaccagattaatatactcgtaagagagagaaagggggaagcgccacttttatttgaggtgatcttgaataatgttgctagggggtctgatttcatcaatctgccgttgtgtggtggcactattctatttattttttaaatgttagtacgtatttgctgctctaatgttagatacttactggtatattgtattggcgttattgagtcaatgggtttttactattgtttctaagcagatttacttttgaaaaaaaatcgccaataaagaatattatggaagaatgaattatcttttatttactgccagccattctctcaacataaaaccaccatggcttgatgttggctttctcttcttgagtattgttccatgtctctttgagttcgagcataactctttattcagctggtattttcagattttgtattgccatccatgccgtcaagctttaataatttggaaataagtagatgcacggtatttataatttgccaagtaaaaatgaacaatagatttctcttaaaaacatatttctaggacattgtaatgaaaaaaaattatgagaccacataattaaaatagttataaaccattataacatataaattcaatccctaataccctacagatattacacacttaatatgagtttttttagtgagactaaaaatttatcgttggtcacaccctgtcgtgggttttcccataaggttcttataataacctattataatttaccataaccattaaactattcatattatctatactatccattcgttttattatagtcttaactagttcgaccctataacacatccatcctgaaatcttttttacttccatccttaatatccttgtcgaaggctaaaatcattaccccatctatttcatatgaaaccggggagtatattttaaaacgaaggaagcagcgtaatcttagattgagttattttcagcaactcaaaacaacaaatttctcatttatggttagcacgtttatcaatgatgtattttgtgtaaaagaatatgtattttttaataaataaataaacatattttttcaacttttaatagttgttttagaacaaacttataatagttaatattaaatttatgctaacggttattcttgttttacgtgtctcggaaaagcaagccagtatgtttactcaccctaaagtgatacggtcaaaggtacgaacaggacacggtgtccacgccttaaacaagcattaaagaaactgatgacgacggttaattgtataatttcaccgcgcctaattaaagaaacagcaaggcagcaacgcctatccgatttttattactcgcgccacgccagctttgggtagcaggaagaacccaaggatagatacttcggctggcgtcaacgtgtaacgtatgtgcagtgcaaacgagatcctgacacgcatggataacgcccctgactgacgaccgggccacagacagcgggccctttttaccctctctggctgtagtcggaagaaagcaacgtctcgggtggttgccgtgtgcgcccgacgcagcagcagatgcaaacgcagcctttgtactttcgggaatacccatgagtgactcaacccccccaatcccccccagaacaccaaacctcgtaaactacttgaaaaaaagaaaaaaaaaacagaagacggtaaagccgccaccacgggtgccacggcttttgatacgagagccacacgccgagaccgagacgacgccgttggaacggaacgcaacgtgcggagagagagcgagagagaagcacatggcacgacgacgccgcgcgccccggcaccggagagaatcgaaccgaccagccaaccaaccgcccgcggcaggatcgcgctcattcgcccgtgagatcggcccgaaaccacgtaaaacccccccaccccccaccacctcgcgccgcaaccgtgcccaacggcacaagcgcagttacgccgcgcgtgatgcgcctcccaccaccaccaccagcgcgcgtctccgcctaaacatagctatctccactcctacttcccggtctcgagctacaccaaacacaacgggtcatttccctccattttgatccgggagaatagcaaagcaaggggcgggggtggggattgtctatatttaccgcacacgcgtcgttggcgaggcgggggggtagctgctacctttgggagttgggtggcgccatggcaacatcttcggtggccgccatgccgcacgactccacgccatggagggacccctccagggcatcctccaggcagcccgccagggggttcttcaacatcctcgtcccgccgccgcagtcgccgcgcccgcgctgccccgaccaccaacaccaccaccaccaccaccaccaccacgatgctgctggtggcgcggcggcggcggcggcggcggcggcggcggagcccacgccgaggcggcggaagcagatactggatcggtgggcggcggcggcggcggccgcgtccgccacggcgtccgccgaggcccccgcgccgcaggagcagaggcggagggcgagggacgccgagctgtccgcgctcgcgtcggccacccgccccgtgaccgcccgcgccgccgtgttccgggagccgtccccagcgccgtcggacgcgtcgtcgggggcgggggcggggtgcgggggcggggccgggtgcggcgcggagctcccgcccgcggcgccgcgcgcgtcgtcgctgatccagcggtggcgggagatcgaggcggtggggcccgccacgccgcggccctgcgacctggcctccgactccgacggcggctcgccgcggggccgcgtggggtgcatcgtcaagaagctcagcggcacgtcgtcgatccccgacgacgagctggacgccgccaacaaggaggtcgcgatgtcgcagtccgcgcccccgtcgcccgcgccgatgcgcgccggggtggagccgcccaccaacatcgccggtatcaacgggtccaggccgacgcagctggtagtccgcacggtgcgtggccgccgcgcaatggaggagctcgtcgccatgatggcccattgccggaggtgcgagctcgccgcggtcgccgaccgccacgtcgtgtcgcggttctcgcacaaaggcaggatccaggtgaactccccattctctcatgcggctctcttttttttttttaggaaaaaaaaagaaggaaaaaccatatttgcaaaacgcaatggatatttggatcaaattacaagtaatcatggatcaaagtacttgtttgtcgattaaccaagtgggatattgttctgtttcttgatcgagaaatcattattttaagacgagccaagaagttagaagtgtgagttgttgattttgaccccgtagtcccccaaggatggggccatatggctgtttggtagatcatgttcccaactggcactgctgatcattgtcatgtgcaaatcacattatcatgtttcgttttgcaggttcgttaatatgctaggataaaccaaaatgtgataaaaaatgagctaaacttaggacttgattatcgcaaatagtgatatgctaatagccattgttgactggttcaatatgtagtagaacagcaacgaaagctctactagaagatccaagaatattttgggagctctattgctatacacgcaatgtccagtgtagcagagagggtaaatctagtggacgagatgtcacaagtgaataacatctctcgtttgtcttgtttgtttgctggcacgtccggaatctgacgtcctgtggagcttgtggatgctgcagagttgtggctaagaggccacacgaaacatatcacgtgactagacaggttgcttgcttgctatagtgtgcacttgttgcacataaatatgattaatggcagagcagtttgttaattggaagtacaacgcaaatttcaactgtttattaatggcaattgccttttaggttggatttttatgctacggtaccagcattacttgcaacatttttggatattcttcactccaactccagcgaatattaatgtgcatgtttcctaggaaagctgaactttttcctggagaatacattgccggtgtgtagctcaagtatgggctgtgtttggaagcaacaaatttgttttggccacaaatattaagcaagaatctcgattacttgatgcccttttttgcatatccaaggcataaattgtgtttttgttcttttctctgtgaacaagattattccttcctcttgtcaaagattggtaaatacaatagagattcaccttttatatggtacagccatcattgttttggctgctaagtgccaacacacatgcacaaaagtatgtattctctggtttatttcattagattgtatctatgcgaacacaagtactttttaagcttgtttgttccttatgtggcttccgctaatattgtcatgctctttgacaccttgcagtccatgcttcgtcttaggctgttgcgtcagggatttaaagttaaggatgaagtttggactctaccaaaaccagtcaggccacgccttccaaaacatgagcatgaggcctataccacaaggtattaatatgctctttggtaactaaaccatcatcttgtactagtggatgtgaaaatataacattacatgtgttcttttccactactttcatgtctgtcattcctagtccttttcagcttgtagtaagtttagaatattttttccctgaaaagaaacataagttcagaatgttttactacttccctttttt

SEQ ID NO: 58017 - DNA, 8786 bp, Oryza sativa
  unsure (1)..(8786): unsure at all n locations
catgattgatgattttgaaggatattatgatgagcgcttatactggagacagaatgatgaacaacagaatgctgatcagagggtatctgcacagtgttcattagcacctgtctcccatctccaccaacaagaaggctggcagcattcttcgtttgaacatcaacatcatgaaaaccaaaacttccttgtaagtcttgtgctcttcaagtcagttcgtgtgcaagtcatattctcactatatttctgtgttacaggaaatggaggtcagggttagaagtgaaatggcacaggtccatcatgaaatatatgaactacggaagttggtggaaagttgtattgcatcccaagtaaagatccagcactccattaaagaggagatgtgcagtgcacttcgcgaagcaggtgagttgtgatggaagttttataaatttgtcattcctatctacaaaccgcaacaaccaaaatgttgtccagactccagaatatgcatgaaacggaagagcctcattttcatattctaatatggaatctacgaccctataacgcaatccctagccttttcagaactgaggcttcctatagaagattgcactgaagacaaaatgaactgtgagggcaagtgagctagtaggttgcctttaatggacagtcaaatgagatctggagaaaaagaacacagttggttatggagtgactattggaaatagttactctagtcttggaacttgaaagcaaaactatgcgccatctttttgctcaaatctgggcctgaccaactctctaaactaatactatataattgttatttgttaggctttctgtggcacctttaggctgctttatggaattgacagatttttgcggtgtgccatgctgttgttttttttaaaaaagattaaaataccatgtgaactttggtgtgttctttttcactactgccactttgcaccttattgagtgcttaattttacctcatctgtaatcattgatgcacactttttacacttcaacatccattttttttctgatgccattattttcaacagggttgatgccaagccaacccgacacaccagcaaaaaggggaagctgctgcatctgccatcagacgcaagttgactctctactttacaggtaatgatttgcatggctagattatgttctttgactcacttcacatcttatgtctcacaatttaacaagaaacgatgatacggctcgcaatcttgctaagtgtgttatcatctttcattcaggtgtggacatatgtgcacctgtttcaattgcgccgatcagctgaaatcgagcaacaggagttgcccaatctgccaatctcctattgaggatgttgttcgagcgcatatgaatttttgaggtttaggtcttaggaggaagaagagctgccactctatagctttagatgtggagtttgtgaagccctggttttgaggaggcttcttgaatcaccttcattaacaaccaaaagtatacgagctagcgtttcttgagaaatgtaaatatgttttgtgcaagcgcaatgtgtactaagtactgacagaaaggaacaaacgaaatatctaatccaaatgctgatcttgtttctgatcatttttcttgctttcctttgtttcttttaagttctgtattgaacatgtttgtagccttcagttctgataatgggcttgtcttgttttctgttgataactggtgaaagcaaagttgctacatttggagagtggcacgaggaaaacaaagtaatatttaatattcaaaatggagaacaaatcaaaaacattccaggtttagactaccaaactagtatgtatgagcgtgcaatttgctggccaatttgttaaacaaatcaatcacactagttaaatgttagcacgtagactgctttgcagctcacgctcacgggaataatttgtttatgattaaataaatcaaaatgaaagctacctctctcagaacggaagttcttctgtgaaactaataaacatgcaaatctgagaacaaattacagtaaattatctataaattcaacataattaatcttggtaaaccgattactaactgcagaatatatatattttctgaggtaacagcacgctcctgtgacgtgctctgagattaacttcaagtatgcggtgaagtcctcctaacgctcgccggcgaggacgcttacgacggccggcgtcgatgtcggcgatgaccctgacgtcacatagaatctcacatggcgccccgagatgcggtctggcccgtccgtcgacatcttccccaccgacggccgcgccgccgccgccgccgcgcggcgcacgcccttcttgagcacgctctttcttatgccgtcgctgtcgaacatgaacgcggcgtgcaccggcaggtctgcctcgtcgtcgccgtcgcatcccaggatgagctccagcggcaggtcgaagtacgacgagccggcctcgccgtcgagggcgaggccggagcgggacgacgttgagcacgagccgcagtcgaaccgctcgagcgacatggccagcgacatggtgctcgcccgcgccgtgcctgggtcggactccacgccgccgccgccgccgccgccacggaacgttgccggtgacgacggcaacgacgatgcgcgcgccgcggcggtgggtggtgaaggcttggccgtcctcctggtgccgagccctgggaggtagaggcagcacgtgaacggcgccgccccgccgccgcgtttccacttgcggcggccgctcttgccgcgcgcgtccgcggcggcgtagcccgtcgagtcctcggcgccgtcgcccgcaccgatgagaggcacgtcgctgccccaccgctgcggcgcgctcgccttccgctccgaggacgacaggatcacatcgaactcgtcgtcgtccagctccgcctccgcggcgccggcgcaggacctgctcctcgagatcgccgtcctgggcggcgccatcacgtccgacgacgcgacgcgcgcagcaggcgcggccgccacgaccgccaggtgcgcgtcccacctggtgggaggcgcgtcccaggcagacacccgccgcggcgacgtcggcacgctggcgctggcgccggcgagtaccagagccgggcccgggcgcgcgtgcggcgcgtggtggtggtggtggtcgacggagacggaagggatgggcagtggcccgtcgatgtcgaggcgggagaactgccggagcgagaaagggtcgacggcgatctgcctctcctcgggctcctcctcctcgccggcgttggtcacttggaatcggaacacggtgtttcgcgccatggtcgcgagttgaactggccaagagcctaagtaagactcaaggaaggagaagaggctattaggatttggagcgaaactaatcaactgagggcgattcgattagtttgatgacaacaaggaactagcttgagacgctagccagcagctgtcagtatcaagatcaagagtggcgacatgaacgcacgtatagagatgtgtggttgcgttcgtgctctccatcactggacagtttctaacaagtaacaggtctacgtgggtctgcctatatgaaattcgatagaaaaacaccttgtaaatcttacaaattctaaactatgagattgttttaagatttgtgcacgatacctctaaccctaatccctcctccctctctccattccaccgtcggcgctgccactcgcgagtcacgagctcgcgcgcgcacaatgttccctcgccaggccgatcggaaggagtcaatggttccggctatagctagccataagacttgaggcctgacgacccggcccacggtacaacattttggcccgccccaagcacggcccggtccgccgggagttaggcccgtgccggcctggcccggccgccgggccgtgcctgggcccctccaccggcacgttgggccagcccggcacgaccgggccggcacggcacgatgggccggtaggccaggcccgacaaaaaaagaacagggagcaaaaatagacatattatatgccacggtccaaataatagggatgtaaaatagacttattgtagctacatatgtgccacagcccaatgaggagggaggaaaaatagacttatttttcaaaaggcatgatgggccactcgtgccttcgagccagcccagcacggcccgactgctggtgggccgtgcctgggccagcacggcatggcctagtgtgttggtcgggccgtgctgacccgacagattttggtccgagcacggccgtgccgggccagggcgggccgtacaaatggccaactatagttctggctaggccccttggccagcctcctctccctttctcctttctctttcctgaaccagcgatagtgagtgttcccgcattaattaccgtcttcctcatctttgatggctcctcgccaccggatttgccatcaccagctgctgtctcctaaccacaagctctaatctttcaccaccaccaacgccgatcaaccgctctcctctatcctcgtgactccagcgttgttgctggcaccttgctgcccgcccatgttcaccgtgcagcgccgaacttccaccttccacggtcatccttctaagcctcgtgatctcccctctgccccctacccccatcctatatccactccgaacataagactctaaaccctaacttgtcaggccgtcgcaggttgccggaggagaacgggtgtccggagcacgattcacgacacgaatttgcatgattttggcactaattttctaccaatatgtagccatttagtagcaatttcgatttttaagtgatttttttaaccatctccgggctgttgcattttatccagtgacgacgactcgacaggctaatttcgatgttgtcagtgtctccaccaagtccttagggcttaggtgtttatttcataagtaacaatactaacatcattgcttgtagggtaagtatatatataccaccagacaaaggagataattaaggaactgacacagtaaggtagtttacttggactcataaacaacactaacagtagacaacgctggcaggagttttcgtaacatcccagaacaatgcataaatcaggtgaacacaaaatatgcacacattcatagagcatacattagaggaattaattactccggatcagtagctgatcaagcaagctcatccaaataaatcaagccaagtaagtttgtctatttttacctcaggatcagccaagataaaccaagccaaacaaatcggcaaagtaacgcacatactctgaatctgaatcaaacaactaatagcaagtacaatttacatgaaactgaatagcgtcgtgccaaaatcagcctatgtaggatatgcttcatttcacgcattcagttagatactgacaaagtgagataattattgaactctagagtcaagtccactagtctttccaattaagctgcaacggcctgattctctatcatattagagagaattccatataagctacagagaataacatggctatatgtcattggtttaaatttgcacactcatgccactactgtgttgactgtgtattgactgttaattctaagtacacaggtatatttacccctttgagttgcacatgcagatgtaccaattggttaatatggcaactatttgaaggtgattgacatatacatgcatatttgtagcattttagtattcatctagctattgaatgcagcatattatttttgcagtcacatgttttttagccactaccatcacacatttttaagtcaaactcatgaaacatgcagttcaacaatgaaagcctaaacatgtagtaaaacattgaggtctccaaaaaactacatggtcttttcataaaaaggttaaaatgacatcacatagttcatcagcactatcacagggcaaaatttccatagtaggaccacacatggtgcatcagcactcagtataccacaactcatcaaagtgcatactgaccatattaccaaaatgcaaatgcaaaattactgctatcagtgcatactaaccatagtaccaaggtgcaaatgaactgagcagtgtaaaaccagtgtgtacctagagatcacagcaccaaaatatctgagcacattataattctcaactaatctactcagaatcacagtagagtcaacgaatcgaaccaactactcagaatcgcagttcgaatcgaaccaactactcgcagaatcactcgcaggaatcatatagtcaacgaatcactcgcaggagagtcgcaaggacagattgaggttcattgtgtcgtcaaatatggatacatggatacatgggtcacacctccaggtgtcggccggatctgggcgatgcttgtgcgatcaacgaccgcggagatcacggtccctctttgcccatcccttcttacccttgtgcctcttgtcctcggcctccttctgagctttggccctctcatcccggattttcttctcggccgctgcctgagccttggcgcacaacctggtatgcacctttatgaagcgcacccgtattcgccggccttgagcatcccgcacggacaggtccagaagagcatcgtgtgatcttccaaggccatcccgcctccgccgccgccttactcccgctcgctcgctcgccccccgccgccgccgccgccgccgccttacgcccgctcgctcaccgccgccgctctcggggatttctgatttcgctagggcgatccgatctgatcggacgcgtggagcagacggatgggtgccggcgtacgtgggcttcctgggcttcctgatagtggcctagtgggagtgcgaatgcatctgctccatgggccagaatatgtgggcttactgggccgcctgactgtggcttagtgggagtgctagttggccagcgtatgtgggctactgctgtttaggcctaagtacgtgggtttcctggacgaataagtttattctatgtccctttacttgacagcgagttgggttttcgccctcgaaccaaaataccagatacaaatgtcctttaattgtcaaaactggtacatatgaggttcctcggcgtggcattggaagccaaatatgaaaattaatttttttgaaaaaaatgtgggacccatatgtcagtaaggcaaaagaaaaaagtagtgggacccacatgtaggtgggtctcaccttccctctatctccacgacgagcgcacgcgtagaaccggagaaggagaagggcgacggctagcggctggcggccatcgggcagtagagcaagagaagtagatacatcagtttggaaattatggcttgaaaacctttcgtagcagttttttttttctgattccttccttatgtaaatagaacttgcatatattgacctaagtagcccaatgtgcaacttaggttatatatgtggcctaaagtgaaatttactctctttttatttgcatgcgaaagggtgtgcgcaaccctggcacgtgtgtgcgtcgatctaggttgaagacgacagccttggatatgatggagagtatcagctccattatcgtacatgcacgagactgtttccaggaggttgaagacggcaatctatacgagttgagcctgcagttcctgtggactggatcgaacaaaggcaggctgagcggaggaaggtagcggactaggcagggctgaaaaaaaaatgatgtaatgggcttttggatcaaaactaaggaaggagtaaaatttatcgtgcgatcaattttacccggtgcaacgcacgggcattttactaggaatactaataataataatctaattgtcccctttttcatcacaaatcgcatatgcatatgcatgtattaaatttcttttcgttgttccacattcattaaacaatcaactctggaggaaaaacccacgttctgtccaaatcaaagaacccgatgcttcgtgtaaacggcctcctagtaccggatttcaagtcccacacgtccggtgtgtcgacgaaatacatcgtgtcctctaaaacctcgccgtgtgcgggagcaggcatggacttgttgaagagttcactgaggaagattgcttggccacctagaccgccgccggtgaccggaacccatgtgccggcgtccatgtcggccttagagacatccacgctgcgggtgtggtcggcgtccttgacgaaggccgcgattaaacactcccgtctcaccatgagcaaccggccagacgactccaggaggtgccagctaccgttaactgcgtagtcgtccccctctaactcgtactttgtagtcttccaaatgagatcctcaccggtgaggtactgccactgatggccgacgtcgtcgatgccatcatcaccgacgggctcaatttcgctatcgttctcgctgtctccctcttggtttaatgactcatcatggtcgttggtcgatgcgtcaccgtcattgtcttgtgcgtcgccgtcgtcgtcgtcttcatcgtcgctccacctaaacgcgtcgattacgccatcagggcttctcggttgtctgatgatgcgctcgacgctggtgacggtgggcttgccgtctttgtcgtcggcgaggtcgacggcgaagaggtcctcggcttttgtaattagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58018 - DNA, 709 bp, Oryza sativa
attgactgggttcgttcgacataaacagtacaataggagcagactgtagtagaaatcgatgaagtccgtagtttgcagggtttaccggacaccgaaccgccacgtttacgtacgtgtcacatggttacggcgattacggcagtgtgttttcgaagcatatcgaacggacgattgcaccaagcattgacaacgagatggtactgtaattgacaatttgacatcgtttgcatggacgagttccgtggtgttcccatcgagcagctgcatccctgaattcaattggacgtcagggagaaattttttttttttgaaatggattggcttgcaagcaagtcgacaccgaggaaatggactaccgagcgatcgaaagatattcatcacaccccatcctgttgaagagtactatggttttgttcagttcattgattgcgaagaaaaatgccttaccatgtatttattggtaaagttaaaatttggcaattataaaagtttagtaggatcaagatgtgaaggtggtgtttagttggacatcttaatttgatatattattgtgagtagaagtttctaaaaatactaaatgttggtagatattgaaaagattgtgatggtaaaatgttgtttaatttgttaccttaccaatttttttagaacagttaccttaccaatttgatatggttgattatagcaacaaactgaacacaccctatat

SEQ ID NO: 58019 - DNA, 3123 bp, Oryza sativa
agggaccaggaaattaatcttgtttttgtagcaccagccaatagcactgccgcatgtataagacacctatctgtgccactacctgaccaagtgacagccatctgattaattaaatgcaacagtaatcgatcaaaagctctggttacggaggaaatcgacacggactcgacgtcagccaactggagacgacgtacaaaatattcacgcaaaaacatcttaaacttttataatagtagatagatatgccaaaccaaattattatagtcattatatcatcttgctacaataactttcactatcccaaaatatggaatccatcgttctcgaacctcagcgaatcacctatatcaatccggtacgtcatcgtggttatttgctcgaatttcgtcaaattctactgaatctatagatccctggcccatctatgtccaccaaattctattgaattttaccgatttccatcccatcaatttcacctgtaaacccggcagcaaggtacaggttggatcctgaattttcagagaaaatgactgcatatttatcctgattaattgtcggcaggtcaaaatttgtgttgtctttttgtgaatggatgaattgatttggagcaatcttccacagacatgctgatcgcagacacatcaatttcagcctaagccattgaccatggggttcatgcatgcacatggagatcttttgcacttttgttgtttgttggcttttgcctagatatattctgaatagaactttccattactcatttaatgatctgtcctccatatgcataaacaaaagagtttgtcctgattaaatctaattgcattctaaaccccacaggcaccagataactctcaatctttagatagatctcatatgcatgcatcatattgatattcttttcatgtacttgtttttatggaacctctagtgcctaaccttattatatatcaatcagttcagatccagccacacgcaaaaagttggccaatcttttggccacttgctaattagcagcaaatgcagcttgtagctccatgtgttgaacactccaacaaccatagtagccggattcggctcccctatcttgagagatgtatatgaacagttagtctcaacctaatgcatggaattcggccataatcagggctccaaagtactctacaaaagctatttcccagtcaaaaaggttccaaagtgaaataggcagtcgtgacttgtgactctgtgaggggccgttcgaaaggcaggagtaattttggtgaaatatatatctgcaatagttatggtaatttaattctatcgcagatatatatcttcgcatgcggacgcccgccccgcctgcgaagatcggcgatcttcacagtcgtttgcttacaggcggacggccgcctcacctgcgaagacacatttccaccaccggcggtaatgcattttctagccgtgatatatcacccacgagaaaagagaaccttgcgtagacaactaaaagaaattctaaatgtgctttacgtgaatgtttgaattcctttcagtttgtataaaatgacaatttaatattggaatcttgagagttcaccagtataatccggccgaacatgcatattgatgaagaaagggcttgaatgaacattattgtagctctgaaaattaagtaaatgaattgtaacaataatattgtatatcaattataaaacacaagggaaaatggagagctagcttttaatatgtccactgacatgtaagagcaaaagctgctgagaatcttctaattaaatttctaattcctgcaactatagatttctataatcaaggtgaaaacttagactatttacgagaacttgagattgagattttagaagaagttacaggcttacagctatcaaaaactcatcaaattgagacatagtcttgtatgttatttctatccatttgtcatatcattttctttttttttgaaaaagaaatatcagcaaatatctactactcctactttaaagggtcgtcatccatccgctcctttccatgttgtgcaaagaaaaaatatccgttgggcctagtgcttggtctatacttgtatatcccagtatataagcccagtatatatatccatccttagtaatataggtctatcgtaatacacatttatgtaacctcttcttattttgtctagtttctttcctaggtagtctactgttgtctctctgtcgacggatgatacccgtagaccggatgaatagggtattgagatgcgttggtacgaggatctacacaatacgacatgaagcaaacaagaagacaaagattatattggttcagacccctcataaggtaattgctttaattcagtttatatgagattgatatggaaaaccacataatacaacgagaacagacgaatccgacgctaccagcgagatcctcgtcgagatgatttgacgagatctctcgatgagtatgcttcgcgccctccgatttgttgactatggtgggcgtatgggcgataaaatttgatgatctgaacccctcagaggtgtgccttttataccgtgagtcacattagtctctaaatagaactcggagacaattgacacacacaatataatataaacccgattctctctgagtagaactctattattcacctatccgtgaagatgatttttatagtattttgtaaatttccttatcatatactgacggagcgtggggctcctcaccaggagaccgcgcaggcccccctttgccggttcggccgggggcgctaagtgaggttcttcgccctcgatctgaggaacgtccgcgagagaggaagtgcacaagacacgggcgacgtagacaggttcgggccgctgagaagcgtaacaccctactcctgtgttctggtggatctgtgcgtgaaggaatacagagagctggagagcgagccagagttcagggtctagcacccattcccttttttctcctccctccagcgcccccctctcctaggcctgggcctcctttttatctggtcaggggtcaccacaagggcctctcgctacctaagaaaggaaacatgctttttacaatgagggctaatctacagtcggaagtgacctctgacaagcagagcacacgtcttct

SEQ ID NO: 58020 - DNA, 20153 bp, Oryza sativa
cccccccccccccccccgagggggtcaggccacgtgggtgaccgcagctacccaagcctctagtcacgatacccccggccccatgtcaccgacagtagcccccggcgttatgccagggcgatcgcccctctcgagggaagcgctcgggcgtgacgccactccttagatccggtgacaggtggggccggtccctacaggcgggcagaaacccagcggtcgcaaatcgcgcgcatcggcaagggaaaaccgaccgacaacaatgagcggcttctttaagaccgctacattactcgagcagcgcgcgaatcgggacgagccggttcgtttcgcctggagacatgatgatggcgcttttcacggttggcgagcgtagttaatgcgtgcacaatctgccccatctcaaccgccacggccgcacatctgccgcgtgcgctgcaaacgggcgagtggggttagtggaggcgtggacgcgagaaacgagggggcgcggtagtgggcgcgggaagcgaggagccgggcatagcgttggcaagggtgtaaagacgccgaggaagggattcgtttctttcctcttcgccactcttccccttgccttcgccacttgtgctctaactcttcgtttcctgtgccctgcccttgccgcactcgctcgctctcaagctcctcctccgccggcgtcatggcacggggctccgcaccgctcgacggtagcgtgctgccgccttcccgcatcgtgagcgagaggcaggccgggctgccgcgccgattcatgccggaatctgccaccggcagggaggtggtcgcgctgggcgagggacgcccggcgccacactacctggggcggtccgtcttcttcctccctttcgcaatggcggggctggtcccgccattctctatttttttcatggatattctggagttttatgatctccagatctctatttttttctctacctgttggccattttcgtgcacctgtgcgagatgtttattggggtgcgcccatctctccggctgttccggtggttcttcaccgtacaggcggtgtcgccgccgacggtagtcggtggctgctacttctagccgtgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcgacggtagatctgggagacggctacgacgccgttcttgaccgcctggcgggtctgcgatcccaggggctcacgggggccagggtgttcggtgactaccttcgtcgctgggtcgcgccgctccagcggcgcgcccggggcgcctgggagtacaccgggcccgaggactacgtgaggacccaccaggggcgcaaatgggactgggaccctgaggacttcaggacggtggtccaacagatgctgaatctcagctccgtggaggcatccctcatcccccaaggggtcctccccctctgctgcaatccagagcgcgccaagatcctggccatcatgcaggtggtcagggcgtcgggggagcgggccccccgaggccacgatggcgcgggcgggagccgcaggggggaacaatctaccccgggtgggggtcgtgcttctgggccccgcgacgggggcccggggggcatccgccctgccgacgcccgggggaagaggaagcaggagggtacccctcccccatctcctccccgagggggcggggcggtgcgtgccagcagcaggcgcccggagggtgctgtgccgacgccgcagcccgagggggagcgaaagaagaaacggccccgcaagatgggggggaccgagccatgccgggggagcctcatcttgcccccgaggtggtcgtttagccgacctccccgcaggttcgtccccgcgcccaccgcggccgtattcattctcccaaggcgagttttcactcacccgtttctttttgtcttctggtttttcttctgcctcagcgagatcccgtcgccccccccccccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctaggctccgccgggccggggagtccgtccgggaggcagaggcggcgcgcgcacgccaggcggcctgccaaacccccgacccgactccgcccgagacgacgccgacttccgaggccacccacgacgaggccgcgggcgcgccgctcgggcccgacctctcgggcgacgcttgggacgagccagcttcgggggacgcccccgagtccggcacgtcgatcggcgggccgagccgcgcggcacccacaccgaggcggctctcccctctgccttccgctgccccactgagcgcggagcccttcctgcaggccttggccgccgcgaacagcacggtgctggacgggttaagtgcccagatggaggccctgcaggcggagcgggcggagctcaacgcggcgtgggcgcgcgtcgaggaggggcggcgctcggtggaggccatggtggaggcgggccgcaaggcacaccgccggcacgcctctcagctcgaggcccgtcgtagggacctggcggagatcgccagggaggtggaggaggagcgggagactgccctcatcgccactgccgtgctcgacgaggcgcgggacgacctccgcctccaatacgggagcctggcggcggagctagaggagaagctggacgccgcccggggagtccttgacgccgccgctgcccgggaacagcgggcggcggagaacgaggcggcgtcccggcagcgcgaagaggcccttgaggctcgcgccacagcgctggaggagcgcgcccgcgccctggacgcgaaggagagaaacctggcggaccgcgaggccgccgtcgccaaccgggaggcaacactggcggcgcacgaggccgcctgcgccgaagaggagtcctcactccgcctccgcgaggacgcgctcaccgagcgggggcgaactctcgaagaggccgaggccgcggcgcagcgactggcggacagcctgttcctccgcgaggcagcgcgggaggagcaggcgcgccgcaatctggaaggcgcccacgccgagagggccgcactggatcagcgggccgctgagctcgaggcacgggcgaaggagctggacgcgagagcgcacagcggcggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccatctagaccgcgccgggcggcaggcgagcctctggggcgggcggtacacgaagtacgccgccaaccagggggggcctcgcccagcgcctctcagagatggccggggccctcgagcggctccctgaggagctcgaggagacgatcaagtcatcctcgagggacctcgcccggggggcggtggagctcgtactggccagctaccaggccagggaccctgacttctccccgtgggcagcgctggaagagttccctcccggaaccgaggacggcgcgcgcgcgcaggtccgggacgccgccgaccacatcgtccacagcttcgagggtacggcccctcggctcgcgttctccctcgactccgacgaggagggcggtgacgatggtgcggacgacagcgacgacgaggccggcgacccgggcgcgtcggagtgagcccccaggcccccgccaatcttaatgacttttccttcttcttccgaggccttcgggccccctttttgtatagactgatttaatctgcaatcaagtaaagagaaaatttctgcgtcagttctgtttgttgtgtgtataagacgaggatggtctgtgccgcggtccttatgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccgcgccccggggcacggctcggttctgggccccgtttggcgattttagccggcccgggccgccgagggtagggtcgagcacgagcgtactaattcaagccaagattcttcaaaaggaaacgatggcacagacacagtcctcaggaaatcgaaaatgcttttattgaaatacggaagagaaaaaggataagtatatgcatgtggtagcccccggccaaccctgcacgcccgggggggggggtgcggggttggcccgagcccgagacatgacacccgacccctactaggggtagaagcgatgaaggtgttcgatgttccacgggttaggcagctctgtgccttcacccgtggccagccgaacggagcccggccgggggacgccgatcactcgatacggacccttccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcaaggtcgtctcggcgaaactgatcttgatcagcctcgcaatacatggtgacccgaggggacctcagggtgagctcagatgggaggaccgcctccgcgccgtagacgaggaagaaaggcgtttccccggttgctcggcttggcgtggtttggttcgcccagagcaccgctggcagctcctcgatccacgagtcgctgtgcttcttgaggatgttgaaggtcttagttttgaggcccttgaggatttccgcgttggcgcgctccacttggccattgcttctggggtgggcgggggaggcgaagcagagcttgatgcccatgtcttcgcagtagtcaccgaagagctcagtagtgaactgggtgccgttatccgtaatgatacggttgggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggccgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccattagccgcgcgccgatagagggtcccttccaccagcgcgtagcgcttggagatgcgccggacgcattcactcccttcgcggtcctcgggtagagtcttatctgcgaggtacacctggatctcagtgatccaagcaatcaatctaggggagctgggagcgctcccctcgggtcccgaggcctggactccgacgggcctcgggggccgttcaggcgcgtccgtttcccctagggggtcaggtcgcgccgacggctgggcaagcctttcttcaaaggcgcccggtggggtctgggctcgcgaggaagcgagccttgagagttcgtcggcgaccgcgttatcccgtctgggcacgtgccgaagttctatcccgtcgaaatggcgctccatacgccgcacctggggcacgtaagcgtccatctgcgggtcagagcaccggtactccttacagacctggttaacgaccaactgggagtcacctaacaccaggaggcggcggatccctagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctaaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcgctaacgaagtatacaggccgctgcacctttcggcggggccaatcctcttcgccaggggccgcatctccagggcgctcttcgaccgagaggccacgcggggcacactcggcttctgtgccgatgacctcggggtcagagggcgacaggcgcggccttcccgcagtggccccggggccatcctgggggtcaggggcgcctggcaccgtcggacaagcaggcggagggccagctccgaccgtcgggggccttgggccgccgttcggctcgggggcctctcctccctgctctctcccgggtcgagtcgacacagggtagggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggtccggagcgtttgaggagcttaaataggggtagcgccttctctcccagcctcgatatgaaccgacttagggcggccatgcagccggtgacgcactgcacatccgtaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagttttcgctagatccgagagtaaggtctcttggttgcgcgtcttcacaaccaagtcatcaacataggcctcaacattgcgtcctatctggctacccaaagaaattcgagtagtacgctgaaaagtaggacctgcgttctttaacccgaaaggcatcgtcgtataacaataagttcctatgggagtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttggccttgggaacgacgaccgggttcgccagccactccggatggatgacctcacggatgaatccggcctccagaagtcgcgccacctcctcgcggatgaaggcttgatgttccggggcctgccgccgcactttctgccggaccggccttgcgcccggccgcacggcgagacggtgctcaatcacctccctggggaccccaggcatgtctgccggtctccaggcgaagacgtcggcgtttgctcgcaggaaggagacgagcgcgtcttcctatttgtcgtccagaagaccaccgattcgtgtggtcttggacgggccgtcgcccagggcaacctccttgaccgggacctcgtcgcacgtgaccatccgctgccttggggcggccgggacggaggtgctgagcctctcgtcgccacccgcgggcttggacgccgcggcgaggtggtccgcgcgctgctccatacaagcaagctcgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggcgtgccccggcgtcacaccgatgatcggctgggacggccggagcaccatccccggggccttgatggcctcaaaggctgtgggggaaaggatgttgagggctgcacccccgtctatgaggacacgccccaacttcacattgcaaacggtgggggaaaccaccatcgcgatctgtcctccccgggtaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgctggcgggagccgccggggttttgccctcacggcgctcctgcctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacgtgaccctcgtcgtcgaaacgggccgaccccttcttcctcctcctgtcccgccgccctgaccgagcggcggtcccgggggcggccggagctgccacaccagaaccggaggagttccaggtccaggcctcctcctttcgagccacacggtccgcgagctcaaaaagctgcgcggtggtctggggctccttggaggcgatcttctcgagcatgcggttgtgccgcgcgccccccctaaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcatggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtattttttggtgatggtgggccggaaccttgggggccaacggacgttccgaaagctcgccacaaaggctcgacagccggcaccgccaaccgggggcacggggggccggcccccgtgcccggacgcatgagcgcgccctggggcgtgccgccatcgccgtagacgaggtggcgacgcgccccgtctcgccgtcctcccccgtcgcccgcgggcggcgaagtcgcggttccttcgacctccccgagcgcctccccccgcccaagatttcggcgagagggggacggtggggtgcgagcccgacggcgcgggttccgctccccgtcgtcaccgctagcgttcggagagaggctgtgcgccactgcccgttcggccattaagctgagcgggagaagcttggcgcacacgaaagaggacgagggcttagaaagacatgcgcgccccctacctggcgcgccagatgacggagcgtggggctcctcaccgggagaccgcgcaggcccccctttgccggttcggccgggggcgctaagtgaggttcttcgccctcgatctgaggaacgtccgcgagagaggaagtgcacaagacacgggcgacgtagacaggttcgggccgctgagaagcgtaacaccctactcctgtgttctggtggatctgtgcgtgaaggaatacagagagctggagagcgagccagagttcagggtctagcacccattcccttttttctcctccctccagcgtccccccctctcctaggcctgggcctcctttttatctggtcaggggtcaccacaagggcctcttgctacctaagaaaggaaacatgctttttacaatgagggctagtctacagtcggaagtgacctctgacaagcagagcacacgtctcctgcccccctcgccagctttcccggtggacgcccatttcaaccttcattcaatggccagcgacttccttgccatgcttgcgctgaagcctggaatggatctgaccgggactgacataccaactccaggagttagcacgccggctccggctagggacgagagccaggaagctctcatcgtttcgacgggacggggcgaggcgtgtgacaggccgcctgttgccacctaacccacgatctgaccggtctgtgaccggtcacacgccgcgaccggtcacggaccggataagcgtgcgccgcgccgcattaaatgcggcgtggcgcgctcgtccaacctgttataaatgcggttaggtgagccccgctgtgctcacctaactcacacacgtggcgccaaaaccacagggggtcggggcgtcgcagccctcggggccgaaacgggggcgccccagccctcggggccgaaacgggagcggcccgacccctcggggagacagagggaggggtggccacgtcaccctcgggcccgaccccccccccccagggggtcaggccacgtgggtgaccgcagctacccaagcctctagtcacgatacccccggccccatgtcaccgacatatacggaaatatattttgccatgaaggtatgttgtattagtatatcctataagttgtaggacaggaggtatgacttatctataaccataacactctcatctatgaacccatgacatagaaggtcgtagtagtaaaataattattttttaaatatattaatgagtaaggttatacatagacactttgtacttataatacaacaaaaaaaaaatcaaaggtggtgtaatctgcaaataccgcaatagaataagccgcgtttttttttccaagaccgaagtagcactgtagcgtaccaacgtgccaacgcaaaaaaaaaaaaaaaagaagctatccaagatccaccgggccaccaatccaaaaataaagcctgacatcataataataattcagaaatcataataatattatcatatcccttcgctttccgattatttgttgtttccatgattaaaatataacaacccagccggccggggcggcagaacggatgtcgttgtaaggtagcattcgttgctagcgcgatcgaggatgatgaggccgatccatccatgcagctgctgtgctagctagctctgctactactagctttagcttaagcttagctagcgtcgtcgttggctgggtggctgtggctggctggggccactgtatgctcagcggcgcgagggcgaaatggcgaaaaggttggcatccgatcgagagatcgatggatggatggatgggtaggccgggtccctttctgttgcgaggttcgccggcaggttgcgggctggggacctcctcgcggcacgcgacgtgcctccccacccccggcaccctacctgctttgcgggaggaggctaaaatgcaatgcaaccgatcgatgccactctgatctcctagtgaccgggaatatatgggcttcgccccccagctaattttcttgattggctaccggtagctctgtttctagatggccctaagcaacggatgcagatgaggattaagaaacgcgatttggagggaaagaacatttctaagaagaaattgtgagtatgttggggattgaaaccagacatatcttgccactgcaatatcaagtacatctcaagatgaggattaagggcacatgaaacatgaaagtcattggtgtacgattaattaagttgcaattattataaaccggaaaatacatttatttggtattttttaacaacttcaatacagaaagttttcacaccatttaacaatttgacattttagtagaatttgtatcgtcccaatcaaaagactggggcctaaatgcccccaccgccgttactagcagtagcaatggaaaacattgtgtactccctccatccaaaagtctaaccctatttcttttggcattaaggctaaggagtaattaattctttcacaatgtgataaaatcaatgaacatgcaaccaatgcaataagtaataaaatgactttttaggttccaattaataatttaatttagcacatagtaactacaaattgaacttagacttttggaaaaaaaccaaaaaataaaaaaccctcgtagttttccagatccggccacccctccccgccggagttgaggtcgagggcggccatgcctatctgttaacgaccaaatttgttttttcgcagcaacactatcctggaaggcactgccgctgccggatccagtgaagtagtatggggagtcggtgtaggggtcgagcctgtcgggggaggcgtgtgaatcggactgcgacatgaagtccctcgtgccggagctgtcgccgttcatctccgccccggattgatgcggctggcaagatcggcgaaggcgaaagctgccgtgagcggctgcggtgagcgaaatcggcggtggcggaggcgggcgtgaacagcgtcggtggagtaggaggcgggcaagatggggaaattttgggggtgaaatgagagagagcgagcgtgcgagggaagagagagagagagcgagggtaagagagagagcgcatgaccgaccgggggcaatgcgcgtcccaaagcactttttggtgaaatttgctagtccagactgccaaatgacaaatgcaaagttgccaacttttggaactagtgtttagatccatattaccaaaaagtggtttaaaatggcaaaagttttgccattttgaaggatctaaacggccctaagttttagacttttggaaggagggagcatctcttaagagcaactccaacaatctagctatcaggtttggatcggtaaaaaaaacaaaatgagtcaaaaccggggtccaacacactcggtatctcgctccgctcatgatcctgttcaacatccgtcgcccctcgtcctgcatatttgcagtggccatcccgctcgcaatcgcctctctcccgcgcacgcgctcgtttcccgcccgcgcgctcctgcccaatcggtcccgccgcctcgccctcccgccgtgctacgccgtcgcacctgtcccgccgtcccgcgccctcgccgtcccgtgccgtcgtcggtcccgccgtctagtgcccccgctcttccgccatcgcgccgctctggccccggccttcgtctcgccatgtggaggccgccgcatcgtgcttcaacggcggctaaggacttggatcaggatgctcatcgcccggaaggggacttggattagtcgggtattggatcgatgcgccattgggtggttcctccaacaggcgtcgatggttggaaggcacaaggtctgttcatcggtgagcaagtcaccgatgaggaggtctgcacaggtgagactcactatctacgtctgtcaaaccctttgctgttagttggatgactggatcataggaagttgctcgttctgtattctacctgaggattttgggattgcattcatgttggctgtaggtttctggaaataaaattgttgtctttcttcgcacctgaccagagtagctacttgttagcacaatacatttgaatgaaagattcatctagatcaaattgcttcttctttgcaagtaaataaacaggacctaccctaagtcccgttttgctctaaatcttccatcctgcattcacatcacaataattttcacaaaataagatagtttacaattgcaagagagtaggtaaattaaaaggataatactctgttatttacattgctgcaaatgtccacattgcatataattttattcagctcgatagtagttacattactttagatgcaactgcttccagtataattgtaggctcctttttatagcccctatacatcccgtgccatgcagtaggacaattcttccagctccaatgcatacaatctatggaacctagcataccaggaaatcctctgctcgctccaattgtaagtaacctagcagtatcctgttcattaggcttcctcatgtactctggtccaaaaacctcaacaactgctgcaacaaactttctcaaagcttctagagcggtgctctcaccaatacgaatgtactcgtccaaagcatcagctggtactccataagccaacatacagaaagccgctactaccttctgcagacaagataatccgagcacaccggctgcattcctcttctgcttaaaataatcgtcatgttcctcaacagctttcattatgcgaagaaatacatgtatcctcatccgaaacctatatcatgatgcaattaaattaaattagaaatactataaaacacgacacataaaaattacataaacattatagagaacatgcgaacctgcgtctaaagatgtttggtccaaacgttggattatctgagaaatagtctttgtaaagaagattgtgccacaatagtctatcccgatgcactacctcatgtccatgaacagatccaattcgacccggattatttactgattcctcaatgatcatttgcgcagcaccaaaaaatagatcatgctcctcatccgacgaagagggatcaatcaattcgttcattacgaactcattaaattcatcatcggactccataccctgcacgcaagactgatcaatttctactgatgttaattgaattcacacaagactgcagtaccaatcttcctctacatggcgatagtgtacgcacctgttggatgagtggtcggcggcggcgtgatgacgcaacaaggaggcgcgcggcgtgcataaacgatctgccgacggcgacgcggtgcaacgagaggcagcgacgtgcagaaggaagcagccggctgtgaacgacgtccaagcgatggccggaaaccagcggcggcggcggagaaacgagaagtcatggagtcaaccggtccggaagaacgggagccgtgacgtggacccttttgaatatggagagtcaatatttagctaggctgttggttttacccctcttgttgggatcttttttcctttttacagacctctttactctctaaacttagctaatcatatacataatctcttggagttgctcttagggtctgttttgctaggttctaaatcctgaatccgtatccggtgaagctagagcagaccaaacgttacttaattctcaactttaggagtaaatcgatctgctctagaaaatatataggaatggtggggttaccttttttcatctccataacttcaaatccactacagatttagagctctatcaaattggctcttaattattacttgtcttgtgaaataaggttaaagttgattatcgaatatttgctattagttcgtcacaagatttatgcagacatacatttcaaacaccgatttcactttccttttctctatccccctctagctcgggactagcggtggaaagcagaatttttaactagagtcttattaacattaacacgtctcatcaagtgatagttatggggagacaggggcggaggcagccctaggcttgcttccaatatcatgtataaattatgttaaatcaccatgtaagtttagagagaaatcaacaactcattagttgagccctaggttagccctactctttagtaatttctggcttcgccactgtggggagatgattagataggacacataaatctacatgtcaatgattatcactgcatggacaacgttgtagagtaccctcaataattctccatctctatatggatggacttaacactaactcccttctttgccatgttgagctctcctctttcacagctaccatgatgttcttgctcgtctcctcctcgatgcctataccgccaacctttcttatcgaagccatctatctagcctcattcgtcgacgtctggtcctacttatctacctgctggtaaagactcactactacaaaacatcaaatagatgccgacactataggagccaaaagtggtaaaaccggtacgtataatacctttcccgccaacacgcccgccaacccaccaaaatagcaagaaccggcatctttatctcctaataggaaaccggtacattttacccctgacagaaatagatgccggttttaaattaaatctggcatcttttagttggcatgggggccaccttggactcggcaactttgtggacaaaagaaatatatgccggttttcagtcaaaactgacacccatcttaagccgagccgatccgggcgagccggatccactcctttttcgcccatccttatccaattctctctctccctctccatcccgtctccaccgcccctcccctctctcttcttcttccttctctccttctctcttcctctccacatttccttcacctctcctcctccattcaccacggcggcagcatggcggggctctcccctccgccaaatccggtgggacgggaggtgctggtccggcggcggcgtgctccctaggtcagatctggcgggaggggagacggcgacccggtgacggtccgtggctagagacggcgggaggcggcgggacggaggtggcctgcaccggatctggaggtgcggcgtcggctggaggtgagacaacatcagtggtcggcggatccatctctccccctccctccctctttgtgatttgttggagatgcgttcttgttcatgtgagagtccatttgttgctatgagaattgatgtgagattttgtgtcgttcttgttcatctgttgatgtggaatctattcatcatttgtttctttgttcatgtgggagttaatcggctagagtcggctcgagctcgagccggcttatgtttttttgctcgttgattacatattggtgtcggtttttaaaatgacagtggtgccggtgcactaatcagtgacgcctccatggtgccggttaggaaaaccagcatctaagggggttaccaaccggcaccgaagttcttttctgtagtagtgactcctaaaatattttgttatgctttttttcccttcccttttgtcggtctcctcaggatgttaatacgtaatgttaacattccacactactatacgtatattttaagaataatgttttaaaaacttgtatatattctacgaatcttccacgtaatttataccgacaaattccatcaagttgccgttttccgttcctttccacatccctcataattctctcgctgatctcacctgctaataatcaagaacatgcacggacggcgacatgagccctgtacggttttcctgctccccaaaaaaccgtgatggacctcatgttactctgtaccaagaccctccatgttctctcatttcatttcatttgcacacgcccacaccactcatctgtttgttcctctcgtcgatcttgttgttgggaatttatctttcgagtcttgaccccaagtggctggacatgcatgcaaaagatcattcaattaattgccaccgtgtcctatgctgctgtaatcaagcgcagctcgatccctgctgcccaactgttcagcgagatggcgaaatggcagtgtgtgactggcacgtccatggaatcatggattaacacctccagagagaaatctcatggcccaaacgacatatttctaaatgaaaagcattatgtgaataaaatttttatacacgtgttcttagcgatatgaaagtgaagtctgaaaataaaattactactcgctttattttaaaactaagaaggtagcccgcgcagatgcgcgggcaatttatttattgtttacaaatttaattggtaaattttgagataaatctaatggtttagaaatttgaagatttttttcctaagagagtaggaaaggaaagaggagatgaggagagtacgtccgtaccagggaagggtgtggagaaggtgagagcacgtactttttttatttgatctaatagttaaaaataggcaaaattgattatatagcatcgaaagttcacgtttttggttttatagcattgaaagataccggttcactttaatagcacccaaagtttaccctgttcccatttctagcacttccgtcaatttttccgtccgtcttgatcgttattgacccagctacgcacacaatataatgtttctacccctcattgacatgcattctacttgtacttgtgaggggtagaaacgtcatatcgtgtgtgtggatggatcaagacggacggaaaacgatcgagaattgatggaagtgataaaaatgggaacatggtgaactttgggtgctattaaagtgaatcggtatctttcggtgctataaaaccaaaaacgtgaactttcgatgctatataaccaatttttccttaaaaatattggacccaccaatttaaaagaaaatcaatggaaagattttagagtgtcacttggcttaatccaaacaaattaaaattaaatcagatttacttgaaattaattattatatatttgcccaagatgtggtgatgtatttagaaccgcaatataaattttataagacacaaatattttatttaattaaagaaatataacgggatcacaaattgattatataatctaaaataatttaaaagatgaacgtttagagatagttgatttgatattttttatttatattatagaactagtttatatttgcacatatttgtggagtaatatatttttatatggtaaaaagttatattttaaagacaattgattttgttttgacggtaatatgtattatcgattttaatttattttgaatcttaaattgttggtttaattatgatagagcaaaagttagattagatatgatatgtgtagcttaaaataactgtggttgtttctccttatcatagctactaaaaaatatagagagaagtggagggggcagaaagtgttgtgcgtatctaatggtgagggtgaggtggaggggactttgtttttctatttttttctaaatcatttaggtcaaaaaccaattatcatgtattttgttttttagaaaatcttttttaattttaaagtcatcgtaatgacttaaaaaggtaatcttagatacacagatttaagctggatgatttaactggagattgcttggttcgaattagctacgtaatatcatggtaaagccatgtaaactgatttaattagctgtatatgttatattaccgttaatttccttccacaaatcatgtataataactaatttaattagctatgtataatcttcttgttaatctcctagcttccatatatatattgccgtgcatataataaatatagctatgattagtagtaacacaatatgacagctaattaatctcaacttctaacaaccatagttactaatccttccggcaaaccatacatacgtacaggagaaaggcagatctaattcattggtataaaataaagggtccaccaatttaagtgaaaatcaacggtaggtaaagatctaatctaacggtataaaataatgggtctaccaatttaagtgaaaatcgacggtgagattatattgtgccacatggcggcctagaagcatttgta

SEQ ID NO: 58021 - DNA, 4369 bp, Oryza sativa
gcgttcttgctggcagatggccatcgttgccgtcctcaccacacttctctcttacaacaccatactccacggtggtgcgacggcgaagcttgtttagcctaggtgccgttgttggtctaacggcatctctctctctctctctctctctctgctaggagagagacaagggcaagagaagggaaacggagaaaaggggtagagagggaagaagagagaggatgacacgtgggttctactattttttatttttttagaggtttatatgtgagtcccacctttttaaataaaaaatcggactgagcatcacatagacaccacgtcaacatgttaaaacactactagctcaaaactgccattaaaatcgtttagagagatactccctccttttcaggttacaaggcgttttaactttggtcaaagtcaaactgttttaagtttgactaagtttatagaaaaatatagtaatatttataatactaaattaattttatcatcaataattgaatatatattcataataaattgtcttagattaaaaatgttactattttttttctacaaacgatcaaacttaaaacagtttgattttggtcaaagcatcttataacctgaaatggagggagtaaaatagatccgattttaatagttcatggagtatatgttttgaaatttggggatatgcaaattaaacttgccatagttgagggcggcgcaatggacttgtaccaggaatctgagagggtgaattacaaggcctcaaaactttgtccagatcaacttcagacgcaaatgatttaagcataaaacatgactctgtcttacactcttacaccatacaacaccatctcaaaggtagtattaccgaacaaattaaagtggattaagctccaaaacacaagcattttttttctcttgaggaaattaccaagaagccaaaatggaaaaccattgacattactcgcataagcaattgataatagatatcgatcgataatataattcgatatattgacatatatgctaatcagatcaatcaatcagtaggagttgctgttgatggcggagcacttgaggcggacctcgccttcgtcgccggtgagcacctgcgcggcgccgaggcggcgcatggagtcggcgaactggtgcctgatcagctccgggcgcgcgccggcgagctccctgacgaactcccccgtcctcgagtccggcagcagcttctggtccgtctccaggaggcccatgtcgcgcagcaggttcttgtagtagccgttgtcgaactccgtcggcgtgtcggcgtcgaggtagacgtacccgccgtcgccggcggcggcgcacttgcggcggaggaagtcgccgtaccgcgggctcatgctggcgtcgggcctccccgtgccggcgtagtcccacagcctcggcttcacggcggcgcacgtggcgcggccgatggtgtgcgcaccggagagcacggcgaggtccagcacggtgagccccctcgactcgaagaaggcgatgaggtcggtgacgctctcccgccccatgggcacgtactggtcggcgtccaccatgctcgacctcctcccgtccttcctcccgtacatcagcggccagtagtccaccttcacctgcacgcacgaacaccgttagccacgcgcgccgccgccgccgtacgccgccggcgagagtagattactagagtgtgtgagctgagcttgcctcggtgctggcgtgcgggcggcggcggcgaggatgtcggcgcaggagacggtcttggggcacttggcctccagctcggccttgatggactcgatgagctcgaacccgcgcagcgtcttgctcgccttggcgtacctctcgctccccggcgagtccaccagcacggacgcgtcgatcccctgcacgcaatccaatatccatcacatcgcgattagccgccattgccggaatggtggagatgtcatgtcaggctggcacggcgacggcgagctcgttcgtggcgtacgtaccccgacggcgaagtcgtggaagaagaggcggaggagggcgggggcgagggtggagtcggcggcgatggccttcttgacggctcgctggacgatgccctccatgtccgggcacgactggtggtagtagtcggccttcagcccggcggccggccgccggtacgccggctgcacgtagccttgttgtttctggccgtccgccgccaccagcgccgcgaggaggagcgccgccgccgccaccgagacggcgacgccggccaaggagagagacgccggcgtcctcgtcatcttgatcgatcgaaagggaaaacaattctgtgctgccgtgagctgtgcattattcatctgggtttctgcgtgagattatatagttttttgagcttgttttgtgacgaggacgacatggcgagcacgtagcgcagaaaacgagatgaattcgatcgatcgacgacgtgaggagagcaacacaagacgggattgtgattgaaattaattagtacagtagtatactcgctaattaataattgggttgcagtttgcacgtagggggaatctagatggtttaaatagttatttgaattgttaattttggtgtcaagtgtttgtttgcgcaggtaaatatatgcgtgtattggtcaatcgatcgagtcggcgtaaacatatttgtgcttggcatgtcgagggcaaacatgcaagcatgcaaccatcatatgacaacatcaagttatcgacatacatggtcacggtacaagatttttctatttgatcttgcaaatgattggatgatcgactttcaaaaaagaaggaaatgttgagaaatactacttaattcatctgggtcaacaatcaaccaaatgacaatcttttttttggcactaaatttgggttaggtatgagatctcacaaggtttcatcagtcttaaatctgctactaaaaacagcagtgttcatttgttcaaataaacagaaacactgtaacctactctaaactaacatagatatttgaacagaccctcacccacctccaaaacacacacagaaatgaagttgactttacatggtcaacatacagtggaaactttgatcacaacagtgttgtactaatcaggcaacgaattgatgcttcatcgtattttaaccccaaaattatctcgggggaatttctcaaacaaggactccaacttttgtcaggctcactcactctcgattgccacgcgattcgctggtagcaaatcgttccaagtatctgtttgccctcgcaagcaccaatgcatgcaatcatcatgcttcttccaaccagctgttgaaggatgagcatcagctccgaattcacacatcattcgagttatattcagaacactttaatttgaaagtagactttgaaagtagacttttcaagagccctcaccaagacatctgttagaataaatgggctaggcacaatttaattcaattaaaatctcaacagcccacaagtaatgttagagacaataatactgccttggaaatttaggtgaaagaacctcaacttaaatagggtaatattggggatttcctgttgaccggttgaggtgatggttggactgccacacgcatgcgcgcgcgccgagtcggcctcagccgttggcgtagcgaggcgaggcagccgaccgagccgagcctgctgctcttccgttttgtaatagacgagaataaagtcaccattaactaatgaaattcattgtgttgtaaactccataacaaacactacaagaggtatgtggctttttgacattttattatgtcataatatgtgaaatttatgtcaaaaattaagatttatgacaaacagttcataatttcaaacgtcaaaaagccaccgtcataaattcatcatgtgatgtttgtacattcattgtcacaagcatatgacattgctttattgtcacaaaatcttggggcttgccacatggcagctgacatagcagttgacatggttcaaaaaaaacgtcacaaaataagattcggcctgctgaagcccatgtagctcatgggccaaaaatatattttttctagggttgttgctagctggcccaacatattttttgcttgtttgtttgagtgcagcctatataaattttcggcccacaccaattcagcccatatgatttttccaacccgcataattcagcccatatgatttttccagcccccacaatttagcccatataattttttcagcccacaaaactcaactgatattttttcagcccatacaattcagcccagatacaatatttcagcacatacaaaatcaaattcaaatgaattaacattccacaaatgattgcaatgtcacatgcatttcacattccacaagtcttaaaatg

SEQ ID NO: 58022 - DNA, 4973 bp, Oryza sativa
cagcagagcaatggccaaaagcacagcagcaacagcacaacgaccaaaagcacagcaacaacaaaataacatcccacaagcacaatagtcgcaagttcagtgtcaccttatgttcatacgtattgctgcttcagcccgttcatctgccgcatggcaacgcgcccgacggcaacatccctaaggaggccgcagccactggcggcggacagccaggtgcggaggcgatgcacatggggcacaacggcatggccttccaggactggcatgacggcaaacaactggaggcaaggtcgatccaacgccgccagcaagctctgcacagtggttgtacagtgtatatgcattatgtccagcaaatgtgtacagtattgaacttaaaaaaactagtaatttgcccatgctaatgctacagtgacatttgttaatgcagcccaaacaattaaaaaagaacaggttttaacaatcgtaatatacataacaatagatatttttcccctctaggaattacaaccaaaatttcacatctaacaatccttgtaatttatctccaatctttaggtctttagctgtgagtccttgaattttcatgcatgtaattcttagatagttcaccttcttttacaaatgggctaaccatcccatcacccgttgacacatactctttgtccaaaaaaaatcccaatcatgagtttgaatctggacatagatttggttctttttatgataggagaagtaaagagtaaggaaggaacaatcacaacatgaaattcaaagccccaatagtaacctaatatgatatatcgaaagcgcaccaccaaaacaaaactccaacttacaaaattactcatgaacaatgtgttttttgctttttttttttcttatcacagtatcagttggcctaagaaacgataatttagacatcaataaattatccgatagactatagcacatactccctcgatatttcaaattaaagcaacttacttgcccacagttatcaaatacatcattagacctaacctaacagatgctcagcaccattagacctaacaacttgtctagaatacatatgcatgcttaaaaaatcatctaactactcacatagtttggtcggttcaccgaatgatgtcttcctatctgcatgccttgctctcttgttcatactcctccttccttgactgatgtatccattcctcctgtcagaaaggaaaaaaaaaacaatcataacatcctactcagaccatgtgttaattttccttttttcaatggacttgtcaattcgaagcttaattcctacaagcagctgatcatctgttaaatcctagtcaaatcaacaaaagaaacataagcccagcgagggaacaatagaaaccatgaaagggtgtttagtctcaccgctcatcaatttggtaggaaatattgctaaagttctaagaataagttgccctaaatcctaacaacatcttatcgcatcaaaattgctggtataaagactctgtttagcaagtttaggccttctttcaaaaatctgggtattaaatctgcctgcattctgaaacaaaaacatgctggcataatacagattaagattagtgcagaacctgcggatcttggagttgcacgtgttgccgagattcctaagcaggtcggctcgcatgcagaagacgatgtccctgagcgaaccctcctggcaacggtgcctgagttcccgaagcttcttgcgcagtagaggttggcgttgatggggtcccgcggtccagcatccgcgcggcatgcgcctcgtaggtgagagtgacgcgcatcatgttccgccagaacttgagccagtatgcagactgcacccgcggacggacccccacgcgcctccagaaaccccgaagcaggagcccgccggcacaaacggcgcggcagcgagctctggcgagctgctgcgtgctaatcaggcccagcgccgtagccgcacgccgtcgttgagccgcccggggactgccgccgcgcgatctagccgccctaggcccgggagcgctgtcggcggcagatccaccgctcccgagcctggcgccggcggagacggaggcggcgcagtaagcggtgaggggggagtaagccggcaccgcgagcggcgatggaggaggaggacgccgccgcacgctgtcatcgccgatacccaccgccggagaggagaggagaggagaggagaggggaatggatgggagaagtgtggcggctgagggtggagagatagagagagagaggaggggtggagagcagggttttatatggggctagggttagggacggcgatcagaaccattagatcgtagataggacggtcagaaatagttgggccatttgggccgaaacaggaatgatcttgtggtattttttagtttcaatttatgagaactttaaatgtaattttaggctgattttttgtttcaaatgaaaaaaatcataaacaaaaaaattgtagaactaatcgagatctgcgactattgtattggttctttttacaaataagttcatttgaacaatttaaattttgaattttcaaaatttgacaacttcgaataaaaattagggttaataaatgatttcaaatggaaaagtcaccaaaaccaaagctgtagaaatcatcgagatgaaaaggttttattttggtcatttctccatatgactctatttaaacaatttgaaatttgaaattcaaagtttgagaaattcaaatagaattttttattagtgaacgacttcaactgaaaaagtcatcaacaacaaagttgtataatctatctggatctacaatttttattttggtcatatcttcatctggcaaagtaatagtaacattgttcacaaaatttacaaatctctcttatagtttataacaccatataagagatatgtaaattttatgaacaatcatactatcaatttgtcggattaataaatgaccaaaataaaaattgtagatccagatagattatacaactttgttattgatgactttttcagttgaaatcatttaatatttgaaaatgttatttgaagttgtcataatttgaaattcaaattcaaattattgaaacaaagtcatatagcaaaatgagcaaaacataagttgtagatcatgataagatatacaactttgttgttgacaattttttcatttgaaatcatttaccacacaaaaaaatatttgaatttcttatattttaaaattcaaattttatatagatcaatcaaactcagatggagaaataaccaaaataaaattggtagatttcaataagttacacaactttgtttttgacaactttttcacataagtttgtttagtatgataaaattcgattcaaagttttaatattttgaaataaattgagaggagggaggcaaaatgaacttcttgactcgctaggagtgcggtatgggccaagtgggaaggttggaggcgtgttagattagtttctttagaagatataaacgtgatatataaaataatatgcaatatcaaacaaaacatcgtgtgcagcttagtgttttgcacaccaccactgaatcaggatctcgtgggttcgactcccagcgcccaacaatttttagctattttgctgagttaggcgcacgggttggcccattttgggtacgcggctgttgggctagcaccaggttggaccatctgaaaatgaataaaaaaactgatgtggcagtaaggctcgcctacatggataaaaatattgaaaatagtacaataaataatttgtgacccataaataggtcttatgacatagtaaatattgtcacgggacgacgttagactaactatatgacacttattgtgacacacaattttttattgtcattaagttgaagtgcttaaaataaaatgtcataaattagatgatatagtgacattatgacctatgtcatattaaatacgtcaaaaagccacacatatcttgtagtgaaatgagagatccattgtgttgtaacatccacaacaaatgagagatttatttgttgtaaccttcacaacaaatgaaagattcattgtgtggtaaccttcacaacaaataagatttattttatggtaaccttcacaacaaatgagatttatttgtgtgataatggagatctctctctatataaataacgcaaggtagaggctctcaatgagtgtgtctttctcctgctattgttcattggcgatactcttcttctgttcctacgctgtctctctttttcccggttctgttcatcccgcgcgcacgggtgatcggaacgagcaggtgcctccgaaactccgtccgcttgagaatctgcatgggtaggcgggcgatcaagtttttgggtagcgcttcaagcgcgactgctctgcatcatcttcaccaacatgtcgataaccggcgacaacaacaacactggagacaaggagaaggagcctcccgtcaacagcaacagaggcaatactacctcaaactccagcaaatggccattctcggggtataacgtttcactattaccgtttgttcttcgtttcttacagctgtcggtcgcaatattattgcgttctcttgtctatgttgatgcttattctatattaagcatgctcatgttgtacacatctaacaatgtcactagatctactcaaattacaaatatcatatttattgtcttaatattttggattaaaatatgccgaattatgaccaaattttcaacaatccaaaaacttgataggtctttttcgatacttggcttagctgcatcactaaaaccacatcctttcgatggttcaaattataaaagatggaaagcacgtgcacttttgtggttgacggcgatgcaatgtttctttgtttcacggggcaaaacgagtgaaccgcctctctcccctgaggaggaggctaagttcgaggctgcggattgcttgttccgtggagcattgatcagtgtgctccccgatagta

SEQ ID NO: 58023 - DNA, 1303 bp, Oryza sativa
  unsure (1)..(1303): unsure at all n locations
gtaattagctaatcgggggaaccatgatgccaagagacatgtggattcaatagggtggtgtcgaggagaacccccgggtttcatggcacagtatggtctgggacctaacctggtgttggtctgggacccctctcgttggcatatggtgaacctgtgtcggctttcgaaatgccttgtcatgaaagcctcaaggtctccagacgtggccgttctgcacgggctgggtgatccgagtgagtaatgtcgtgtgggtaaagtgtaccccctctgtagaggttattaaattgttcgaacagccgtgcccacggtcatgggcggatatgaggtgattcctagtatagttttgtttgactactgctttgtgagattgttgttgtggaatgggttcgatgtttggaaaatctgcggctgatgggatcagccaggcccgggtggccgtttgaaagctgttggccgggtgccagccttgatctattcaaagactgatacaatgcacatactccgaccggacgagacgcactgtctcctccgtgtcgttcgagaagcactcacttagttgtttcaaaaaggagtttaacaaaaatcattgcaaaaacaacagcctttcctttgaagcctgcattaaacacttaattcccatgacttgctgagtactcctgtactcatccttgctctatataaataaacccccccccccccccgttgctgaagaagatgaagtggatcccgctgatgaggagttcttcaggagcatgtcggcttcgatgagttttagggtttcggtctagttcccaagtcgcgcctgtgataagtggtttaagtcttaccttccgctttccctttttgtaatgcagttgtgagctcggaatctgtccgcaggctaacatgactgtactcttactctgtaataaaaagacttctgatgctgtgatatccatcttcctatagacctgcactattctctagtaaacgatcggtatacaggttatgtgagtcatcgcggactagttccgctcgggatagttaaaggcgtgacaggtgtccaattgtatcccgtcggattggagggtctatcttaagctcttgcctagttcatgagatnatcgagatcacacttatctcatatactgtgaatagcagtcggactcatcaatgcatcaacatacaatacatggtcaaaggacggtatttttctatttgctctcgcaaacgattggatgacaagataatcaaccatttgccaatcacaagttttcatcagtttttgtgagtttgagaggagagaaaaagagaagattgagaa

SEQ ID NO: 58024 - DNA, 16168 bp, Oryza sativa
tgaactaagcatggctaagcaatccctagtcctaactctaatcatgttagaaccccaagttgacaaagaaataaggtacaacaatagcatggctacgacattaggtaaacaacccatagtaacattataaaacaatgcaatatttgaaagaaaacaatagagcatttgcaatataggatcaacatgttcaagtggcaagcatgacttgccttgctctgctgctggaggaacctcggcgactatctcgaagtacaccggagcgtcggaggaatcggaatctagcgacatacaaagaaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaatataatccagggctgacgtcatcaaggcggggcgcggcgccgacatgcgggccccaccggtcagcggctcggggagggaggaagggcgccgacaagcgggccccaccggtcagcggctcggggagggcggtccacggcggatcaggtccacggaccggggaggagcggcgcgccacgcggcggccgaaccgatggccccgatctacccaagggtagatcggacggcggcgggagctcgcggccggtgcgcgtgggcacggcgcaaaccggcccggcgaccatggcgcgcgacggcgcggcgcacatgcggcagcggcgcaagacggcggccgacgacgaccgaccggcgacggagagcggcggctagaagtgaaacggcagctacgcggctaagcggcggcgcgacggctaaacggtgcgggagagagagaaagaggaggagaggcctcaccgacaacggtcgacgacggcggccgacggaggacgatggcgacggcgggacgagctccggaacctcctaacgaacaaaaggagaggggttagagggagagaggagagtgcgagagagcgagggcgccggccgaaggcggcggccatggcgtcactcaccggcgcacgacggggatggggctccggcggcgaacctcgacggaggaggggtggacgaggtggacctcggccgcgcgaacccaacggcggcgacggcgcaatgcggcggcgagcctagcggcggctagcggcggccggagtagcggagacggcggcggcgggtggttgcacggcgcgggagcgatggagagcacgagggagttcggcgaaatggggaaaaagcgagagggggcgacggggaagcttaaataggggaggggagggctggacgtggccgggagaggcgggatttcgccggccaacgtggggaaagagagagaggagagagaggcgggattcgaaaatcaaatcccggccatctcgggcgcgggcgcgagcgggagagagaggggagtgggcgcggggaacgcggcgcacgcgcgggcgtggtcgacgtggcccagaggaggcggaggcgtggacgcggcggcggttgcgggcgcggcatcggccggaggtgggggaaggacccgacaggtgggccccacctgtcggcgaccccgggagaggaggacggcggggcggcctggctgggcctcggcctgcggccggcccagcagggaggagggggaggaaggagagaatgggccggcggcccattcgaaaaaaaagaggaaaaagagaggaaaaagaaaaagaaaaaggaaaaaggattttccctggaattaaaatattgcttgctcaattttaattggttaaaattatttctagaggtctgaaaattccactaaaaatcctgttaatgaatttcgacatgtagaactcaagaaaaattccacatgccaaatccgattattatttgcattactttcttagggttttctcttgatttgcacctgcattttcttggggttgttttaaaaattaaatttggcttgggaggggaacttcggggtgtgacaggtatacaccttaatgtgatctgagtggcttttcataaagcagagatgttatcctatagaacatcttagaaggaacacacctatatgagtccgactgctagtcacagtctatgagatttgggtgatctctagatactcatgaaaagtccaggagtataacttatacgctccaaacagaggggatgcaaatggcaacccagtaccagttaagggtttgagtgaaacctgaatcgcacaagactgacaattcaaggcatagtccattgttcagttgtgatttggtgtagctcttttcctaggtggaagttgaacttaacagtctccatcgaaacactggtataactaataggttcagtttggagaacatttcttgtgagccatgaaatctggtggggattgttggaataaatgggctaggcccaatttaattcaattaaaatctcaatagcccacaagtaatgttagagacaataatactgccttagaaatttaggcggcagaacctcaacttaaatagggtgatattggggatttcctgttgaccggttgaggtgatggttagactgccacacgcatgcacgcgcgccgagtcggcctcagccgttggcgtagcgaggcgaggcggccgatcgagccgagcctgcctgctgctcttccgttttgtaatagacgagaataaagtcaccattaacaaatgaaattcattgtgttgtaacctccacaataaatgagagatccattgttttgtaacatctgcaacaaatgagagatttatttgttgtaaccttcacaacaaatgaaagattcattgtgtggtaaccttcacaacaaatgagatttattttgtggtaaccttcataacaaatgagatttatttgtgtggtaatagagatctctctctatataaataactcaaggtagaggctctcaatgagtgtgtctttctcctgctattgttccttggcgatactcttcttctgttcctgcgttgtctctctgtttccccggttctgttcatcccgcgcgcacgggtgatcggaacgagcaggtgcctccgaaactccgtccgcttgaaaacctgcacgggtaggccagcgatcaagtttttgggtagcgcttcaagcgcgactgctctgcatcatcttcaccaatatgtcgataaccggcgataacaataacactggagacaaggagaaggagcctcctgttaacaccaacggaggcaatactgcctcaaactccagcgaagggccattctcggggtataacgtttcactattaccgttcgttcttcgtttcctatagctgttggtcgcaatattattgcattctcttgtctatattgatgcttattctatattaagtatgctcatgttgtatacatataacaatgtcactagatctactcaaattacaaatgtcatatttattgtcttaatattttggattaaaatatatcgaattgtaaccaaatttccaacagcacttggtgctggtttaccaagcgtgcttctacgttgtttgtgcgatttttgtccaaagagaaaagttcctcgacctgaacaaggttgagctcaaggtattaatatcgaatttccaggttctcaaacccctataggtgatatttgcctattcggacaaataaaaaaaggaataatatgtctgcaatgcagaacaattaaccaccattcaatcatcttcgtaaccgaacgctggttagcagaagactattctcccaacatagaaaaaaaaatcaataaactaccagtcaatacatatttatgggagacgattacacaaagcacgatcgttgtttgttcagtttttcttttctatcttttttacattccctcacacccccccccctgttctatcctttgtttcttttttcatttttattttttttactttgtaagcttctctatttatcaatgaaaactagctacaagcacttaagcatcgtttgcaagagctggttcccaacactaccatcattttccgcgcgcacgtttttcaaactactaaacggtgcgtttttttataaaaagtttatacacaaaagttgcttaaaaaatcatattgatccattttaaaaaaaatagcaaatacttaattaattatgtgctaatggactgctccgttttccgtaaatactgtttgggttgggaacccaaacttgcgaacagagccttatagatcagtcactagtatatctatttaatattagactcggtttgtcatatattttacgcagagtatgatggttcaaacgggtctaaaagataatatatagttaaaaagtataagtcatcaaagattctaaataataaaaactccattttaaggataagatttaaactcgacggaaagattatggacattgaggatgtttagattggtgccattttaaattatacccttttttgataaaattgacaaaaaaatatagatgtatatattaatttagtttgttaccaaacatttgtaatacataagaatctattatattattaagacagctttaaaaagagacaccatgtttactgtggacgcaagaaattcccatattaatcgaagaaaaagaaaagaagagtccaagtagaaatacaaattacaaataaatgaaattcgaaattaaaaataatcaatattaaaagaaaagtccatgtaaggactcaatacgagattaattaaaatttagaagaaaattaaataaaatctgaaataaaaaataaaagaagagttcaggtaggaatacaatttaaaaataactaaaattcggaatttaaataagcaatattgaaagaagagtccatataagaactcaatatgagattaattaaaatttaaaataaaaataaaacaaaatcaaaaaatatctctactacttaaaaaattgaagatgattccgtcgtccgtccgtgaaaaaaagggcgaaaaaaaatcaaatatcaaataaaaagatagggcgaaaaaaaaatccgattccccgtgagccttaatatgagtcagcatcatatttggacccaaatcctagagaaaacactagtacaagaacacaagaacagcatcaacacaaacacaagaagaaaacgcgacaccggaaggggagggtgctgccgtcgccgggccaccaccacctcccctcccttcccactagatccagcggagggaagggtgccgccgccgccgtcgcctcccttcccgttggatccgacggaggggagggcgtcgcccctgcccaccgcctcccttcccgccggaagggagggcgttgccgcctgccgcctcccgtggctccatggcgagaaagaggaggcgaggggcagagaggcgctgaggtcgcgggtagagagaggagagaggaggcggggtgtcgcgggaggcgaagagaacgagagagaggataagggagatagagagagagaggaggggcggtgtggttcggtttatacgggcagtttttttttaatatgtgctattttggcggtgtggttcggtttagttggccggtttttttaatatgtgttatttttttaataaaatcaacacctataatataaatataggtgtcagtttttaaaaaattgacctactactctgtaaaaaaaactcaatggacttttttctttttgaaccattttaatgcacccggagttttgtatgtctcagcaagaagagaacaaatctaccatctgaatagtcgatacatataacaacttaacaaacgatatgcataatttgcacactaatttgtacacctatggaaaaagcatttatcgataatccataaatgtttgaggtgattttccattcatgcatgcatccatgaatctcattgactaggcgtgaacagagaaaacatgtgcaatcaaaatctataaatgtaatggatacatgttctaagtgggttgatggtctaattaatgataggaaatgttaaataatatagctagggcacttgaccctgtttttcctatgctaacataatttgagcgcacacttttaaacaccttaatcggatatgatccatttgaatggttgtactctagctttacacttaaatcaggccaaccattagagaaccctcttaagcatatcatataatcctataaacaggatatttatatatgctgatcactatgttctatcggagtataaatagagcatgaaaattctaatttatatccatgaaacaggcattcgtttaggattaatgaaacagattttcatatgtaggctaataaagtttttccaatttttatctaatttcagttgctttttcatttacattattagttttagcactatttgatccactaaaaattattgtaacttatattttctctatagtaaattatttgtagctaaatttgaaaatatgattaagttatataactttcctgatattgaattatcgttccgaacaaagttatctgtagtttcatattgttatttatatgtttatatttccttcatcattttatgtccaactatataatatatgatttaggattttaatttatgtcaatgaatattatttagaacccgttacaacgcatgggtattattgattttttactagtaagaaaataaaataaaacccggaattttaaaaaagagttcaagtagaaatataatttaaaaacatgtaggattcaatgctcagagaatgtctgctactgctacccttgcccaacaactgttttcattcccagatttgttgctgttttacaagtatagtcaagaacctctccaacacctcgaaggatgttgtttggaaatcagacaatcttcaacttcaaggttaaccttcctagattaacttgggagaggagggatgggtgaaatattgttgacatcccattcttctgaataagtactatagtttttagaggatggaacagcagaaagcatatctattgcacttgtaactaatgtgaacgatcctgtaaagtgtaaatcatgtgttggtactgttatatctgccgctctaagtgaatctgattattcaatgggttttgtgtctgtaatttttgtatgtaaatcagtacagtagtaaagaaatcagtacagtagtaaagaagaaccgtatgagcgcaattggtcaacattcatgttcatttacattggtatatacggtagtaaagaagaaacatatgtgcacaacatcaggaaaaccaacaagactaagaggaaaactaaccagactaaggaaagattactgttgtgctgacgaaagaatcaacaaatttagactaagagaaactccgtagaacagaaggcacggaggaaatcctaatcggcaaaatgcgttattcacttgctcagactctgcccttcttgtgataatctcgggcctccccagctcttggccgccttgtgtgtcgtcgccctccactcgtcgtctcttttcttggcgatcaccggcggcgcaccgctgaccgtgctgcctgacgaatcaaagggctaagaaaggtccttaaaggtcgatcttgtagggatagctctaaaagatcattgtgtcagccctcgttggctaatgtttcttgtttttggttcttggacgagctcaccgccggctgccatgcccggggccccttacttgcggacgtctggctccctccttgcaccgtgatcgcctcctctctccctccttgcaccgtgatcgcctcccctctgtccctccgagccgggtcggttgctccctcgtccgcgagagtcaccggccttaactgtcgccggcaatggccactaccctttaactttttttttgctacgggcgctgcaaactattgctacagacgttgcgaactatcgccgccaacgagtgctttctacgctttctctctcgccactgccttcctctctcttttccaaaccgttacagaacttgtaacaagaagaggaagattgctctttttagctcctatcctgcttatttgcttctcttctgctattaaatgtaagagtcgttttttttctggaaggcccttatttttatacaaaactagaaaaaaaacaagtgtatgtattatttttaattcgtacattttgtatctactatttagagatgatctaaaacgcaaaatttattaagaaactaaaaaatcggcgtgccgttggcacccttgctagtcaatatatatacacacacacacttatcactcaaaaatactacatgataaaattgatgtgtttttttaatttaaaatatgtaaatacttattttattatttaaaattttagagttttcataaaatattttagaaagaaaattattaaccaatattttagttttgacaaatagatatatgatattaaaaaacatttatagatgcatgtataaatgatttatttattatatatagaagtgaaaaacatatttatcataaaaaatttagaatttgtatgacatgctaagcaaaagtaccaaatttaatgtgtcatttattacataaattttgatgaaatccaaacaagtaaaataaattttgagattcatcaaaattaattggttcaaatatattttctaatagatttgaatttttgaaagattaatcatttagtatatttagagttttttttaacatatcatgtgtaacaaaaaaaacacaatcattttattgactgaggaggtattgatgatcctattacgtgatataagaaaacaaggttgtcttctttctttgtttgttttggattttttttttctttccataataactttggatttactatatattctagagtagtaggagtagtaccgagtagtcgtaggatatttaaagaaggaaaatgaatgtaaatttgttgttttagattttttttcttaataattttaggtttactatatatattttagagttgtaggagtagtatcgagtagatgtggtatatttatagaaggcaaatgagtagaagttcatgtggttggaaatggaagatagttttggaagcctctagaatccatatgtgatatttttctctagatttttcctcacatatgattgttagatgttttttctctagtataaatttagatttttcttcaaagtaagaggtgccaagtggaccaatcaaaagctagcaaaagagtcaactttagattattagactagtccaatacttttttttataaacattagacctttcaaagtattattttgagtgaaatacccgtttgttccttaaagttgcatggtgatgtcacttacattcctgattttataaaatacttcctccgttccataattcttgatcttttcgataaggttgaggtcaatattttggaattttgactataaataactttgaaaatatttagtttgaaggcactaaaacaaaaatatatatgttagtcttaaaaggtactataataaaagtaaatatttatttatttattttatatattataatataaaactatagttaaatatatattctgaagaccatatcattgtccaaaacatcaagaattagagatctggagaaagtaagtccataatgttggttcaatatatgactgcaggtccaaatctcctttcgattgggtacgactgcctacgtggcgctccatgatggtacacattttgcatttgtccttctaggcaggagtatacgttgcaaaaaagtgtgggcagtgaacagcagcggtgaagccgatggagctatgtacataagagaatcccgtgccacgatgaggacctcaagctcagtcgtcagcggatcttgcaaccctgagctctagcactaccagatcaccgatgctagatcttgaggaaagcaggggaggacccttgacgtagacgcaaccagaacaatagcgcttgacagctagctctgcctctaagctttgatggggcggatccagggtaatgccgaggtcaccttcgcaccgcatgagccgatagccgtcaccagatgcaccacgcccgagcaccaggctcactggatgtggagcttgtgaccatcaatatcgcctttgcgccgcgcaccaccaccggatgtgtgcacggaggggagggtgcaccagtgaggaaggaggagaggaaggctgcgagatgcatggagggcagagcttcacaccagagaagctcatcacagccccatccctgagctctgcaccggccaccccatacattggtggtgacaggaccatctcatcacttgctcatccacagcacccaaccattgctgtcgtcgccaagcgtggacgtggtcagatccactgtcggtgttcactgcctacccttttgtgcaacttgttctcataccaagggggccgaatgcaaaatttaagccaacgtggagcatcacatcggcaatcgtacacggttaaaaggggttcggaccttgtatgatacccaatattattatctaaatatgcattttataagatcgtggatctaagtgacaccatcatgcaaccttaaggacatgccatgtattttactatattattttagtatattttcagctttatgttaattattgtcaaaatacgaatctaattatacaacttcatatgaaaaataaattatttttaaaaaatatatatcaaatcttagtattaaagctaaaactaaccattaattttgaatccattgtaatttttatggaactttagcatacctcctccgttttatattataaaatgtttcaatggttcttttaagttaaacttttataagtctaataaagtttatataaaaaatgtaataataatttcaatccaaagcaaacatgctatcaaaatatttaatgttggatttaattaaactaatttgatattgtaaatgttactaaacttttctataaatttgattaaactttaagaagtttgattaagaaaaaagtcagaacgaatgttgctaaagtgagttttgaaatatgaatgacttttgtcaatattttggcagtgtgatcagttattcaaattagaacttttgtttttgagatgtcatattggaactaagttaccagttaccacttatcagcaattgaccgagatattgtgtttgtttgcatcctccggactgataatacttgttgtttgagataagagtgaggtcaaactttatgatctttgattatgagccatttttaaaatatctgtctttcagatatggtgatacctgtataggttagtcttaaaaaatattttaataaaatatatatctattacttcctccgtttcacagtgtaagtcattctagcattttctatattcatatagatgttaatgaatctagatagatatatacgtctatattcattaacatcaatatgaatgtggaaaatgttggaacgatttacattatgaaacggaaggagtaatacttttatatatattataatagaaaataatggttaaagttattttttttataagaccgcatccttattaaaaagaccagtattatcaaatccagaggaagtagattaatgcgccgcttgcccccagaattaacgaattgggctttgaatctaggaggaaagggcctgcccgtctccgtcgaccaccacgcgcacctggttaatttggttcgccggcgccggcgtgccgcgaccccggccgcaacgccccgggcgccaattccgcccaccagatcacaggctgcgcaactggtgactccgccatcgcgcgcggacggggacggctgcggcaagaacgcaaaaggagaagcacggcgacagagaggagcaccgtcacacaatcggagtcggaggcaaagccaaacgaatccggatcggcgggcctttcttatacaatctctatataatttcacggggatttgcctgccggcatggcactcactacgatcacatcgcttcactgcgtagttggctagtagtccctccttctctaaatgtttaacatcgttgacttttttaaacatgtttgactgttcattttattaaaaacttttatgatatgtgtaaaactatatgtatacataaaagtatatttaacaataaatcaaatgatagaaaaagaattaataattacttaaattttttgaataagacgaacggtcaaacatttttaaaaaaatcaatagcgtcaaacattttaggatggagggagtattaatttgacaagggaacacaagctcgatctgctcagctagcgtcgactcgacgacgatggcgtcggtcgtggtgcgacctcccgtcggatctgttgggcctcgtcatcgcacgcctccccttccccgccgaaccgcgcgcgcctccgcgccgtgtgcaggccgtggcaatccgccgtccgcctccacgtcgcctccccgccgcagctcccgtggatcgctctctcccccaggccgcccgtcgccacacccacccacgccggcgagaacaacgttgttaacaccgtctgcgttggctccaccgacggatggcgcgccctgcaccacaccgccaccgccggcggcgggacgaaaaccaagaggcacacgttcttcttgcacaaccctttcaccaccaccaccgtcccgctcgccgagctagaggacgtcctcgacgacgctttcttaaagcagaacgaggtccgcaaggtgatcatccggtcctcctcctgctgccccgatggggaccacctcgtcgccatcatgaccgaccactataacttccctttgatcctgtgccggccagggaagggcacctggacgcccgactcatgcacgatgccattcgtccgcgtcatcgatattgccttcttcaaggacaagctctatctaattacaacagccgaggacctcttcgctgtcgacctcgccgccgatgaacacggcaagcccaccgtcaccaacgtcgagcgcatcatcagacaaccgagaagccccgatggcatgatcgacgcatttaggtggagtgacgacgaagacgacgacgacgacggcgacgcacgagaggatgacggtgacgcatcgtcgaccaatgacgacggggagtactcctccctcaatgatgagggggtagtagatggtgaggaccatgacgaggtattgaaccaagagggtggagacaacaacagcgacggcgacggcgaaattgagcccgtcactgatgacgatgacatcgacgacgttggccagcagtggtgccccacttgggagcatagaaagtttgagcaattctacgaggaggagtacgcgattgtcggcacctagcacctcttggagtcgtgtgaccggttgcacatggtgagacgggagtgggtactcccgttcatcttgcagaccgaccacacccgcaagctggacgccggaacatgggttccggtcaccggcggcctaggtggccaagcaatcttcctcagtgaactcttcagcaagtccgtgcctgcgcctgcacacggtgaggttgaaaaggacatggtttattttgttgatacatacgacgtgtgggacatgaaatccggcactaggaggccgtttaggtgagtcgataaggacatgacgcggcccacatgggtgtttcctcccaagttgatcgtgtaatgaatgtggaacaagggaaagaaatttaatggagagcaccacgcgtcggacgtacggcgtgagacaaaaaaatcggacgcctcgtgcgaccgtccgatccatgaacacgtgcgtcagccatccatcatgcatggatcaaacaaattttaaactacttttctcttaaaatatttatccaaatcatgatctgattgcaccattaaatccgttgcaattaaatctttaaaacaagaccacacatgaatataatccgatgaaaaaaaaatagcttattattgaattatttttaaatggtgcacgctgttgcgctaagtatatcggaattgtttcactgagtagatcgaaaatgttttatcagacgttgtttcgccttatatgaaaataatgtttcagcgaatagcgaaaggatgttttaattcactgtaacatttgattcatacatagtgaaacatcacgagtacattaggtgaaatatatttaaattgaaaaaaaatcggacggtaaaatgttgccgttgactaacaagtgaaatattatgttatatatttggtgaaacaaaaaaaattagcaactggaacatttaaatattttatgaaacatggtgaagatacacgttgaaacatgtcgctgtcacacatgaaacaacaagaattaacggattgaaacacatgtttttcttttatcaaaatataatcaagcgatatcttgttgtatagatttaattacaataaatacaatggtgtgatcggatcatagattggataggtaatttaagagaaaaatcattttgaagcttgctaaaatacatgcatgtatgcatgcatgaggtggagagagtgtcgtagaaggtagtttcaagaattttgtgaaacacacttaagacacatattgaaacatatcactattatgtatgaaacattttgttttaacggtttcaaacatatgtttttcttttgacataatataatcatgtgatatcttgttgtaaagatttaattgcaacgaatacaacggtgtgatcggttcgtagatcggataagtaatttaggagaaaaaatatttaaagagaggaggaaagaatgaaaagaaacaactagacatgtgcatgtatgttacactacgacaatggttcgtccaatccaccagacagctgatttgcagtattttcctgacgccaacagagagaaaggataaattagcaagtagggactgagctgaccttaggcgtccgatatttttcatctgatcggatgttcgaagagaagcatttttgaaatttaatccgtgtaaatgcttacacgatacatgatgaaagggggtagaattagatatttgctattatttattcaatagatggaaaatgctgggatcggcgccagatcacccctagaaaaatcgggcgcaggcctcccgggcctccgcaccgtccccaccacgcgcccaccacatgcgccattcaacaaattacccacatattatggaaatgctctactaaggaaatccatttcaatttttgttccactaacaatatttcagcaagtgtaatcgtgatgtttcactatgtatagatcaaatgttgcagtgaattgaaacccacatattatgcaaacgctctgttaagataatccgtttcaatttttgttccaccaataatgtttcagcaagtgtacttgtgatgtttcactatgtatagatcaaattaattaattgttatgcgtgtttgtaccatgtcgcatgtctgtccagatttatagtattagaatatgcgacgcatctaaaatcgggcgttcacgtcatcatgcatgcatacatgcaagcaaaactttctaagcgaagctatttttttctcttaaattatttatccaaatcatgatccgattgtaccattaaatccgttgtaattaaatctttaaaacaagaccacacatggatataatccgatgaaaaaaaatatttagcttatttttgaattatttttaaatgttgcacgttgttccaccaaatagatcggaattgtttcactaagtagattgaaaatgtttcaatcgtttaaaaagctgaaacacaaccaaatcacctcatgaaacattttgctacaacgtatgaaacaacggtttctcaaaaaatcgggtattgtttcaccttatataagaaaatgttttagcaaatagcgaaagaatgtttcaattcactgcagcatttgatctatacatatgaaatattacgagtatatttgctgaaacattgttggtataacaaaattgaaacggattccctaatagagcgtttccgtaatatgtgggggatttgttgcaacagagtgtgagtggtgaggacacgtgggaggcaggctgagacgcgcgtagggggagggcgccctttttttcgtggaggcacgtgtggggggagggcgttgtagcgtccgttccgtcgtggcgcctagcgggaaaactaaatcttaaaaaccctatttgcggaagtcgtttctttgcttgatgtctctgtgcgtgccaatctccatcttgaatcccctatccatcgtcaaattcaaattccaaatctcaaattcctcccaattcaaatccctctgtaaaagtctagtttgctctccctaaggtttggtgggc

SEQ ID NO: 58025 - DNA, 1914 bp, Oryza sativa
gccatgtctctctctcgttctctcgctctccctctccccgcctccatccccgtcgagctccccgcccgcgattttcgaatcctccgcgcatcgttgtttcgcgcgcgcgcgcccacgtggtgccgcggtcgtcgccgtcgcctgccgcccgtgccgcgcctgcgccgcctggcccctcgcccctgccacactgcgccacctgcgccgcgccctgccccgcgagccagcgcacatgcccgagccgcgccacccgcatccgtccaaaacctggaggcagagctcccgctcccatccctctccctccccaactcggcaaagtttgagccctctttctcccccctctgtttcccgctttcctctttcggcccggcctctgccctccctccgcttggagctagcgccatggaagaggagcgcctggcgccggtgccagcccgttgcccgcgtttgaccgcgcccgtgagcacccgttccttcccctcgaagctccatcctgcgcctataagagtcgccctacccctctctcatttggttccattcactcgagctcgccgcgccattgccgctcccttgccctgttttgctgtcgccgtccgttgccgagtgtgccggaggagtaggcgcgttcgtggacacgtgacgtggactccaggcgctcgtcttcctcctcttccccggcccgaggccgaaatgatcacgtttcgcgccgtcggctctcgtcactgcgcccttcaccgtcgcggtagtgcatctccccattccccttcctcgttcctcctcctcccccagctttcggcagtagcatgtgtagacctcttgtagctagctggcgccgccccgaccgctgccgctgtttgttgtgtgctcgccgccgtcgtcgcccgagttcagtagacgcctctcgtcgccggccttcctcggtgtgtttcctcctaatccgacgctaggaatggtttcccggagtcgcgtagatgctctagtgcgtaggaatcgatcccccgtcgcgtcgtcgccgtttccctctcatctcgccgccggtggctgccgccgcaatccgccgccgtcgagccccctccggcaaatccgagctgttggctcgtctcccctcgtcccatgaaacctcccggtgtgcttgcccttgcctgcgtcgctgcgcttcgccccgaacgccgccgctaccgtccgccgtccgttcacggccgcgtcgtcgtcttcctcccgccggcccgcgtggcagccacgtaggcgccacgtcggcgccagctcggccggaccgggtcaagccgaccccggtcagccgctccctccgtccccgctcgcgtgtgcgcggcccacggagagccgagaggctatgcgtgggcccgccgcgcgcgtacactgcgcccctcttccaaaccctagcgtcgcgtcgcgtgcttcctcggcacggtgagccgagccgccgacaagcgggtcccactcgggaccgcgcgaggtggacccggcccaacggctccccctccctctctcccccgcgcgtgcctttgggccgccttcaagggccggccagcccattagctcggccgagccgcgccccttctctcgggtcgcgccctagctgcccgagggaagtctaatacccctccctcctccctttctttttcaaaaaggatttaattaaatccttttccctttagacaaaaatccaataatcgtagaaattcaatatcttctcaaccgtacatccgtttgactccgttcaacttccaaaaatttctcaaatctcgagatctatctaatggcatgcttagaggtcaataatagggctttattttcgccgtttgttgagttgtcccatttcgcgtgtagttttggagcctgaagacccgcagtgcgaggatttcgagtatcaagctcaagatgggctgcaggaat

SEQ ID NO: 58026 - DNA, 6117 bp, Oryza sativa
  unsure (1)..(6117): unsure at all n locations
tttgtctagttatacacttgctggatttattacattagttgatcatggaaattttacatgcatcctactccctccgtcccatagtataagggatattgagtttttatttgtattgtttgaccactcgtcttattcaaaaaatttgtgcaaatataaaaactaaaaagttgtgcttaaagtattttggataataaagtaagttacggaaaaataaataataattctaatttttcttaataagacgagtggtcaaacaatacaagaaaaactcaaaatcacttatattatgggacggagggagtacgtatttattcaacatttcacgagtatgaatacaggtggcagtgttgtttcttctttctaaaaaaaataatacagacatatgttcatacacactcgcacaaacttataaatgcacatgcttatagcctacttttatgagcacattctaatattgggttagcatatattaagttcgatgaagttatcaccagcgtctttactgttgatgtgtgcgtcgtccacatctaaaaactaattaaagtaaatgcaagataaattttgctacatgagattgacttcggggttttagctgtagaacaccgtacaaatgaacctttggagaaagtcactcttgaaaattggatatttgttgataaacaccgtacatattaaaatatttatttccgattgaataggacatagaaatcgtgtgataagttagaaatatccttgggcccacatttcagctctcccatctctcttctctcctctctatcccttcgtcctctcccaatgatcactgccactaccttgtcatccctatccaaggcagcctccttgtatctctctgcccgtcaacctacgcggatccccttcctatgtagactgccactgtccaaagaccatcaacatccccgagaacctcctggccccctccccgtccaaatcgacgcctcccaatgaccaatgccaccaccctatcatctccatctcctctctctctctctctagatctggtgcttaggaaagctcatgtcatcatggactcctcgaccgccgccgcggcatgtggagggagaaggagaggtggtgccgtatcaacaacagtagtagtttcagggccggtcttggggttttggggccctagggcaaaaacttataaacacgtagcatttaatattcgatgtgataaaattatccatatataacattttaaaacttcaaagagaaataaatatcagtagtgagcagaaagacgaccgacggatgatcgacacgagcgtggctactggcgagccgtgatttgctgacttgatgtttccgtttacgagacgccgagaagtcgagaagtcgtcgagagcgcaggagtagcgagcggcgtgacgtgatcgagacggcacaacgcgagtggtgtgatgtgatcaaggcgaagtgacgtaagtcaaatgaagatcgcttcagcttcgctgaaacaggcttgacgatggactaaaatttattttctgtattaggctattcaattgtctaacttaatatagacccatggcccatgaactagaattatacaatacgtagtatatatactatatgtgtataggggccccctagattttgaggggcctcgggcggccgcacggcctgaacccccccccccagggctggccttgagtagcttgaaatgtggctttgctcggggcccaacgtggcttgtgtggtcggcaagcatggtgtcgcatgatcgttagtgtggtgaagggtgaccgatagcgtggtgagggaggagaggggatatagtgaaagagagatgggatagctgacacgtcagcctaagggtatttatgacatttcacattatttctctcttctattcaactgaaaataaatattttaatgggtgtgatgtttagcagtaaatatccaacttttgatagtgttttccccaaaggttcacttaagcgatgtcctatagctaaaaatgcaaatgccatgtaataaattaagtttacctaaattcaaacacccatgctaaatcaaatcttgaacttgaatgtgggtgggcaagtttcacctggaagaaacctagccatctacacttaattcacatttgcgtaatattgctagttgacttagcctcttcatacattttcagactatgtttacggcggtcgctactactatcagtgttatcatcaatgcataaaatgacgaacatctgatttggtagtaatgattatttcaatacccctattaataaattcatatgaatagaccaggatcagaccagagagataactcaaaataaattaactcctgctaactttcttctaatatatatatatatatatatatatatatatatgaattgagtttggcctagttcaagacataacattttagcacatgattaattgagtattaattattacaaattttaaaataagtttttttaaaaaaacttttacataatatttttttttgaaaaaacacaacagttaaccgtttgaaaatggggttaaatcgagcattggagaacgtttatagacatgccaacagggtttacatgtacggtaaccttatctgtttttgaaaccacgatatacctcgtggtaatcgcgcggttatcatgggtggcggtaaccccacccaaaatagtttggtgaattctgcatgtcagtgtgacacgaacgccacacgctcgtactgcgttgaaccaacggcagaaaagtttttaggtagcccagtaagggcatctacaaccaaagacactctatggggcattataaccaaagacactctatgggtgccctcactaaccgaagccactccgtgggacacctatctcccaatgaagcatactcgtacctgggttcttcaaaatctcaagcaaccaggtgaaggtactccaacccaatgggtaatcccaacccataaagctacaagtgttgtttttctcttttacccctctcttcaaactaaggaatttgaagacacgaagcattcagaatacatgaatatattcaacacaggaattttcaatcaagggtaacctcatatattataatccaattaagcaatagaatactatatattttctatctcactactctcaagtactactctctgctccctccgtcccataaaaaaccaacttaatattggatgtgacacatcctagtactacgaatctggatatacatatatccagattcatcgtactagaatatgtcacatccgatcctagattcgttttttatggacggagggagtagacaggaaagccttatcttatcctcctcattcatcgggtcattcaccgtatcatgtcccccccccccccaaaatcttccagaggcatcgagagcagcaaaccatcaaaatcaacagggatggctgagcgagcttgcgcgcgcggccgagctgggtaccgggcggagaaagcgaggcggcagtcagccgacgagctcgcatgggcgcacggtaggagcgagctgccaccatggccagcacaagctcgagctgcggggtttgcgactttgccccaccgcgccaccgccgattctgccacacagcgccgctcgtgagctccctccgctctctctccctctctctctctctcccgtcgcctctctctcgctgctgcccgtcgtcgccgccgacggagagcaggcgctgccggcagctggaggcgacagtccagcgccgtcgtgcgctgatctggccccctcgcggccagatcggatggaggggcgccggtgaaggttgtcgcgtaggtcgtcgccggcatcgtctccgccgctcgtctccctctccctctcgccgccgacgcttacctttctcccgccgctcgtcaatctctctccctctctctctcccgtcgcaagcggccgtgagggcgatgaggagggtcgccgccgccgccggagccatgccgttgctggtggaaggggacgagggtggaaggagaaaaaccggaggacagagcggtgtccttgggctactcccccacccaacgcgcctcctctatcaatctcccaatccaggcactcgtagagccgcgcccctctactaggggcgcgcgcttttgctggggccaggggcggagctaggtgtatcaagggggtgcccaggaacccggttcagaaatttttttagctatagtttatcaattttcaccatatatacacctcctcgattcaaacttaggcacccgtatcaagctaaactcaatctaaaatagactaaaatatatgagtggaaccccctcaatttcgttctacctccgcccctggctggggcacggcacggcgtgaaaaagggacgaggacggacgacgtgagccagggacacggcctggagagccgcgttgaacatgccctaactgtaaatacacatgacgatacagcgccccggaggaggagcagcaacacgagtacagtaaaaacgcgcatgtgcattgtgcacgcgagggggcgtggcggcgacgcacgggtacggtgcgtgcgggctccaccgcggcagcgacgggtcggaacctgacaacatgtgtgttgccccggaccacgcgcgacccccccttccaaacccgtcgcgtcaccctttttcccccggcctgtcggtgggacccacctgggcatcgcattgatcgatccttttttttttcttcttcccctacgacgtcgctcgcccaagtggaaagccgaggaaaccttgtcggtcacgagccccttttttacatgtttggactctgtaggctgtcggctgtgtagcagtagcttctttccgccgcgtatcgtatcgatgtccgaaagaacatcgaacggacgttttcagtgaacaaatcgatcgaatgctacgcctactcctagccgaatactccctccgcccaaaaaaaaaaaaaaaagaaaaccattcctatcatcgcaagataaatttagtgaggagtgaaaatgaccaaaatgacctttatcattgaaaaaagtagtaatggtaattggtagataaagggtatctaaggaataaaacatctcattttatatattgaagataggtaggataatagaagttgattttgtgtggaagaaaatttaaactctataagttaagttttttttttaaacggagagagtaggggtgtgtttagttcacgctaaaattgaaagtttgattgaaattggaacgatgtgatggaaaagttggaaatttatatgtgtaggaaagttttgatgtaatagaaaaattaaaagtttgaagaaaaagttagaaactgaaccaggcttaaaagtgcatatgtacgcaccaaaaccgagccagccgtccaagccttattacagtcgtaacaggtcaaattgtttttaaagtcgtaccccctctcctaaaaacccaaaggaaaaacgtttgaattatacccttagtctactgagtaagtacgaattataccctatacctaaaaatcagacatatttcattcttaattattacttaacaccagacaaattaccttctaatttaaataggagtggttttaattctacgtgacagtgtagtaaaaaaatataaaaacttagtactcgatcttgtctagattctaacatctaaacaaagaaatatttttgtgtacactgttaatgaaatatctgacatttggaatgtaatccctccgttcaaaaataagtgcagtcatctcgttcaaatttaaactagaggactatatttattttgggacgaagagagtataaacttttgcatgaaaatcaaataaaactccttgctcggtagcttattttcaccttattcatgggatccttaccgctgataatttgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58027 - DNA, 1463 bp, Oryza sativa
tgagtggggtgcgccagtcgtccgtggtctcgatatcggcaacggtgcgctctgcctctatagcccccgagctgatgtcgggggcgaccgggctatcttcgccgcttgcctctttcactgatggcctggttaggacgtccagaaaggtgccaggttcgagtggctctcgcctggacgcacgtcgtgctagatcatctggttcgatgttgtctttgcggtatacatgtcggacctcgatcccatcgaaccttttctccagcttcctgacttctgcgagatacttgaataactcggggctagagcacttgtagtctttatgcacctggttcgcgactagttcggaatcccctttcacgatcagtcacctgactacgagcgcagctgcaactcttatccccgcgagtagtccttcatattcggctgtgttattggttgccctgaagttgaggtgaattgcatgcttgaattgatctcccgaaggtgatgtcaagatgaatcctgcccctgctcccttgctgttgagtgcgccgtcgaatgccatggtccacgtttcattgtcgatttggttgtctgacctgttatcgggcatggtccaatcggctacgaaatcggcgagtacctgggacttgatggctgttcgtggcacgaagtggatatcaaattggcttagctcgactacccatttggcaatgcggctgacaacatctttatttctcatgacttcaccgagagggaaggaggagacaactgtgaccctgtgggcttggaagtactggcatagctttcttgatgtcatgattactgcgtagagcagtttttggatctgtggatatcttgtcattacgtcgtggagagcttcgctgacatagtagactggtagttgcaccttctctctctcaacaacaatgatagtgctaacggaatatggcgtggcggcaatatagagaaataattcttcattaggttgaggggcaacaagtacatgtggatttgataggtagcgcttgaatgcaatgaatgcctcttcggcctcctgtgtccatacaaatttgtcttgttttttcagcagagcgaagaaaggttgtcctcgctctcccatcctagcgacgaacctgcttagtgctgccatgcatccggttagcttctgtacttccttgagtcttgtaggcgacctcatgttctcgattaccatgatcttctcgggatttgcttctattcctctgccggagacgaggaagccgagtagcttgctgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacgg

SEQ ID NO: 58028 - DNA, 12699 bp, Oryza sativa
ccttgtcttctagcttgcaaatcttaccacgattccgatcttcacgatcttgagccgctaacacagtctccgcacgactttcatccatagcccacagcatctcaaccaaatgccttgtggtagcatcattctcaattccttcagtctcaaggtagctgccacggtcacttccctggggttgacgaggatgatagcgatactcagtatcggccaactgatcactgtaacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacattgtacgcaactcctggacaaaaccctcaacaccaaacaagtactcaggcttgtagcgcggcatctaaagacaagtgaaaagagggagttaagacatttatccaattaatagcacaagttttgggattaatttgaataaagtttagaagatcaaagtaaaaggtaattaaataaagtaaaccaagcttgcaagataagttgaaacagttggaaatgaattttgtacttttgaacatcaggttccaaaagaaataaaagaaagttataaaatcaacatgttaaatttattttattgcagcaagattaaataaaacaatattgtaaaacttttgctggtaaaatgagccattagtacagtaatagatgtacagtactaataacactggaataaatttttgaacgagaaccattaaaacagattatgaagtgcatgtgctattagtttggtttaattaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaagatggcataatagggttttattttgcaaaagcagcatttagtaaacatttgagaatttaataaaacagtgaagtattaaacaatattaaaccaacgctatacaacataccctgttgtataggcccaaccattctgaacaaccattcccggctgaacagatctaatctccaaaccaggaattaaccattccaaaccaggagctaaacaaattataaccaaataaagcatcatttactatggtgagaaatgtgagactaatcacgaaaaacattgttagacccgcccataaccgcgggcacggctattcgaatagttttactctgatcagaggtgtaccactgtacccacaagacacagccccacatcatgtcaccatgtgccttagtaccaccacggtacctcggaaaggagctgtgacattaccttgctggccttggaactcttcaaactcttctccggcgaaaacgaactctccgaaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaatcggattaaaacacttaaaccggttttaattgaattatgacgcaataaagaattatttttgaaaaggaaaaggggatttattgcgtcagcggctagggtttgcggtggaccgagcgcacaggcggcggttcatgcgaacggacggccgagatcgatccatccaaaacggacggccgagatcgatcgggtccacgacggctcacggcggacggccccgataacgtcagcgatgacgtcatcatcggcggcggcggctcggcggctcggacggctcgggcggtgcacactcgccggcgaacggcggcacgaggacgcaaacggagggcaccaacgggtagcggacggcacggcgaactcaccggcgaccaaaacgacggcggaaacccaacggacggcggcggcgacgaagaagaagcggcggagctcttcggttcgacgacggcgatggtgctccggcggtctccgacggcggcgaagcaacggacgaggacggcggcgacttggcgatcccaacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagaaaaggtcgaggagatcccggagatcatttcccctctattgattcggccggaaacggaaaggggcggccggatttggaaaggaacggcggcggcggcggcggctagggtttcgggcggaggccgacgccaggaagacgacgacctgacaggtgggacccacctgtcagcgaccgaacgcgcgcgcgcggctgcggactgggtcggctgggccgaggagagagaaaagagaggtttttgagccgactttcggcccaaagccaaaagaagatttttaaaacctttttcaatttaaattattttttaaatgcaattccatttattaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctgggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgcccgttgttgtctcggcgccgatctccatcatcgtcgtcattatggcgacgtcctcgaccagtatcgcccagcacccgccgttcgtgatcgtcatgatcgcagcggttgtggcggttatcatggcctcggtcttcgcttgaacggcctcctcgatcttcgttatcgtgacgtcgtgaagagatgcgatgttgagaacggttctcgttgtcacttgtgcgtcgcgcctctcggcggccattcaggtgatcgcggagatcgccggtgccgcgaggtgaaggggtggctcgatgaggcaattcccggtgttcaggatcttcaccattagcatcgccagttggtggctgttctgggtgcactgcagcagcggcttctttgaacgcgttgctgaggttggtcactgattcccgtagtcgttctgtccatcgtgcgagatcgtcgttcagaatgggatcgtagggggtttccctcagtattgcgttgacggctctgatgtgctgggccagtgtagtcgcttgattttccgcttccgcattggtgcgcgctgatgtgccgacatcgtcgatagccaatacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcctgcctttgattattatgggccagaggacgcgacccgggtttctcctcgaggtatttcctttttagttaaattgactcccttatgcgcatgttcttcccggcttatcggattctgttctcgatctacaggcttgaatagtgcaaccgtggagcgccgcgtcagccaactgatgatcagcggcccgacaacggcgagcaacgtccccgtccccctttgcgagaaaggggcagccgagcgtgacgctgccatcaatgtaagtgtacttagcggtccttttgcatttttcttccgggatcgcattatgacttcatgaaacataggctcttcctctgactgatatcatcgggccgctcgtggaccatcaggtggcagcgtcgctgaaggagaaggtcgccaaggaggcgtctgacactgctgctgccgctgccacgacgagtggcagcgatgttccgaaaaaggggaggaaattctcctctgtagtcggacattgtcggaagacacccaccccctcggtaagttctcctgttatttgatcacgtagtcggaaaacttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaagatgagggaactggtggccggcaacgagcgacaacggcaggggctcgagcatcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatacgagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttgaattttgatggaattgtaagaaatacttgtggaatagaaaagaaatctatcttactaagctttcttactctggacgtagtgtgtatgagtgtcttctcacttcgcgacttcgatcagtcgtttgagttatacactctccctagcctccagccttgtcatcggagaattcttctcggaagataaggctcttggacctttgacctgcctcggttgaacaagcactgatcctagcccccagccgtgaagttggaaagtttatttccgattacacggcttggttaatacgcacggcgagaactcttacacaaccagatcttacatggtctttcgtctctacaggatccgacaaggccttatcggctctgggtgtccccgccgaagttcccttaggttcctcggaggccttgtcaagacggcgtaaagagacatgaggataggtttcaacgttaggtgtcatctgggtaagggatcatcgaaaaggaacactttgattgtagtctgtacctaaaaaataggctttattgaggctgtaagatgtcttacaagtatggatactattgacttatacatagaatttacgtaattgatcaatgttccaggaatttgccaactcgcgaccatcgccatctgcgattttgaatgcacctggccgcaaaacttgcgtgatcgtgtacggtccttcccatttgggtgagagcttgttgcgccctgcttggctttgaacccgtcggaggacgtagtcgccgatcgaaagcatgcgtgctcggatgcgcttctcgtggtaacggcgaagggcttgttggtagctggctgctcgaacggcaactcgttcgcgatgttcctcgagtagattcacatcgtcgtatcgctgctcttcctgatcctcatcggaatacttctgtactcgtgtactttgatgtcgtagctcggtggggagcatcgcctctgagccgtacacgaggaagaagggtgtctccttgttggacgttgtcggtgtggtacgcacggcccatagtactgatggaagttcctcgacccaattcttgtcgtgtgacatgagcctgtcgtagacgcgggtcttgattccttgtagtattatgccgttgccctctcgacttgtcaattgctctgagggtgagaaaccgaggcgaagcagatcttgactcccagcctgatgcagtaatcctggaaatcggcactgatgaactgggagccgttgtctgttatgatacggtggggcaatccgaatttgcagaatatccctttgatgaatttgatggcgttgtcggccttgatttcccccgtgggtgtcgcttcaatccacttggtgaatttgtcgatcgccacgaataggaacctgtagccgccctgtcctcgtgggaatggcctgagtatatctagcccccagcacgataacggccaagtgaaagggatagtctggagtgcttgcgctggcagctttgtgtgtttactgtggaattgacaggcttcacactgttgaaccatgtcgcaggcgtctttgagggcgtttggccagaaaaacccttgttggaaagcttttccgactaatgtccgaccggcggcatgtgacccacagatctcttcatgtatgtcgaggaggaggtgtctgccgtcgtcggacaagatgcattttagga

SEQ ID NO: 58029 - DNA, 2335 bp, Oryza sativa
cgacccagttctgaccgagtaggactccttccatctgtgaactccatgatgaatttccttaacgtatgccgaaaacgtccgtatacgcgtgaacataccatatcgatacgtgacgtatatcgaagggtagagggtataccttacccgtaaccctgacacagcccactgcctaatttgctctttagccccacaaattttcaagagttggacattggcagtcacataattagttccagagaacacttctgtgatatcattgaacaacttgagcctattaactacctctacagcaaaagcacattcatctttactaggggcacaatcaaagagcttctcaacatgttttgcacgatcaaaagcatgtgcataaggtaaagcaatgctaagcatcttgtaggtggaactccacctagttttgcaatcaaggcctaacttgtgatccattttaactttaacatgcttagcaatttcatcaaatttctctactctcttaggcgtggctgtccaaaaagcaacactttcacggatttttgcaattgaatattttatcacctctataccatccttcacaattaagttaagaatatgggcagcacaacgcatatgtgttgatgtgaaaaacacgaggcctgggagatctgcttaactccagtgcaggtccaaaaatcttgcctttaggttcgtgagcgtgccagttgatttgatcatgcaatcaacaagaaataaagacaggaaaatagcggttaaatccataaacgatagccgatcgaccagccgccgatgacgtatcatttgtctttgagccgatgtcatatttgaatcgatcggcaatcatgaataagtaagaaagaactaaatctacttgatcggctgtagatattaaccatatataattcttatgttgatatatacttaaatcaagtgattgggatagatcggtcaccatgccgagacagtataaatcacttagatcgaaatatataataacaatgagattatagatgttcatagcatagccgattagatagatctagcatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccgccataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcggggtctatttatacccgagattacaaaatatgtccatgtcggacacgactctcatctctaacaaactctaagataccataagtctttgcggcagacttttgcccaaacttatctctaaggaaattacatgaaataccctaattaatagatacaattaccttttcaggactcaatccatgcatggcaatcctcatgaagcacattaactcaacccgacaacgtgtaccgaatcacattgtcggaatcggcttaatcggcaaccttgtccgactcgaactctaccgatcctgatcgtagccgattcggacttcagccgattcttgctccgcttctggaacgatctccatcttggattccgcttcgattttatcttcatctccgatacctaaataaccaaatttggtcgttaacaatatgcaacaattttccctccaacatcaacttagacttgccaatcttcttcccaagttcagtgattaccttgtcattcgtggtacaattatcaagagtcaaggttgagatcttctcatcaagattccattccaccaatgcttcataaagttgttcacatataacttcagttgtgtgtggagcaggcacatatatgaacctatacaatcaaagttaaacctagattaaattcagattgatgcaaaaatgaaatctaatgtcatgctgaattaaatatgtagcagtaggaaatgaaatta

SEQ ID NO: 58030 - DNA, 18983 bp, Oryza sativa
  unsure (1)..(18983): unsure at all n locations
tgtgtcacatcattcaaggcgggtagccaggtacacaaaaacggtaaaagaagcctttaactaatccttccaatccataatcaaattagtggctgttaaattgtacttccttcgtcccaaaatataaaaactcagattcgtaatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaagagaggaagcctggtaataataattccaatgcagaccaaaatcagagtcctttttattattccaagagacgaaatggtggtttcgtcacgccagtgacgtagtgggttagcgttgggaatcaaaagccaagtgcatgcatttaacccaatggtgagtgcagggttggagatgtgccagcccataggtaggaagggtgagatgaactagacgaccagagttttagcaaagaccagcaaaaattttctttggaattttgagaggacgacgaatccggcagcgaaacttcatgctctggaaaagttggttcagacagagaccccctccaagattgtccggcttgaagcagctcgtttggaacaaaggatctttcgaatgatggctcctttgaaatataggaatttcacgtggaatttccaggtctttatctttcaaacattgggtcgtttggaatacacgaatttcatgtgtattttatgggggttctaatcttttgaacggctcatttaggatgcatagaatttgtaggagtttcacatgaaggctgtgttttcacgtcagaattgaaagtttggttgaaattggaacgatgtgatggaaaagttggaagtttatgtgtatagggaagttttgatgtgatgaaaaagttagaagtttgaagaaatattttggaactaaacacggtggaattttgcacggatttcattctcagaagggtttgaagagtaaggcggtcagcttcagtaaaattctcaaccaggtgccactgtaagaaaatccaggaaactaattaagcatcactggaagatcttgatctcagtgaaaccaagcagccgcttcaaatccatcaggaaaacaaagcaggcacaacaacacaggcaaaaccgtaagtttcgagctccacttcaaacagagaatcgacttgcatactgtcatactgatacagcacaattgcacaaacaagtgatgacatgattagaactcaaatcacacatcaaagtttaactgaaacaccacattttatttaatctgggaaggttacaaagattacagcattcaacaatctgccagcaaaaccagggatccggagtagaaaaacaaccacacagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccaatgaagttgaactggagattgaggccctccaacgatgccgacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgaccacggccaagctggcatcggtgaaacctgggcaatccttgatggtgagggatcggagagacttgcacaggggaagctgcgcgggagcagagcagatgtccttgatcccgttgcacttgaccagtgagagggccttaaacttcgggctgcagttgaggaggaaggccagaatgcccatgagagtaaccttgttgcattcctcaatctgcaaactctccaagacctttgccgattccgcgaaatccttgagacggccatccgagacctgaccgcatttcttgaggttgagctgcttcaagctcgggcagaacttggcaatcgatgcgagcgcaagatcagtgactcccgggcaggagctgacactcatgaacctgagcttctgcaggccaagggcgttggccatcacccaaaaacccctctcgccaaccgcgggaaggcgagcgagggtgagatcggtgatcgccttcccgtagtacccaatcaccgaaagagaagcatcggtgatgctcaatccctggaggcgaaccttggcaagcgatgcggccgcggagcagacaaggccggagacaccctggtcaccgacatgcgcgcaattcttgatgttcaccgactgcagcttcgcgcagcaccggccaatcgccttgaggccctcgtcagcaacaccggggcatgcctcgacggtcaccaccttcaagtccgggcaaccctgagcaattgcagcgaggcccttgtcggtgatcagcgggcagccggtgatgtcaagcctcgccagcgaggggcagccggcggcgatctcggcgaggccggcatcggttacctgagggacatgccacagggcgagcgagaggagcgacgggcagccgcgcgcggcggccgagatgccggcgtcggtgacgccgcgcgtcgggtggctcccacggatgacgaggctctcgaggcttccccggagcgcgtcggcgacggccaccgccatgaggccgacgtccgtggcctcgcgcccctcgaggcacctctcggaggagcagccgccgccaagggggacctcgaactcgtcctcctcctcctcgtcctcgtcgacgaacacctggttgaggtccggcaccgccgccgccgccggctctcgcttgatctccgacgagcggatgccgccgaggagagcgagccagcggcgggagacggccgcggaggcgcaccgggcgcgggcgcccttcacgcggcggaggatctcgaagaggcactcgtcggggagagcgtcgagcgacggcgcctcccgctgctgctgctgctgcttctgcctcttggccgccgtcaacccctcctcctccaccacctccaccgcctccgcggcggcggagacgaagccgcagggcggcacggcggtgacccgcgcccgcttccgcgacctgacgccgccgaacagagccgccgacgccgccggctccatcacaagaacaccaccatctgcacaaagcaaacccaaaaacacacatcagcatgaacccaaacccaaatccattaaaattcctcatcttgtttacctacctctgtaatcgtggaacggaggcatgccgacttcttcaagaacaaatcagaccaacaaatttggccccaaaaaacaacgcaagaatcaacaagagatgaggagaacgccgaacccaatcgccaggaggcgagaggggaaaaaagatcgcagatttagtgtgaggagatcaagggaggtggaggaggtgatggaggagagggaaggaagaagagggtgggtggtttttatgtgctttgggtagagaagaaggggggaagccaaagaatggagaggatgatgaggattcctgcccaacttgcacaagttgtgtgtgtgtgtgtggagggggggggttgtttttggcctccctgtcacactggatttgctggatttgcaatggattcattgaatctctctctctctctctctccctctcggggggggggggggggggggggggtnnnnnggggtctctcnncnnttcantgtcttggacatgcctgatgcatggacctctttttttcccctctttttacagtgggatggatggggaggaggcattgtggagttttgattgtgtttgaatttgatagctttgggatgaaaaaaaaagaagaagtgttcttgttagatttttattttgaaagattataattggatgcatacggctgtataggcatgtagtagtatgcgtttgttctcttggttgttaatactacttatgttttttaatatttcatgtccttaattttttatgattcgtttgattattcatcttattaaaaggttttgtgcaaatatataaaaatatagtgaagatttaataataactcaagtcataagaaactaaattgtaataaacatatgaattttataataagttgattggtcaaatgtattactataaaacaacaacgaagttagatattaaaaatggagagagtataacctcggacattagaacatcaaagagaatcggtaattcgtgtatgatcttgcacatttctccattaccattctgaaaaataaaaatctttaaatccaacttctcaattggtttcgtcatcacaggatattcaattaaaaaaaattcaacaatttactttttttcacactagaatttcccacaatttttgcatcgtttttgtgttgattaatcggcatatgatttttaatttaaagatgctttgttttgatacataggtcatgttcttttttccaataagagttgaatgaaaattaagattttcgtggcacgcttttcaaactactaaacggtgcgtttagtgctaaaactttttatatgaaagttgctctaaaatatcatattaatttattttttaagttttataataattaaaactcaatcaatcatatgttaataccatctcattttacgtaaaaaacttaatcttcatcttcaaaagaaaagagcaccaccacagtggtagcatggctttactaggaagctgtctagtacattaccatattcattactgaacaagtttgcatttatgcagttcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaacggtgactaggccctgttagaggataattaattggtaatcagcttctgataatagttaagttttataacttcttttagtttttactaaattctataactcaaaatcaaatctgaatgagaatctaatttatttaaggggattttaggacaacttacagtgcccagaaactccccaacacggggcctaagcccagataaattaacaaagccagtgccccagtataccaccctcaagtttttttcttttttttttaaaaaaaggcccctactgtggacatgcgccacgcggatcgatccgtggaaaatgccggttcgatcgcccaactctgcctgctgccaaatacgcgcccgcgcgccgcttgatcaaccgatcgatcgagactgatctccaggtgagaaacctgcgagaccgatcgatatgatcgaccgaccacgcccgcgtccaccgctcgtccatcgaacccaacccctcgcgctcgccgtcgcgcgtgcgtgcatgcacctacatcaacaccaccctccgcgcgctgccacggctgtggctggctcgcgctgcgtgttccgtgtgcgcacaagtgcaacgcacctgggctagctgggcgcacccaccacttataactaacggaaagaaagaaacagagaaagaagagagatgaaacgggaaaaagaaaaataaaatgcgatacgacatgcaacggcctgctgctgctgggtgtggtggtgtgggtggtgaggtcgtccagtcctgtccaggtgcatgcactattgcgcccctttttccttcctcccccagcttctttcgcccttatcaaatccacagcttcgtcttaattagacccctgttaatttaaaaagcttaagaggcagcttgtcagtcattagcttctgagaatccagcttaagaacccgcatgtgacttctagtttattttcttttttaataattttttagtttattttttaagtccgtagttactccatccatccctaaatataatggattaatgataatctgaaatgttcgtgtgagctaaaacttctgagagaagcggcagcatcataagcctcccaaataaaaccttagattagattaatgttctttagagcttacttttcttgccgtttatattaggttgttaaccaaccagtaggactagctaacttatatgggcatttaactattttttttgtcacttttagattgaacgtttaatcatttgtcacctatatggcaacgacatgtaagttcaagtgttaaataattatttgtcacgtctaaaattagcaaatagttaaatatcttgacttatcttgttactctagaatcttagatgcacttaattatcttactactatcagcctagtatctctctctatgtaaaactcggtaatttcaagttggaataattttgtggttcttaattttcttgatgcaccttaattttttttaataaataaataaattatgaatagcaacaaacataagagaacattattaagcccttctcaccaacttaggagttgggagacaaaatgagccaaaaatgaagcagttgtttcatagagtaaaaaaaatgcattcgttatttttcttccattttcttgtactatcagctagggttgtgtttagttcagcgcaaagtttagattttggttaaaattagagatgatgtgacagaaaaattatgtgtgtatgataggttgatgtgatggaaaagtactgaagtttaatccaaatttgaatctaaacataacctaggttgatctactacgcggtttcgtggtggcctcttgtgggggtttgattaatgactcggtgaacagaactactaataatcgagagtactgaaacttacacgtgggcccatttcagaccagtgtttgtgcgtggggcccactgtcagtggctctacgcggtcgtccctcttgttgaacgagctccggagtccaaactaccagtccaccatggaaaggtcgagctgacgtcgtgtgaattgttctttttttttccctttcaagaattatgatttgtttgaccaacgagttgactgggagaatttttattttttttataggtgagttgggttgtatacgtagaatttgagtaaaggtaggtagctcgaactgtttttctatgttttgatgctattataaacatggattttaattgtacggtttggagtttttacctgtcaatctatatattgctcttttaattctccccccccccctcctaactcctaagtggctttgtttggttaagtgaggtttaaatataaactcataaattgaagcatttctcacatatttatgcccatctcacattacacagatattaagaaatcaggtaaaattaaataaaagaatattgtgattggtcgagaaaatgaagaggtgaagaatttgaatggcaaaatattataattgattaaaaagggaatatgagtggagaaattgttacactttggagtataggacaaattttgaatggtataacattattatattttaggacgtagggagtaggtgattaattaatacatcgccaatctgtatgtaatggccaagcttagaaagcttaatcgataaaaatttcaagattatgctaccaagtatattagaagaagaagaagaagaagaagaagaagaagaagaaagtgaaagaacaataattttgtccaaaagaagtgtactccgtattctctatagaggagggaggtaaggtacatatcaaaatgagatgtattcatcggcagacggcacgcctatagttgctcctattctacctttcaatcttctcccaacaccaaaatagggtgtatttgaaaaagacatatgatttatttttagaaaaagaagataccaacgttattactatttcgtataatggactataccttattgatactactgctttcaataaaaagtttacactgtttagtgataggcatgattagctttaattatttccccagaaatcgacattgcagaaactaggtcagcttattgaataaagatcacttataagatgattattcttccagcagaaatttatttacatgtcaaaatttttatcatagtcaattatcataatcctagattatatatatacttgcaaactcatatgcttgtatgtcacatatcatttaacaatagatattccgatcaaattatcacaaaattatagatttaacgtgtaatttctcacataactatagatttaatatagagtgtcacaaaaataaaaatcaagtagcaaatttatcacataactctaagtttagtgccaatttaatcacaaaactacaattatcatagctccaatatgatggcaatgctatggatttaaactcaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaattagcagactggacacaccaatcaatcatcctatccaagtacatgcatcgtcgtcgtcgtcgtcgtcatcgtcatcaaccattgcagttgcagctagagagctgaatatatacacaagttgcagctctttccatgctctatcattcatcaagttgggtttaacttttaattctttctcttcacccttcttgcactggaccaagacctttattctttttcttgcattggggagctgaatccatcgatagattcgtgagagaaaggtaggagtagtaccatgatgcatgaccgaccaagggtccatccatccatccatctcgatctatactgtctactagtcttaaacaaatgaaatgtgtgagctgtttctcgacctgatcagtcgttcttgcaacttttgcaagttgcagcaataaaataacactggattgttgcttagatcacgcaaaatgcagtacaagaattcctaggaaatgaatgaattgctggctaggagtagcaatccagagtcttcttcatcatcgtcttggactgcactttctcggcctccatttgggtagttcatgtggccaggtgagctgaaccttgaatgcatgcttgtgcaatttgccgattgttttagctaaggcgtagtacgagggacggagggtgagatgacctaaagtcctgaagaccagaacgatgaaagaggaaatatgtcggttgctaattcatgcaaattattaatgcttgattaacttttcaatcaaacgcaattaatggttaattgattaattagtcccccacctacatcacttggcctgttttatatagtttgccttatggtgtcgtgtgttggtaatctgtggatcagcagatgccacggtgatctagataggaaaattagttcacagtacttcactcacatctgcatcttgagctatctatatattcatcctagctgcgacttgtgttaagtttatcatataatcgttgtttgattgctctctggttggcttctttttaatttgcagtagctagctatgcacataagaaagctagccatgcatgtatatatgaagaaattactgctattaagtaggagatcaagatttaaagttcatatatattagacaaacaaaaacacttctttttcctaaaaaaattagattaatagttctccacacagacgtggtaatagtcgtctttcaaaagtttatagcttaaaccacaatccctgtttctttttttttaacaagttctcctagcttgtttagcagccggttttctgaatctaatcccatcttgacgccttgacgtgtactagtagaattctagctcggacaccggcggcaagttgatccgaagctgcgcgcgcggggcgtctctcccggcgggcgcgcgagagcgcgcgtgcgcgtcgacgacgaccactaccaccacctcgcgcgacgccggtctctgcccgcgtctccgcgagcgcagcacgcgcgacgcgacgcatgcggcgtacgtgcgtaggcgcgggcgtcacgcgccgcgcggcgcgcgcgcgttcagtgaacctgcagcctctgcgtacgtacgttgccgtgccgtgcgcgatcgatcgaggcgcgcgtttgctagcttatgatgggtttttcccgcgggcgcgagcgctttttcctccgtttgcgccgcggggcggggggagtcgttttcggtgccaggcacggccggacgggacaaagcgagcacccgcaaacgtgagttcgatcgattgcccggttaatttactatggccacgtttgatagggttccaactcctaaatttaatttttagagttacgtttagagtaaagttgtagagcaatataaacccggcttcatctggctagttgttttgtgatagcacttcagtccgctccgttttattttacgtggagatcaaactgtttgtttgagttccgtcttcagaagaggtagaaataaagttggagctctcgtgccaaacaggtccggcttcacttgcaatcgagagtcgtagaataaatctcaactgaagatctacttggtgtgttcaatttcctagaaacgactggatcagctccctagcttcaagacctagcttaggggtttgtttgtgaaagcttcggctctagctgcatcacttttggaactgaagctagtctaatcaaacaattttagctctataaaaaagaaatagccgagttgactagagtaacctaaaaaaataaattagatgtgtgagtggagttcgggccgctatatagaactcatctccttagtgatcgctccctgtttttttagccacttcaccatatcattactgtgaattatttgccccatgcctctaaaacaaatttttcttcatatggcattgcttaaaccactttctttaagttatttaatttatgtttattttcaaaaagtatttaatttatcactacgattaattaattagatgatctgataaataatctatttcaaacacataaaactgctgatatgaggtaaccattatttgaagtagagttcatccatcaaatttaattttaaatcttgatgtctataattacacgcatatgtgagattgtgctctcatcagcagagcatgtcttaagagagtgcgcttgcgagtgtgtacgtgagacggatggggtatgtaatcggggaaagaaaattcttaacctgatcaattgttgtatttcgatacgataaaccatcaccatcccaagcattgcaatgcctgcacagcttgcatgcaactctgctaattttcccgacctggaccacgaccatgttgcctagctagtgcttggggagctgaatccaactgctaaataatccaactttctagattatttagcaagtactaatgttagagaaaaatatttctctttagtcaactttagttatcattttttaatttttaaatcatctgattagctcaagatttattaaaatgatgtgtgaatcatgcgaataagtagaaatccttatattataatattaaatttgaatttataactttttgtattattaaacataggaagtattatattacttcttatattacgcaatagtgcgatgaccagaaaaccaacagtgagatacctgtttatcacgctcatcgatcaaatccatctagcgctggcacatgcaacaagttgcccagaggcacaataagagggcaagaatgcaactatgcaagatggcagttgttgctgttaagaaaagtgcaaagagatactgtaatagttaaagatctagtgctactatttcgtttgcatcaaattgcatctatcaaagagagtctgcaggagtactactattcatcaacaacttggacaagatatgtatgttacatttatatatgacccttaaattttagaggtgtccgggtgagctgaacccatgcatggatacatctgcatccaagctaaacaaagtagtataagtacttattttagtgccacgagtgtaactggaccgttttagttgacgacctagtcgtaaacaaacaaaggggatcgatgtacataccgagagggttcatgaatctgaacgttttagacccgataccaaacaaagctttttgccgggtgttttagtttaatttaggcagtcgctttggcacacaaattgtcgtaatctatatattgatatcaataaaagtatatatggcctggtaaagaaaatgaaaagtataaagcagtgaatagagagttctttgaaataacttctttctccctccgatcccttactttttaatcatagaaacactgtgcgtcttgtatatatgtcatgtgtttatacatatctagatagctaccacttaaaacatgagtttcgtcatctatccgtcgtgttaggaaaccggcggctcataaagatccagcttagttatacccattaattggactgatcactaaatatgaaaactatctatagctatgcctctatatagagagaagatgatgctcactattatactccttgaggatgaatgaatgaatgagtgcctcacctttaaatcttgtgtctttcactttcttatagacatctgtcatgtattatgcaaaataaacccacaaataaaacgatttagatggtacccaaggaaagacatgcataaaaaaattattttccgaagtgaatatcttaagagatcctcttgagaaaacgaattatttccacgggcctaaaagaccagccactatacccaacctctccttactctcagccttcttaaaaagtaaagaattatgctctccctcatctcctcatccttatctcctcgagcccctctctcttctctcactcacaaactcaactcctctctcactcacaaactcacctcatctctcactcacggcagcggtggtgcacgcacagaggcaggtccgacggtgtggtgtgcgttgatgacgaccgccctccctcgtggatccaacgaccaagtggtggggaggggcgccagatctggtccaatgggaaagggcaatgacgttgacagtggctaggggcgatggcgtagatccgatgctgctaacctttggagggatgccccacagccggaggcctctttccatcccttgtgcctggattcaccgtcgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagca

SEQ ID NO: 58031 - DNA, 1681 bp, Oryza sativa
gagtaataaatgcgtgtagttttactttttagctgcacgtacgtgtcggatgtccggagaattgggccaagctggtcgtcgctggatgctggcatgcaacgcacccaaccaaagctgcaccggcccgtctctattcgagaaacaaaaactgccaactggtgactgagaagtgagaaagccatacgggcacaagacaacgtgcaaaaccagctggatactcgggatttgtacactgtcaatacaagctccaaatgaatttcttacttcaaaatttgtatccttttcaaggcaacttcacaacttgttgagtgctcttattacacctttttttttctttctgacaaattgatcattttcagaaatttattgtgaaactaagaccgtgccaaaaaaaacttcaataaaaaattaagccatgttctcagcaccagagacattggcgctgaggttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagt

SEQ ID NO: 58032 - DNA, 7796 bp, Oryza sativa
attcctgcagcccatgccgcgctagctagccgctagctgctgcgcgccgcgcgcggcttcgtcgttgatcgatcgcgttcgctttccggacggatcgagctaggtggccggcaggagtcgctgaggttgatcgatcgatcggtcggtcgtctccgccgcgcacgcgtggttttttaactaactaatcggacgctctcaaaatgtatcgttctttttagggattcagggattgcgtaattacattgttaatccggtatatccacgcaaaatcatagaagaaaaataatactactatatttttaaccttttttttccagctagtcaacggccggcgcacgtgcacgcgcgtgcgcaccgggcggtatctgcgacaagcgtacgcgcccccgtgttgcctccctccatgtgtggctgtgggctgcaagcctgcaggtggcacgaacctggcccgaccgaaacaacgcgcatgcgcaagtcgtcgatactctacgtactacgcgcgcgcccgcgcgactacggacgtcgcccttgcggagagggacacgacggacgagatcttggctactacttcctccgtcctaaaaaaaatacaaaccctgatttccgtgcccaacgtttgaccgtccgtcttatttgaaaaatttataaaaaaaatttaaaaagacaagttacgcataaaatattaatcatattttatcatctaacaacaataaaaatacgaattataaaaaaagtttatataagacagacagttaaagttggacacggaaatctatggtctaactttttcttggacggagggagtacgccgcatgccgcgcgccgccgcgccgcacggcggtctttgcctctgccgtctccgtctccgatcccgtcgcgcgcgcgtcgtgttgaagttgcagcagccagcaatgcagcctgactcgactgatcgcctcgcgggccggcacgcagggtgcagcgagcgagcggccgacgtgcgtgcatgcgccaacctcaaactacttgaaatttgaaaagcatatgcacgcattatgccttttttatttgccccctttcgctttgggctttcagtaattattcatgtacttacttcttacgtctcataataaatttatttttaatccattttatttgtagaaatgaatactataggaataccactggcagaaaaggatgtgaatcaacaacaagctgtgacattaccgtgatatatccatagacttccataaatgtgcacaccgcttgacaaacagataatctgtttcgaatggcttcacgggaaacaacacaaatgcgaggtttattattgcatcctagattttatgtaagcttcatcggacaaaacaaatgatcgttttcaggaagttcaccactaaatctaagaaacactcaatgcagtcctgtaaaccaaggttacacaggtggatcgtgctcaatccgaatggcaaaccctgtatggtacccactatcgaaatgaaaaacgtcaccccatcgttacaagttaaccaatttttttaaccgataatcagcagtaaaaaaaacttccattcgaaatacctttctaaaattttttgtagcgggccagcagttagttccaccttttcagtgctgatttgaattttttggcccgctccgatataagggtgttacacgtacgtttgcttgtgcacataataatcgttagtaattcattcgtttgcacatggatgtacagctatctagcgagttgcgctgttgcgttccactgtcacgcaaattggcaaccaggcaaaattcggggatcgaatcaaataggacgtgtgtgcttcatgccttcatccaatggtggctgccctgctggttggtggtacagtgaagcgcgctggtgcatgattttaggatgtgagcattatgcagtgcataattaattaagtactccctccatcaacttttgatagtcatatttcatcttggcacaatgaggtgtgttcggcaccctctttttctaacccctctcgatcgttttccgtgcgcacacttttcaaaccgctaaacggtgtattttttgtaaaaaaatttttgtacaaaagttgcttaaaaaattgtaattctcacaaactctccgaaacctgcagccacagccggccacagaaaattcaccgagtcagactcggcttgccttgccacatgcccaggccagccgacgccctgcttgcatcaccaagccgagccgctgcatgctgcacagtacgcatacacacatgcatagcacaacatgcatcaccacgctactgcaattcatagtaggcacacatatatgcatgctacagtaccacgtgtactgtagcaccatatactcttactttccaatttccttcgcgaacaccgacgcttgcacgcacacctcgtgaagcccgttgcaaagatttcacccacacggtatccatccaccgtatgccatctcgtatccaacttcgtcacccggtatccttgaccgtctggacctcaactcctcactgagtctagaacttcaattctccccttttcaagaagtatgcattttgtatatttctccccctttgacaataatttcatcaagatgtaagttataaaaatctaaatacacccatagcatgacccatcaatattaataattaagaatttagcaagaaaatgttgacacatctagctttttcctaactattgaagttaccaaaaattcagtaggacacgtgttggcttcaattcaaaacaaccttaatatgagagaacgtacctaacattaatttcagcacgcggaatatatatcctttgtttcttttaaatactaagatatcttttccacgtttcatccatggaatttaatattaaatacatatatcctttttttaaaacattatcctatctgaatggatatataataattcttccatggataaaataaacaagagggtttgatatttttttcctataaaaaaattacatgataaaccttagtaacgaagcaaaccctagttgggccgcctcgagatggcagcccattccggcccaggacacgagccatcgtcatcgggggtcgtctactacttgcttcctcctccctactccgcctagtctactactctacttcgctctccgccgccgccgccgccgccgccgccgcccacctcgtctcgacgccggtgagcactctcccccgctggagatccacgcgccgctggttggattagttcgggctagggtggagcgagattggatcgttggatatttggtttttggtttttgattttttttttgttgaattgttggggggatttgactggattttcctcgtgcaggatgaggatggagggttcgtcgccgatggaggaggaggaggaggcggcgaggctggcgggctcgcagggggagtcgccggcgatgctgcacccgaacggagacggagacggcgacggcggcgatgatgagggtgacgccagcggcggcgaagaggagcagggcggtgtggctagggcgggggttcgtcgccgcggcggcggcggccgtgtgcgcgtgcgtggcaggattccgctgaagaaggggccgtggacgcccgacgaggacaagcggctgcgggagtacgtggaggcgcacggcgaggggaactggaaccgggtgcagaggaacgcggggctgaaccgctgcggcaagagctgccgcctccgctgggcgaaccacctcaagcccgacctcaagaaggggcccttcagcaaggaagaggaggagatgatcatcaagctccatttatggctggggaacaagtgggctaagatggcaaactctgtaagtgtgctcctcctcctactctttcatggttccttggttttgctagcttgtgcattgatactccgttcattgttagtttagattagtagcatgcttaatatttaggtgcattggtgtattagttggattagagcaaaaatatttaaccacctaaattaaagcctaccaacagtttgcctagtggggagaatgcatgctgtccactccaaatataggggccgcaaatataccacttgctcgtagatagatgtattcagagtacatcaaccagtattttcttctgtattggcgaaagactttattttattcatttaattggctccaacttgatttaaatagagaatggccactgggcatacttttttctgagtgtggcgtagtgccatggtgcagacacatttgacatgctgcactcttgtaaatggccttgttaaaaggagtagacaaatgctttgccattattccttgtttgcagagaataacaaagtaagtcgttcttttacaattgttgttagtcttgtctgaaatagtatttggtcctccaacaaatcgaaagaaaattgattcagaccaattatcctttaaatcttcttgcttgtagtggctttacataagcaggggcagagcctcatggctgcctacctggacactggcctccattggctgcaaaacctttgcaagttacaacttagtcgtatatatactacctatctagaagcatgatatactgcttgattaatataaattgtttagtttataatcagaacaaacggcatattgtcagtcgagtatccgtagaaaaccaaacagcgtatctaaactgttttttaactttgatttgatgcgatacccgtgaacaaaattcagctaagctttggccttctatgaattaagtagacccaatcctccatgttggacgtaagctgtctgttcaattctggattgtcgtggctcgagaattttgtagataatggatagaaattcggcatctgtagactgtagtcactgttctaggttcctattaggatcattgtttgttagtattgttactacatgaaaatcggtgtgatcgaggctatatatctttcatcttctgaatctttagggacagcattactggtgtgatgtgagtgcctgagtgagtgagagtgagagtgtgtcctagttgcggactgaacacataaagaatttgcaaaagttaacaatcgttttctccatattgcatcacgatatcacatcactaattcactatttgttggtggtttgtactacgcatttgcaaacaccacgtagctagctagatcaagctagatataacaccaaatctgagttctatcctgaagactagctagtaatcaatcgacttaattaggatataacgtgaaaatcgatctttggctgccgtttgtgtcaagttaaccattcattagcttaagtgaatggttttacttttcttttcagaaacgatactgtcatcaggtgaaactgcaactaatattgatggtgaagtctgaactctgaaatggatggtgaaatactgaaattaatggaagagtgaatagtttacctgacaaccagatgaggtcggcgaggtcgagacccttgctctggatataatctattaatcaagcagtatataatctattaatcatgtatccgtagaatagctctcgaggtgtggtcccgagaatagcagtcgagtatccgtagaaaaccaaacggcatattgcaatcatgtatctgatatttagatgcattggtgtattggattagaggaaaatattgtctctagattaaagccagctaacagtttgtctagtgcagtcttctccatatatactatttgctagtgtctggatataatcagtggacattaaatagttctttcttatgtatattggtgacagactttattttattcaatttaattgtcttaatatcgttagttgctaaggacttaaatagagaatggttgccgggcatactttttctttagtgcgttgtggtgccatgggcacacgtgcttgcagtgctgcactgcagaaaagaaactagatatatattttactgttattcctcttctgtagagaaggaactcggcttgtttgagcattcagagcttgcactaattagaaaaaaatagaatacctattttcttgaatctatacagtcagttaacacatggaactgtctttttcccttgtgttactgtaagcaggcggatgtactgtgactcgctagctagacacaatctcgaaagatgtgaatttaattttcaattcttagttttctgagccatgttataagtagtgtcaacttttaaactgcaacaggaaaagctgacatctaggccacaggataaggtagggtctgcaattattatgggaggattcattgacatggtcatatatatttttaaacttttattgggttcctttcctgcctcctactaaattcctatgagtttttgttcatcgaataggacttcatcatattttcatttatgtaaagacaatatcattcactgtttcgttaggtatgtttaaatcctctccaactattgcaacaccatgatacatcttgctatatttgccattctaacatctgaggtacaatgcaaatgcttattaggctaatgccttaaggttctttagtctaattgcctagaaaaatcctattagatcatatgttaacttgcatatctgaacttctgttgttgttattgcagttgccaggccgcacagataatgaaatcaagaacttctggaacactagatgtaagagaattcagagaactggtgaacctctatatccgaaggagtttaatcattttaagttgacagatctggaagtgatgaactgtgaaagccctgatgaatcacgtgccaagaaacgaacaaatgaggttttacagggaaatggtcaaagttacaaagaggtttttttcgataatttagactatagtagaccagaaaattatattcggccaaattgtgtgactccaaattctcttccagttgatgccacaagtccatttggtagtgccattgccacacaagatcagtcagtaccttttggtagtgccattgtcagtggacatccaattcttgatggcaacttctctacttctgggaccatacagaggcccatgaatgtagagctcccttcactccaatatcccaactatgactttaacaataataatgcatggtcatatcacgaccccttaggacatcctattgaccaggttgactttggctccctgagatcagaatatctctctccaaacaacaatggtctgctggatgcattggttcatggaggacatggacaaggggaacttgcaaattcccaaggatcttttgatgcttgttttcctcgtgttcaatgcaatcaagtgattcaatcgaatgctttctctctgagttcttcctttccaatcattggtgatgatctcctcgagaacagtaagtgtactcactcttattttaacatgaacaatatcacataaaacttactgttagtcttttcaggttgtcatgcttttgttggcatcaacaataatgcaagcagcctattccttgacagccaacctccacccttggtggaccctactttctggaggcacgatgtatcactagaaccgaatttgccagtttattgccagtttaacgaagaattgccgccctcaaatgagcagtttgccaaagatgcagatgacgctttcggtcatgggggtctttctgatgagaccaatctagctgctgcaggtcaaggcgatgaacatgaccttgaggacccctgggcgagcatgcccggtgcctgtgacatacctgattttccaagtgaatgacttgcatagagtttgtgcgtgttattgattttgatctcaaccagtgagagaaccaagaagatcctttttgcaataaccatgcctttcaagatcgtccaataagtttgtggctgcgtatgctattactatcttaccg

SEQ ID NO: 58033 - DNA, 703 bp, Oryza sativa
ccattctaattcggcattagattacgaactcacttctcatgttacttgacagatcaaaagggagatatcaataatgaagattgtaagacaccccaatatagttagactaaacgaggtatgctaaatatttacttgccatctgtcctatataacttttcattattaacaaaactcctatgttggctatcttaacttcctgtgtcactactttgttaccattactatgattttgtaggttctagctggaaagacgaagatatacataatcttggagcttatcactggaggcgaattgttcgataaaatagtaaggagtctattatatacactaccgaaataacgatgagctgctgttctacttgaactaaaaaaatataagaattgtgccaatctggcagtgtctccatatgtaaattctttttatcacccatatataccagaaactttctgttcagtaaattataggcccattatataatcccaataggcaatataaagaaaggaacatttttttattattgtgcattttcttaaaatatgaacctatgcgatcaaatatctgtaggctcgccaagggaagcttcgtgaaaatgaagcaaggaagtacttccagcagcttattgatgccatcaattattgccatagcaaaggagtatatcatagagatttgaaggtccgttactgataagagacacttggctat

SEQ ID NO: 58034 - DNA, 739 bp, Oryza sativa
caatgaagggaacccaactcttgcccaagtcctggctcaacaggtgcaacttatgaacatgatgatgcagcaacttcagaatcagcagaaccaaggaaataaccatgcacctccgcagaacaggttaactgattttcttcgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaacgccggattgctcaattcaagacacaacaggggaataatcagaagccgcgtcttactttaggaccccagtccataccacatggaagt

SEQ ID NO: 58035 - DNA, 8955 bp, Oryza sativa
ttcattgagtccattactagccaatcaagtgaggagtgtacagacaaacttgaagaggttaaaaacaatttgtatgacctcatgaaggagtatgaaatggaagaggatgaagataacacagaatcttcagctcattcacttgctaattcaggtgtattgtcttcaattagtgcacgtgttgcttgaaggaggccaccagcaataagagttaaatctgagctagataggtacttggaggatgagttagtctcaattaatatggaaaacttcaagatttttgattggtgtaaggtggctgggacacaatatcctacattgagaaaagtagcatgggacatatttgccattccagttagcccagttgcatcagaggctgcattcagcactagtgggagggttcttagtgagcaccgcagctgactcacttcagatatcttggaggccttaatgtgttcccaaaattggctacgaaacaagtacaaaggtgtatgtgttgtaccattcaaacatagtgtgatcatttatatttttccattgtcatggttgcataataatcattacaactaattttgtagatgctgataatgaagaacctgcaagatttttggagctgtcttcaagagatccaagataagatggaggtattcttttcaaactaaaaataattgactattgcattgtactcccttcatttccttgctatcaaataattgactaatgcctatgtattttgcttgtcttttgcatgcagagacttgcactagtttgagacatgaagagtcgaagacagtgccttctaagctaacgtgtgcatgatgcctatttgtgtattttgtttattgtgatgatccattggatgatggttgtcacgaccggaaatcacccaacgggcgttccttacgtgcgtgtattattccttgtcccaggaggcaaggtacaccaaaagttgatacaattcagagtttaacaagcggaagcgtaaatagttaattattacatgggcagcgacggcccagcacactcaaagacaacgaagaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagcataattgcaaaggagtacaatggaattataatataggggttaggagttgcagtaaatagcattaaaagacacttagttgctcaaagctatgttgtaaacacgatcctagagctataaaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacccccgggacaggtaggcaggactgagcccctagcagcagggcaccaaccctgtgccatgacatctcgactaccgggccgcagctcgtgtagccttcatttgtcctagagatgtccatcgaatcccccgacttcgtccatctccatccgtgtacttttgtttataaccagactgagccacaaactaagccttacccattagacatgtggaagtacggtggtgctttgcaacagaggcccgaagaccggtccttatatggccgaggtgcgactatcaaaaccatgcaccccgagcccagcctaaaaccattttgagagttttgaatagagggggcggggtgaatccaattccacaataatccaacaattccagtgtccaggtgatatgaatattaccacagtctagggttttaaaaccacctaatgttacctaattaatcagcgaagcatctacctaaaatcatactagtgataccacaaatagagtgtccactagttgggggttttgtttattctagggtgaacaaggtaataatagcaataaaaataataaggtcgtaacaaaggtaataggcatggctaaataaaacagtgataacgcgggaatttaaataaagcgataatgcaataatttaaatcaaaataatttcagaaattgggattcaatatgttcaaggatgatgtgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaaggaaaaattagagacttgaacggtccaattctgagttcaaatggccaagttatagccatttgaagtttatatgctctttaaatgaatatttgcgaatttcttcatttaaattttaatttaaaatcggatttattgcgtcagccgaggggagagggcgcgcggaccgggtccacgggagcggggcccacgcggcagcctcacggcccacggtggaccgggtgcacgcggctcacgccgaccggcgccgtgggccccaggcgtcagccgcacccgagggcgcgggcggctgacggccgagccccacgtggcagccgctcggtgcgcccgggggggcggccattgcggcgcggccggcgggaggcggcgcccgtgccccgatggtcaccgccggcgaccaccggcacggcggaacagcgaccgagagaggggagggaaagggggaaacgaagcggcggtccacggctcaccccgagtcgaaggcgacgacgaaaacggcggccggagcggaggaaggcggcggcgcggctcgggtcgacggggtcgacggcgttccggcggtcggtgagcgaagcggaggggcggacgaggtcggcgaggatgcggcgaagccgaaggaggcggcgccggggcgggagatggtccggggcgacggcggcggcggaccggagctcggcggcgacggcggagagagagtgcgacggcgcgggctcgattccgacggggaggaaaggcggcgagtggcggaaacggtggaggggaaggggatgacgggtgggccccacccgtcagcgagggtggcgggcgggcccgcccgtcagcggcgcgcgcgcggggaggaggccgagtgggccgcggggagaggagagggaggggagggagctgggccgagccggcccaagagggggagggggagggaaagggaactttttagggtttttctttttataaaacctttttaactttgtttatttcttcttaattatcatttgtgctctgaaaattccactaaaatttatttacgcattttaggctttttaggaaatatacaaaaatcctccaagccttatttgacttttaactttgcacattttaatttttgaaggctttcacatggattttaattattctaatcataatttagaggatgtattttagagtcgatttgggacgcgacaatggtgccccagactcatatgttgctgacttagtgactatgctcatttgtgatttgtgaaactaatattagcttcagactgtcattttgtggctcatgtgatcatgtgatgtttaatattagctccagagtctagactgcaattttgtggctcatgtcatcaggtgatgtttatttgtgttttgcctaatgaagtaatgacaaatgataatgatccttactgtgattgtgatctataatttgctgatttgttgagtggagtattttggatatatttgatataatgtgattgtgaatatgttgtttaaccggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccagactcaaagatgcaaaaggtgccaggactgcgggatgcaggtgcacgtcacaagcctgagaaggagcgatcgtatcgcagagaaagagagaggagaaacggaatgggatagaggacagggcatgaccattgatgggagatttttgtggtgcatccagcatatggtgggtcccatggtatgctttatatttttccttttaatttccgtcgcacttttggacgtatcaaagcatgcatccataccaatatacttatagcaaatggtctatatcatatacctaattaaagaaaatatgtaaagctttcggcgattttttttcaattgaaatggactaaacttagagtttgcttgtttagaatagggcttaattccgagtttgatacacaatggattttctctgatttttgggacaacggaaaaatgaaaagataagaatcgaaaccctcgatcaattttagattatctataaggaaatgacctgatttcacaagaggtggcttcagccggtgttgggcaactgagagaatctggacagatatgggaaggcggagggaaggagaaaggaggaaaatgggccggcttagctacgggttgaggaagaaaattggctaaaaaaggcccatacacaaatgaggatttttatttagattttgttttaaataaatgctgaaatgatatttgtattatagaaaatagcaattaatctttgaaaattccgagaaaaaatcaaagagtgtaaataatcatgaagaatttaataaaaaattaaattcagccatgctattttatttcccacacttactttacttataaattaatttaattatacatctacctatttaaaaatacctagatatctcaggaaatttataatttaattaactacaaaatgtaaatctttctcaattgttcctcaattttctcgttttttcttcccttgcaacgcacgggcactttttatagtcttttaaaatatttgtagtgtttttatcatctcacctgacataatgacgctgaaaaaaaataggaaatcaaaaatagatagctcccttcacaaacccagattcgtattcctggtttgcaacctaggactaaaggggttgcaacccggactataaattctctagcagttccaatttctttaaagtattatgtaattcacgttcttattagctttgaaccatttatttaaaaagtggctccaactagctaaagagtactgtactctctccttcccaaattgatcattatataatgaaatctaaaatttctcaaattgatcatcatataactttatggacgcggatttcatcggaatacaattaatgcaacatcggagaatgtgtgcatgctagcgaccaattttattaccatttctaattcgatctttattcctgatccaattggtactacatctcctagcgccggtccccctgctccgtgccaatcagatctttgttcccgatccagcttctcctagcactggttacaacgctcggaggccggggaaagaccggccgcgacgatggccccaacctttggcaccctgtgtcatctcctcgcttagagcaggtacaatagtagtagactataaaccagctataaccactgcatatatcgagaaaaaaagagaagagagaaaaaagcgggctacaaatttatagctagctgcaacacggactctaatatgttatgtgtgtatgagatgtgggaccgggtattaatggtgtagtatatttttatagttaactattgtataaatgggctattagattatttatagataatttagagtcagtagttggctatactattaaaatactcttaaggattagagcccgccctctcgtagtgagttcgtttccaaggttgggtgctggggttcttggttaaatatggcgtatatacataagtatataacgtatataaattttatataagtatgtattaaaaaataaaaaaactagaaaatatattatgtatacaaagtttgtatacacataaaaagttttttacacgtatataaactttgtatcccgtaaaaaaaacaaaaaaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtggagtaccacgtcatggcgtggggcgcctacgaggcgacccggcccgcgctcctcggcctcgggttcatggcggggccagggatcgaggaggttctcatcgagtgcatcaacaggggcaacgccgccgtcgccgccgccgccgccgccggcgacggccagccgaggctgctcgccgcgttcgggatcaagccggagagcctgccggcgaacccgacggagaggcgcttcgtggccggcatcctgtacgctgcgctggagatgaggaactgcgtgcggaggcgggtccggtggctgaggagggtggagaggttcaaccagcggcggcgggaggaagaggcggaggcggccatgaggagggaggaggaggaggcgaggaggaagctggaggtgcaaaaggttcttgaggggtatgaggaatttataaattttaaataaatatttggcttgtttagattcaaggaattaattttggaggtttttcacagtaattaattgttttgatccctatgaaattactactttccaaagtagcacttagccttacaaagtactgaaggatccaagcttcacagtgcacttcatactattgaagggagtagttgcattttcaattgttttcagtggctactcgtgatagaaaccattatatatctttggctgttattgtgacttatatgttctaaactcatccaatttgtttttttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctctctaaaacatcgtctc

SEQ ID NO: 58036 - DNA, 1240 bp, Oryza sativa
tcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcaagcgaaataacgaccgctcttggaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccg

SEQ ID NO: 58037 - DNA, 2100 bp, Oryza sativa
gggatgacggggagccactcttgacttagttccagccatgtaggctagggctttcttattttcttccatgtaatagtccataatgtccttcctaaaaatgcataaatgttaattttttcttcttaattgcagatatttttaatagacaactgaaactaatagatatcattattacctaatagtgtttcgagtcaccatcttaaataatggctgaagtgcagtcacaaacctttgaaatccaatatgatcaacaatagataaaggatactcatgtagtacaatcatggcagcaagctctctcctagctatttgtggatcaaatgtgtacttctccacagatatttttcctccctcctgggaattgaaccttaaagaagactgtgcaagtgtcttgttttgtcccgccatcttgatctttttcaatgtgcaaattttcaaatggtcatggagatgtcttgttccattactgcttttccctccaagccgcttgtggcaatgaaggcattgagccttgactttaccacagatttttactttcttgaaatccttccaaacgatagaagtaagcttcctcttggtgccaaagtccacatcctcctcctcagcctcatcttcatcatcatcaccttgtattggctgagaatcattaacactctcatcgtgaggtggaagtgattgcgagtcttgctggcttctattcgcactacccgcagttgacttcgatgtgaatctgagaagagagaaataaattcagttcaaaatttattcaatggcctagtaacatactgaaatccctttacaaagctgtgaaagcaaatttaaagttcagaccatgttgacgcatacctgcatagcactataaatcaccaaacaataatgcatgtacataagtataaatatagaaaatatataacagtaacgtgcaaagaaatatcccttcaatttgcaaagaaaatatatgacagtaacatcaacaaatccatcatttagtacctaagagctgaaacattcagtacctaagtgcaatgcaatctcataagtcataaactccaacttacatattccaaattgttaaataaaagagctgaaacatataagaggggtagcgtgcttgaaatcgaaccccatggattttaatagacgaaggccgccggcaaaagatgacgtgtttagagtagtcggtgcagaaggagctccaacagctgcaagatggcttttcggcttggatgtggtccttttcaaaggaggaggcctgcgaagggcatttgcattggacttgcgagaggagccagcacccaacccgacgaccgcaggggctgcacccaatgcgacgaccgcaggggcagcacccagcacggcggcggatacggcagtatgcccaacattgggtgtggctgcggcagcgactactgctttacttgtatcacgtggtagcaggtccaaatccatggcagcatcccttcgcgtggaccgccggtcgtgggttagtgagtcaacaatgcagctatggaagacgaataactcgatggagaagaactagaggtaggcgtctatcgagcacagagaagggatgagggattgtagtatgctcaccttgcatcgtcgctgtcatagcttacggggggaggctgaagccatggtcaacggatggcggcggcgatggcggctcccggcggcgcggcgacggcggctcccggcagcacggcgacgacgactcccggtgaagacggctgcaggctggcggcgtgtcgacagaggcagccggtggctctcggtgaagacggctgcaagcgccgcgccggccggtgacgacggcttcaatctcccgacgagagaaggcagcgagtggcagcgaacagtggcgtgcacggctcctaggctcccggcggactggcgaacggcggcggcgcggcgcgcgtgacttgggtggtggttgctgtggatctggatgggtggaggtcctggaggatttggctttgacctgttgacttagggttagattatatatatgcatgttaaatgggcttcaatattatgggccaatacatctaaaaagtctagaattccgccctataagtatagtcgggtcactgtgggggg

SEQ ID NO: 58038 - DNA, 14021 bp, Oryza sativa
gcccccgtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggactgagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggattgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtattacaccagtagcacgaaaagcatgtagccaccatgacccatctactcgtgctgcttaatttgcaatctgcttcaggctattgcattgggtcggaaagaaaaggggaccacggaatatgtatgtcgtcgaggtcgatcggctttagcttgcgtggcacgctcgcaagcttgctttacaccggagattgcgcgacgggcaccggagattgcgcgacgggcataggctgtgtgtccgtctagcctggtgcatgaactcggtccaccggcgccgtcgatacatgctagcaatacgtactcctacgtcaccttcgtttctgtttttttttctgtacccacgcgggtgacgaaaaaacaagagagaaacggatcggatcagtgcatatcacacacattaaatacggcgcgcgaagggttgcccaagcaatgggatactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatatacattcagcaaacttgatgcacaaatcaagcatatatttcatcacattctcgatgctggaaaacagatagtaagatctagcatcctgatttttcattttttaaaaaaaaactttcacaagttagcaggaaatcatattgttagagtatatggtagttatagttatattagaataggatttatttgtgtggactccttccatatctgtaatccttctttatctcaccctatgtactcctatatataccggtccctaaggctcaatgcaattgatccacgttacgcaatatacctctctccctatactatccaatatggtatcagagcgagcgacctagaaccgctgctcacgcttccgtcaccgtcgccccgggagggctccgatctcccgggggcggccaactttttttttctctcttcgcgtcgtcaagtcatcatcctaagagatccatctctcaggcgtttgtgttgtcatcaatcaagcagcagcagcagcgtctccgatcgtcgtcgatctcaccgaccacctggcgcactgcccccgcccgtggccatccacgagcaaccgttgacgtgtggatctccgtcggccatgctaggcctgcctcgccgctgccgctgggggggggggaggggaggggggacggccacctcttcacctcggccggcgtcatcgggccccgtccgccgctgaggacgcccgcctgctggtggtgctcggcgctgccccgcagccatctaccctagcgtgacggggcttgcctcttcgccgcgctgaggaagccacctccatcaaccacgccgccgtccccgcactcctctacgccgctggccaccgttgacgccacctccgccagccttgccatcgatctcttgctgcccatctctctctcttatctgtatacacatgcgttcatggataggatttgggaaggtagtaattgacacacaagagggcgttgtggaataggattgatttgtgtggattccttccatatctgtaatccttccttatctcctctccatatactcctatatataccggccccctgaggttcaatacaatagatccatgttacgcaatatacctctctccatatactatccaacacatatgatggagcttgataacaatgtaattatccaaaattaacactgcatacctcaacttcacaacgatatgctgaacacattttatcaatatttatacagtccatcacagcgaaaaaaaaatcctttgctctttccgtgacatttggagcaaacttttattagaaggtgtcatatcactactacagaaaacatttttccgaacgaggacatctttaggttacgggtgaaccgtaactagtcgtgcctgcaaacatcggtctacattttcgcatacggctacttaaaagatctgcatgcaaaaatcaatttcattccagttcagcgaaaacccaccgcatgttctagttcaccacccatcacattcccattcggcgattggtctagttcgatgatgccagctgccactcagctcttgtcttgccggttaattatcgcccttctccctattgctgaccgctcgctaccacctggagggaagcctggaaaagatggggacgagagagtaagaggagggaggagtaggaaaaccgacccgttcacatgtagcgtccatgtggtcaccttgactcaatgacacgtcagctaaaaccggacataatattatcatgtgaatttagtagtatttcagtattgtaagttaaagacgtgttatatctcgtatcatgatttatggatgtgatttaaactcgaagcaaatacgagggattaaagtgaacttattccgaatgaaacaaaacacatggagcaatctgaactgcgtttggaaagtgaactgtgacaccaacggtcggcgtttggaaacatgggatcgtgcgtccagataaaagcaacaaagaatcacaaatcgattcttccaatctccacccctcgccatcgatcatcgtcaccgtcgccgtcgccgtgatccgcagcatggcggcgccaccgccaccgcctccgcgtccgcgtcaccccgtggcagacaacgacgacctggtcggcgagatcctcctccgcatcccgccggacgaccccacgcgcctcgtccgcgcctccgccgtctgcaagcgctggcgccgcgtcctcgccgacccgagcttcgccgcgcgccaccgcgcgttccacccgagggcggcggcggcggcggcggcccccgtgctcggcgtcctccacaacccggccgaccgcgagctggaccgcttcgtcccggccgccgcctcctccttccgcgccgccgccggcgaccgccgcaagcaccacatcctcgactgccgccacggccgcgtcgtcctctacgactacgactcccactaccccaccgacggccacgtcgtctgggacccgatcaccggcgagcagcacaggatccccaacgtgatggatgccttgacccacccggccgtcatctccggcgccgccgcgggtgggggtggtggctcggcctccttcatcgtcgccttcgtcggcgtgcagaattgggagaggcacttctgggacgcgcacgcctgcttctactcgtcggagaccggcgagtggagcgtccacatcaacatccacctcgacctcgatgggtaccacctcgaggaccgccccgccgccctcgtcggcggcgacacgctctacttcgtcggcaagtcggggatcctcctccggtacaggtatggcctcccgctgcgctgcggcagggacatcctgggccacggcatcacctcggccgacgtgctctcggtggtcgacccgccgccgggcgccaagcgccgcctccgcctcggctacaccgtcgtcatggcggcgccggagagcgacggcggcgggctgcggctgggagtcctgcaccgccacaagctcgccctgtgggacagggaggaggacggctccgccgccgccgccgccgcccggtgggtgtggcgcgtggccatcgatctcgagcaggtgctgccatggccggtcgggaataccaagggcaaggagcgggcgtgcttggccgcagttgccgaggaccccaacgtcatcttcgtcggcacggaagaagacggcgtcttcgccgtcgagctcgattcgctgcgcatcaagaaagtgtgcgaattgggcaaatcacaaggccgtttcttccccttcgtcagctactgcgccgagtcatttctggtatccatctcatatttctcatctgttcatgcaagtttggttgctgatttaaaatgacatggtttggtggtttttattttattctatttttatttttacagctgagcctagcaaccagcaaattgccagcaccagcggcaaattaatccaccatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgcatggagctttaaatgtgaacggaaaaaaaccaattacacagtttgcatgtaaattgcgagacgaattttttgagcctaattgcgccatgatttgataatataatactacagtaaacatttgctaatgacagattaattaggcttaataaattcgtctcgcaatttacaggtggattatgtaatttgttttgttattagtctatatttaatacttcaaatatgtgtccgtatacgttaaaaaaaattggccaacgaactaaacacagccatcatcatggaatgttattaatcgcccaagactcacacgatgatgtcgactccgccactgcatacataactctacgcgagcaataatcatactccatccgtttctaaatactttgacaccattgactttttaagcacatgtttgaccgttcgtctttttttattaaatacttttgtgaaatatgtaaaactatatgtatacatataaatatatttaacaataaatcaaatgatagaaaaagaattaataattacttaattttttttaataagatgaacagttaaacatatttaaaaaagtcatggtgaaatatttaggaacggagggagtaatttattggtgtgggaaattattgcttagactgtcttgtaatattgccttttgctttccttactttgtttttaataaaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaaccttactaagttgtgataaagttgccaaaaaagtggttacatttagtttgctaccaaattttggtaactatatactaaaatttggtaaggttttttttatctaagtgaacacgtccgtcattttcaaagttcaaaaaatgccctatgaatttgcatgcacctctcaagaacaccaccaagataatgagaaggtactgtagaattctatggcgtgagctgagttggcaaaattgacgagtgacgacattgggtgggggagaaagttggagttgatcattcaagatccagaaagtccgtagaaataatcacgcaatataatacataaaagcatgctaattgctttcgtagaagtgctgcttttctctagctgaagatcttgcaaacaggtcacactaaccaaacgattgttacagaggacggatgggtacgtcactaatatttttttaaaaaatacgttgagaacactcccttaaccgcacgcttcaagagcctaagatgtgtttacgttagaataggctaatgtgttgtcaaaattcactgaacattataaatgtttggtaattaactaaatccatctgtatatttattattttttaaaatatagtatgatttaaaataacattaatctgaacaagcccatgagtaaattcagactttcagcacgaaaggcataacattttaagcatggcctcatagacaactagtataaaaaattacagtcattcgggattgtctcgtctctaagatctttctatgaagtttaggtgagaggtcataattattttatagctaataagtcatgggaaaataaatgaagttaccaaaataatgatttaaaagaaaatgcaaaaaacaaaattatgattaagaaactgaaaattcaaattttagctatgaaataagccaaccagtaaaagatgcagctgaaagagctagctaggcggcttgcgtgtccatacctctacggtcctagaaaaaaa

SEQ ID NO: 58039 - DNA, 6370 bp, Oryza sativa
tattaattaactaactaatctccccgcaaaaaaaaaaactaactaatctacatccatctcgttgctcgtgcctaatccacatgactaattattggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaacatggagacgctggactgcacgagcgtcgcagtggacggtgtggtgccgcaacgaggggatcgaacgaatcaacgaatgatcgaaatcctctcggaatcggtagcatctctttaaaagcgacgctctatcggttagtaattaaacatatttatcatttaaactactaggtattgatattaatatgatgcagaaagaattaaaaaaacagattttaaaaatagtctaaaacggtacaccttatacgaaaacgacgctcggtcaatcaggaatttcatcttaaacgaaccatatgtaagccaactcactgggcaccggtagtaaccaacgggaggggagagcaccctgagtttactaggatttttcactggtattggactataaagtgacgcatttgcacgactataacaattttgttatgtgtcattaaacaattatatcatttgacgtaaaatttgagaacaaagtaaggttattttgagaaatatctttactgtatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcaacgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagagggacccctgcactgcactgcaatggcagagaagcccgtaggcacgctgctactataatatactacccgctactgctggttgctttgctggagctggactgaggttggtcaagctagtttattagggtagttcagtacacttatccaactggtaaattattactactactgtaatttttaatttttttctatttttattttgggagaggtttgttttgggttggaatcattggtgcagggtacaatggtcattttgtagttgatgtttcaatttgtattcagttttccatggaagagtgggggctatatatgcatcttcggcagtggctgtatgcacgttgttggtgtagaggctgagttttaatccattattaaaaatatatttgtcatttggtaattccgtcgataaaaaaatgcataggactagtttcttatcggtggatctacatcgagacttataataaagtgcgcgagcggtccctaaacttgtgcgggtatgtcatttaggtctctaaactttcaaaatgcattttcggttctttgaacttgttttgggtgtcatataggtccaaacaagctccaacctcttccatgcgctgatgtggtatgccacggtagcgcctacgtgttagtcggatccacatgccagttacatagaaaaaatataattagaaaaaaaacatattttctcgtctctaccttcgaatttttatctttttttctgtctacctaagaggagaaaatatggtttttaattttatttttttatatatgcttgacatgtgaatttcactaacacgtaggcgttaccgtggcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttc

SEQ ID NO: 58040 - DNA, 1966 bp, Oryza sativa
aattcctgcagcccgaatcgtttagtatcggctcctatctgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaagctatcggtttcttggaggatgagcaaggaactgtatggttgggtgagagaatttgtgtccccgacaacaaagatttaaaggatgcaattctgaaagaagctcatgatactttatattccattcaccctggtagtaccaaaatgtaccaggatctcaaggaaagattttggtgggcaagtatgaagcgtgaaatcgcagaatacgtagcagtatgtgatgtttgtcagcgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttcc

SEQ ID NO: 58041 - DNA, 917 bp, Oryza sativa
ttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcct

SEQ ID NO: 58042 - DNA, 1110 bp, Oryza sativa
tgaaataccctagattctttttttaagcactaaatagtgaataccatggtgtttggcagttattttttaaaaaaatatttgttatacaaatctaaaattacataagaatatttttttgtcctacattgggatttattaacaacattactcttttaaacatagataatttattcaattggatttatcagtttgaggggttttttattccgataaattttcgttaccgtattcgcgccggttcgttttcgctccgttttcggtttcgataatattcgattccgttttcgtttccggtgtttccgattccgattccgattccgattccgaaaaaaatatgaaaacgaaaacgataaagatggattccgtccgtttccgtaccgttttcacccctaactccctccatcctaaaataagtgcagttttgcactatttacgttcaacgtttgaccgttcgtcttatttaaatttttttattattagtattttaattgctattagatgataaaacataaatagtactttatgtgtgactaaatattttcaaatttttcgcaaatttttcaaataagactgacggttaaacgttggacacggatatccacggttgtacttattttgggacggaggcttaacaacacacttatatgattgtggcaacctttgaaaatctgttagttagtgcgagggcattgaattgattaactgatcacttacaatgctcattccctctagaactttgaaaattgatcaattagctagggccccttggaatgaataattgacacaaaaattttaaaagaacacggccctgtttgagattgtttttccaccaaattgttgacgcagtcacacagattgtcttgattagcatgataaattaatatttttgagatataattaaacttcgcaaatactacgttagaatatatggtccgatgaatatggtagaagaatttttttagacattgtattagtagaagtgtagaacaataatctgtggcaaaaatttgggggaaactatgaaaataatagggccataattgtaagataatttgtttctaatggacccctttattcactaaaaagggaaaaaattgggtaagattacat

SEQ ID NO: 58043 - DNA, 27083 bp, Oryza sativa
cctaacaatggtatttgtaaaaatatgtggatctttggtactaagatatataagaatgtggtaaaaaagatgggagatatagacttttatatagatttgtgccctactcttgttagcggaagctagtgttactattatatatcaatatctcatgattacaatattaagggcgacataatctaatctctatcagcttagcggcgtaaagctctcacatttgctggacggctagcttagtccacttcctcgaataggaactcaatgatattggatgtagctctagatctctctggtcggcttgtggctttctattgggtttgtctagacttgccttggtgtatgttggtgtatctttgcttgtgtttgtttgtattgacacgtttcctctcctccgagagtcttgtatttatactctcagggtgcccacctgtccaagtaaaaataatgaagtaaggctatgttctttaacacctcttcccaacttctactctttcgttttttgtgtgcacgcttccccaaccactaaatggtgcattttttaaaaaatctatatgaaagttgatttaaaaatcatattaatacatttttcaagtttattttagctaatgctctattaatcatacgctaatgaatcactctattttacatgcggggaggtgaagttcccaaccttcaccttcgaacataacctaagtatagatacgattcaaatagaacttgtaatatttgagtaggactctatttctatttttttaatatgaaggaccttccaatcttccatgtatgatagtatgaggctttattccgtatatgacttgatatatggtgaataccgccgagtctaatacacaagtatgaggtctcacgtatccaggacacagatagtttctattctaatttcttcttatataaataaaaaaatagccttaatggaatgcaatttttaattgtggataatggattaccacgcacacattttcaacatcctaaatggcaaagaaaaacttactttattatttgtaaaataactttttacaacatttttcaacaatctaattatcatttcattcctttataacctcaagtaattgtcacaaacttatccatgagcacattcatacagccactatatattccctgtgatactgtgtttttctctcaactttcccaacctctcatctctcatttttcgtgtacatgcttcctaaactactaaaagatatatttttcacaaaataaattctataaaaaattactttaaaaattatattaattcatttttaaaggttttatagctaatacttaattaattatgcattaatcatttggttttgcgtcagaaggatacgtgttgccctctagaccaaacaactgtaccggaagcatttccacacgcccccattactcgtcggaacttttgaccggcgctgaagaaaacatatcccgcaatcaatgatcataatcagcccctaaccccttcccttcctcccttctccctttcccctcccctgaacggcttgtacggaggaccggacagctgggcagccagacgcgcagggacgcggtcgacgactcgtcatcacaacacactccgcccgcgtccgcgaggacgcgcagggccgcacgggggcgcgcgcatccaagccgtgtactcctggtgtgtacgtgccggagcgagtacgcgaccgcccaatggaattcgcggccgctttgaagaagcttgatgcttcgcgctggcccgccccgtccccgtggttggttggtttggtttggttacttgctactactcctactacgactactattccctccctggtttgctcggacgaacgagtcgtggactcgcgggttgggtctgcgcgtctgaccgcgtggcgttgctcacacaggcgagcgaaagcgagagacacaggcgggtggggggcgacagagagggagagggagagggagagggagagagagacgccgccggtttcttccgcctgctcccgctcgttcttcctcggggtgggtgggtgagccggtccacgaggcggcgtcggcgacggcggggcaacactgccgcagcacaggggtcaggagacggggccggcgttggcggaggagaagattgggcacaacgagactatagagcaagcgacgcctccttttctttttttctccgatccatcaggtgaactaggccatgcgtctgaacttgtctcccttcccccctcttcctccggctgcttcatcggctccttaccttgttggtgacctagaaccgcgtgtagattggcaagattattttttgttttttgtaattttttttgcatgtgttttctcgtgattttaggggaagcttctcccatctcgttgactattgagaacggatattcgaatggagtgagggttttgtatggctaatcgtgagctgagctgggtgatctggtcttcgtgacagttctgagcacgaactggggaactggcttcgcattgaggttccaagaaggtcaccggatttggcgcatgggggtctccgccagctgcttgtggggtggctccgagtcgagggggaaccaaaatggttctgctgcggtgacgtctcctcgttcaggtatagtatttcactcacttggttccagagatcatgagctagctaatactgtcagaattttaatgctgcttgcatttcaaggtctgcatttgcatttaggaaaaaccagtgttgttttacatgaaaatggcgattaaattactacctatcctcttctgccatgtacacatgttgctccaggatatatatggttatggatgtgtcgaacaatcattctttggagagtctactgagaggattttctttttctttatgttattgaagcattcaaagggatgaaatgatgagaaattcatgttttttttaataataggaggaacgtctgaatattttctgtcttttcatacataggaaagtgttgttggcaagtttctctttttaagacaaaagcaaggctcaacacaccaaaactcacacaatatatgcttcatgagtataatcatcactcaagataacacatccgaaaaaaagttcttgatgttcttatgtcttcctttaagcagtgccatctgcaaggaagttttgagcgagctacttcctgcattagggcttaggggtcctgttggaaactatactgtgtaaaaaaaaataggaaacaccatgtaaaacggtatgcattataattaatcatgcatatatgaggatattggtcttaaccttagagcagtcaaccttaatggccactatcatgttttagtgaactaatacatgtacttctttttattacttctctttcctatttttctaaacaaacattgatgatatcacctctggaagaaatgcaggtcaagtaatatcaagagctggaagtaatgtacgagtcttctccctaaaggagttgaagcttgccactcgaaactttcacatgatgaactgcgttggccgtgggggttttggagcagtgtacaaggtgagaaatggactcactttgtgcatcatattttcctggcttcttactttatggccttttattttatcatcacttgctagttttactgtaagaattctctcttgatattttgtaataatacgttttataagtctgcaagtatataatgaataacaactaacaagagtctccttcacttagggaaacctgaaagatggcactcaaattgcaattaaaaagctgtcagctgaatcaaagcaaggggcaaatgagttcttgacagagataaatgtcatatccaatgtcaggcaccccaaccttgtaaagctaattggttgctgtgttgaagggactaacagactactagtgtatgaatatgcagagaacaatagcttggcacatgctttacttggtaagttcattaaatcaatactgacatattgatcaagtaaagtccagccattgtgttaaatttacctttgtgatcaggaccaaggagtaggtgtattccgttaaactggcaaaaaagagcagctatttgtatcggaactgcttctggccttgcatttcttcatgaggaagcacagccacgcattgttcatcgtgatatcaaggccagcaacattttacttgataagaaactacttcctaaaattggagattttggactggccaagctttttcctgacaccattactcacattagcacacgtgttgcaggaacaatgtaagtacatgtaaatcttttgattatttacctgctcttgtaatggatctatgcacattacgtgtagattttttccagaataatcagctcagtgtatgaatttttccaggcagttttgtcagcttactattgttgcctctatttctagtgacccaagttgacctgtcattgtcaaatcacttaaattgcatcttgcttagtctgtgataggatcattttacttatcgtttgggatgttatttctcctgcaggggttacttagcaccagagtatgccttgttgggacagttaaccaagaaagcagatatatatagttttggggtccttgtccttgaagtgataagtggtgaaagcagtagcaaatcgacttgggggcaagatatgaatgtccttgtggaatgggtaacacacttttctctcctcaccagagcactagtttgcagcaattttaatgcccacatcaactcttgatagcagtagtattattcattgattcatgacagtgtaccagcttttccttatgacatacatctacatggtcttgttcatctggaaaaaaaataattaaagctttgatgtggtttaaaatttaaatggcagacatggaagcttcgagaacaaggaaggcttttggaaattgttgatccagaactggaagaatacccagaggaggaaatgcttcgtttcatcaaggtggcactcgtgtgcacccaggccacgtcccagcagaggccatccatgaaacaggtggtggatatgctatctaacccaacagaaatcagtctggagaacttagtcgcaccaggtgtgctgaaagaaccccgccatcattcaagtagttcgggtttgacaccggacacaacctcaaacagaagcaccaaagccaatccagctgattcctacagcacacagaccagagacatgaatagctatcagttgagcacgattgaggtgtcgcctaggtgatacggcacactgcgcgctttcttgccagattcagaggggctcccacattgtcagattttgctgcgctgacagagttttacttggaaatgagaaagtgaataggatatgcttaaagccctgatccatatgcatccggattgaggaaatacacaggataggatgggcattgctgtgggttgctgttgtacacttgtacagaacttgtagttatacttttagggatgcattgcaagagtagtgatgtcttcagacacccaaaagaacttcaccattcgaagacgtggtgaagaacagggtgaagagttgtcacgtgatgatcatagttttaaggcttatttggataggcatggattaggtttaatccttccattttgatgcagaattggttcattatctctgcttatctaaaggacttaaacctaaaccccacctatcgagacaggcctttgatgacattaccttctttttaccgcttattggcccaatttttcttacatcgtagctagtgcaaaaacatgtgatttgagacaaatagttggtttctggaaatcctttgtacactgattttttgttcttttgggatattctcatatatgaagtgaccgtctggactctggactgtatccatttgtgataatattatagtgttgttgtattgaattttcaacagcaattattggattcctgatttcgtgcaatcaaactcagcggggaatgtgcgtgtcattaaatatcaagactattgagcttacacaatcttggtcataaggtgtgaattaccatcacaccccttgcttcttgggatctaaaatgttgataattctgccatgaggatgttttgtgagtgtagcataagcgatgcccattcgcttttgggtttcttttgttttctccaacttgctttctgctgtatatatactctgtagctgcaggggattatcatataatgttggtcactgctattgtttctctgctgtctttcttttttctgtaagggttttcatgctaaatgtataatctttggttttgtgccgggtttaaacctatctttatctaaagacgtctaaaatattcaaaatagtctctcttttttttttgaagtcattcaaaatagtctttgttttgatgtgtatcttaatcagcacatttagtgaatggttatcaaatgattcaaagtatagatcgcacataactccacatgaatcgactgcgactgtgtttctgtacagtgcatattatagttattatagttatataatataatgaatctgcaaattaactgaagatgatagggagaagaacttgcacaaccgtgcaccaaagaggatgacaatacccctgttaagcccttgcttgatttagccagagagcgcactatacatgcctccaccaaacaaaacaatctaaaagcatatacctttctaatgaacacagctaataatagctcacgaccataacctccagtttattcgattcacatgacaacataggcttattgcttctctcaactcactgatgatacctttcctgctaaacatgcagcgagaagaaccatgaacaagaactaacaaaatcaactctcttgagagagactctattccttgtctacgaaagctgattcagcaagatcgatggctcgagccagagcggctgccttgttctcgcattcacgttgctcgtcgtctgggctgctatcagcgacaatgccagcaccagcctgaaggtgagcgacccactcccggcgcctctcggtgtctttgtatgagtacatcgtgttgtggcttggcgctgttgagaacacaatggtgcggagtgcaagagcgataagcatgtctccgtcaaatgatatccctccaaggccgccactgtatggtcctcgtcttgtgacctctagctcgtctatcagctccatggctttcacctggttatgtcagacggaattttgttaaacaacggtttgttccagaaaggaatatgaagtcctgatgggtaaatgagatgtatttgttactgtacgcaaaaaggatatgagcaatgtgatcgaagtcaacagagcaaaaaaagaaaaaaaaaggaaaaagttctagcataattctatgcagtagaagacttcaaatagactaccaagaggctacactgtcccaaccatatggcttgtattgcaaaaatgcaaatatgtcaaacaatctctactgacatgagtgtggaaccaaaatgatctacacaaagaataaatttggcaaacatgcttaaaaaaaagacggaatggaggttggacagcacatcactagatccaaataaggagattgtaggcaacatacctttggtgctccactaactgttccaacaggcaacgcggctcgcagggcatcccaactttggagatgatcatccaactctccactcacctgtaaatcattcaaacaatacattgtttttcagtgtaagtacagaagacaagaatctcaaaggcgctcagccagcacacttacgtaaaagagcactacatagtactaagacacaattcatacttttcatagaaaccgagagagagagagagagagattatatccagaaaccaactcattattgtaaccattgctcattacacaatgtatcgtaccaaccctagaaaagatagcagtgaagatcagtcacttgtggtgctactaaaagctttgcactttcatgtctattagacaagacacatttgaaacatagaagcgtcaaaattgcagaaattgttggctgtttataaaacaagccaataaattacttagaaaccacatatccattttgtcgcataggtaatacatctgatagtgttatgcatactgagttaagatcctagattttcttagcataaaaagacatttgtctgaactaacaatgcagactggaatgctgaaggaaataataatgacgcaacattgccaaggtatataatgagtacagaaccattgtttcacagtatagaagaagagcctaaccgtggaactgatgtgcatgacatgggagtagcgttcaatgttcattaatttctccaccttcacagatccaggtttggagacctgccaagtagaaagtaatcataagaaaagttgttaacacattcctaacaaatctgtcaaattaatgcaaccatgactcagccatcgaaaaaaaagaacacaaacctttccaacatcattccttcccaaatctacaagcataatatgttcagcacactgtttttcatcacttagtagctgttgctcttgcatttcatcttccttctctgtcttgccccttcgaacagtcccagcaagtggacggttaataattttaccctgaaaaagatttaaaaggatgaatgttaatgaaaagaaaaaatgtattccaactatcatcagtaggagagtttacataccttcctcacacgagtaagaatttctggactagatgctaccaggacacagcctcttgcctaagagatcataatagtatattattatacataagagcgtttagtattatcttatacaaatgttagaaacagataccagtcaaaataagcgcatagtgtaaatatacctgtacatatgccatgtatggacttgggttcacaattcgtaaagctcgatagacttcaaatggattggcgtatgttcgcctctcaaacctctggcttaaaacaatctggaaaatatcaccagccataatatgctccttagcctgcataacagcattcttgtactcatcacttgtcatggttgatttgttcaaaggtgtaccaaactgccgagtgtgtaactttacaaatcctggagaaagcttgggtctggagtgaaaatgaaataagatatagaagctgtgagcaccaaagcagaattagcaaaacacaggattgaaggaatgggcacaggttagcttacacatttgaattgtgcactttagatagcaacaggttcagccgggacttgccatcttggaatgcatcctcggtggttgcatgccgatcaagatttacccaatggatgacatatactttctgcagcaaacacatgaaccaaagaatttgaaatggatataggttttccacaagttgtaactcacggtctcacatttgcagcaagttcaaattctggaactaccaatctacaagttattttatgtcacaaacaggatgagctccgtggtttctgctgttgttggcaaccaaagagaagaagcacaggtttgcaatttggcttcaaatttagtgtaggaaatagtgtgttatatattactagctaaattgtgcattgcaacagatttcaaaaaatatatctaaagttcttgactaaaaattatatttttgttggaaaaatgcatatataatttgcaagcaaacatcgaaccacaaaaaccaaaccacattcacagagatatatatttatccagccttagaagatcccaccaaatctaagggatggaagattcaccaccactactaggttcttttataaagagattttttttcttttgttactgaaagagatgctcctactgatagtctgatggtgatgaagaaaatccaaagtataggttgattctatgataatcctcctcccaggcaatcaaataaaatagcccataatgagataaaggaaatgacactgaagaataagcaccttctcgacattgtcgaagacgagaacatcatcataaagcccaaggtgaacatcaggaaggttcctatcgtcctggggagcaccggagaagggcagcttcttcttttcaacataacggactgtatcataggaaaagaacccgacccatccacctatcacaaacaaagaaaccaaatgccatggttcacatttcataaccaacaaaatcaaatattccccatttcttcttcctactgtttgatttcgttagctcaccggtgaaggaatcggggagctgatcgatctgctgcgggtgccatccttccatcatgctcctggggatctgcataggatcatccacgacctgctccgtcaccttgcccttctcgtggtccatgattgtgaccttgtgctcctttgccacgacctccatcactgggtgggctcccaccatgctatagcgacccttcgaagttcgaaccaatcaaggcacgcagtgttatttgccaaaggataagaatcgataagggagcagattggaaggtggaagaacatggaggggaggggaggggagaaggccgtacgacgttggtggtgccctcgggcccctgctcgacggactcgaagaggaagctgggcgtctccatgttgtcctcggggacgaggcagcggtaggcgagcacgggggtgaggtggtcggagacgatgcactcccacatgggcaccaggttgcccttcccgctcccacgctccgccgcctcgaagaagcgcctcctgtcctcctccgccgcccgcgccgccgcgctcccgttgatcaccgcgcttgcctctggcttccccgcggagcacctcacgccgccgcgcctactcgtcctcctcctccctcctgccgctaccgccgccctcgctctaaccggggccgccgccgccgccggagtggcggggcgggcggcgaggcgcgagggcgtgaacgtggcggcggcgatggactccattgcgataggctttttttccacagctcgtcaactccacttccccccactacgatttggagcacacgcgaatgggagagcgcgtatatataaggaagattcagcgaggcgaccccaaaggagttcgattcttgaattcttggattgagacaggccgaagtggtagtcggattttaccaacacggagtgggatttttttttttttcgtcttcctcccgtcgtgaggaatggttgtggccggcggcggctagcgagatgggtttttgggtttactcttcctcgatggggagagggagacggtgccattataaactgggaaaaatacgtggaaacttaaaattacaataaaaaataaaatgtacgagatttgttcacatcatcataagtactcatgagtaaatcgtgatgacgtggataaatgtcggacgtccatttttcgatccaactgtattgtattttttaagtttccactacatatttccccttataaacttacctattttaaaatatatcattgttatttactattcctatttgaattttacaattatttttgatatattactattttatatatctatctggtggattcattaaaaattttgatcagcttacccttctcccttcccctctccactcactcattttcaatgaaatgagcctaaccacgatggtcaccgatccacctccacctctccggcggccatctctccctatcccctcgccaccgtcgcgcgttccctcccctctaccaacccatctcctcctctagcgtgtgtatcagggaaagggaataattcgaggtcaacctcgtttggccaccttattgttcccctcaagccgaacggaacctcatcttgaattcaggcgccacttagagactctgtcgtcgtcaagcaagtgtaggttggcgagccacctaggcatggccagcgtgcttgtcaatgatggaggtggattcgatagtggagtgacgaggaacacaaacgtaggatgtcaatggcggtatcgaggtcgccgattttactctgcccgaagtgagaggggatggagaggaagagaggggaaccgccgacccagacctcgccatgcaccactgccggaatgagtagacaggggagaggaagagggtaagtagtaagtagtggtaagtagtggtatatctcaaatagatgtaaagttgtaatgtcatgggaccaaataggtgaatggtaatgatattttttaagagttgcaaatttgttatgacatggatccaattaacccaaaaaataaaagaggggataagaaacaaccatgctctcactagttactacttcctccgtttcatattataaaactttttagcattgttcatattcatataaatattaatgaatctatacatacatatatgtctgattcattaatatctatttaaatgtgggcaatgctagaaagtcttataacctgaaacggagtgagtagtaatgttctcttcatctagaataagtttattttttatttcctcacgtttgtcccaaaataagtttatttttaagtaattatcgtatcagagtttatgaaaatacgggatgaatgtgttaaaaatagataaaaatagggaataattacattaagatttgataaagtgaaggtatttttttaaaagtttgtattggtatgttgcaggatgagtaaaaaataaacttgttttagaacggatgatgtagcagttgccatcaatagtctctaaatcgtgggcaaaatctgatgtgatttgcctcgttagagacgtggaacaaatcagcataccggcccggacgagaccaggttaacgattgtttcgatcaacacaggaaaaaaacagatcccgactgaaattttagatgcttgtaaggattttaaatttaaaatcgtaaaaccgattatgaaaagttcaatcgaaatttagcaaaaacgatggtaccacagcaacgcagaatacccacgtgcccccaccattccaccaaccactcccgagtaaacaagtccattcaacttcaaatcaaaccacagcgccggtgaattggcggagtctgtcgctcgcgtcggtcgcgcggggacggcgatgggctcggcccgcggagccggacagaccggaccggaccactcacgctcacgcctgaatttgccggtgcatcgcacgttgctcacgcatagtacaacgcaccatagtgcactgtgcaccgctgtagcctgtagctgtagggtggacgagcgaaacagtcgtgcgcaccgtctcgtcgccgtcgcctcgcctgtgaccgtgccaccgtgcgcgaagctgcgcggaagcgtactcgcgcgcccgcgcccgcggcaccacggcgacggcaacggtaggtgggtctcccacctctctctcccgtcccgcgcgtgtccgtttcgttgtgcgccacccgcgctctcggtctctttctctccgcgagataaacaagacgatgacggggaagaaagcgatggcagatgtggccatggcgcatgtgggggcatggtttgcacgacgaggggaggtgcgatggcgcaacatgccggcgtgccgctccctccgtccgtcctcggcgacaccgaagtcttcgcgcttttaggtttttgtgtgttggaaatggaatacggtggtggctcggtgacggagaccatcgaccgagaacagtcaaccgacggccgggccaacggtcagcgtcagccggcgacaacggtctcgagacggtgctgaacaacgcagactcgtccacgcaaaaaccatttgaagttctcaactggattctcccccagatcaataaataaagtttggatcttccttgtacacgagtactaactaacacaaattaggacgacgtgatgttctctgatcgagcccggtacttgactacctgtccggtggccactttgaaccggcgtctcttttattattttgccgttcaggggttgttcacttagacccatcccattagcagcagtgttactgaaaaaactcaataaatcacgggtcagtttcatacatcaaggggacatgaaaaatgtcaatatcaacaaatctaaactgctcagattgatccggatataaacaaaaaggaaggaaacagagagttatattgtttgctcgttttcttcacggatggaaaggctatccatcaatcatgctataaagaaaaggattttgtcacgtctttttcagctaattcaccccatcattgaaatgtactatttggtccaccattaaaatttatgttttctaaaaaaaaatattctactacttacgcctcatgtttaaaacttttaaatttattttttttcaaatatttaatttattcttacgatcaactagctaatctgcgatagtaatccgctcaacaccttaaatcaaagagaggtaagttgctgaggtctacatgagggagcaaggttgctgaggtaagttgcaagtgaagcctatggggaacatggatggagcttcaaaccaagaagattgcaatgaagctgtttgggttgtccttcaaaactccttgttgccttggctctctagggcatgctcaatgtatatagattaccttagtattatggtgggacccactgaaacatattatcatgtccacaatgtatatgtcaagagtggatattaaggtggatcccacaaacccaaaattagctattgagagagggagagagagtaacactaccatgagagaggaagaagtactatattttttttattccttgtgggtagtctttatgcatatggctagctcaagcaaatgccacctataaggattacactcacaatgtataaagttcactttagaggcttaaaaccaacccttatgttcacattgtggttgcccagagactatatgaactcttttcctggagatgtaacccaatgtttgagatgttgcaaaacaattagagtagcgttttggctcatgttggctttagggttgtttagtacttttgtgactcagcgtcacggacaaattgggaataaacaggaaagatacttcttttcatgcctatccttgaggtgaagtgaacttgagatgtattaacgagctcttgttgccactgctttttcccaaatgttacatggcctcgttataggattagactggcttatacaacctcaagaggtacgtgtgaagttacaggaatgtcctcaaaaagcttggaaccctaagggcatatttgtatatttaggcggtccttagggcttgttgcaggtactagcttgcgggagtggttggagcggtccccttgttatcttctgtgataatattctcgtctggtggcgtatctacaaagctccttcatcattcttcatgtaccactcatctcatgtagtatgctcgaattgtatcttcctgaacactcaactcgaacactacttgcctagtttgcacgttgttccctccaaacagcttgatcctcttctagttgtctggttagaactcgagaagtatttacctctggttaaaaaaatgcccgaagttacatttggatcgaataggaggtacaaccctcactccctcctacagtagtgcctaacatgaatctctatccccagtaaacccagaggtacctaaaacatactgggaaaaaaatagatgatcacacgagggaaaggaagtgggggaggcgtttttttagctttcttgttatttttgttaagacctactacctccgttttttaatagatgacgccgttgactttttctcacatgtttgaccattcgttttattcaaaaaatttacgtaattataatttattttgttatgagttgttttatcactcatagtactttaagtgtgatttatatcttatacatttgcataaaatttttgaataagacgaatggtcaaacatgtgagaaaaagtcaatggcgtcatctattaaaaagtggagggagtatataatatcatttctattacatggaaattaggagagtttggttttctttcattcaacagaaaaggacctgtttggcatagctctagctccagctccacctctcctggagctggagctcagccaaacaatttcagctccatctaaaatgggagtggagttgggtggagctctctcacataatgaactagagagatggaattgggtttaggcagctctacaactccactccagacttaactccagaagctaaatttagaagttggagctctaccaaacaggctcagaaattcatctggataatcaagcccaaatcaatgctcattgcggcccatgacgtataaaggctgaacaagtctacgtaggcccactaaagtaaggcccaactgcccgagcgcggtaggttcgaagcccacgagaattaaaaacagagctcaattacacatgccaatcgacagagcagagcaaaactacaaaaagatcaatgtaccattgaaccatattcatcagtcgatagttgacgcaggaccaacaacaacagtagtagcaggtacataagaacatggcaaccaagctacataacttacgaccattgtgcagcgtgtggtagaacccactcgacaatactcaacgtcagtgagaccatcactgtgctggatgatgtgtcgagtgctcgatccgatccagccagaggcaggcaatgtgcagtggcacccagctccatgcattgccgatcgagtacactcatagcttgatgtagccaaaaggaccagaaggccagaacccaaccggtcggacagatcaacgagcagcgagccatgcattttgccgctataattgaaccgagaacgagatctcactgtacgcgccgccgtgaccacagcccaacgtacctaacgagggaaaaagaagggctatacactagtacgacatgcaggctggccgcctcgtgccgctgccgcaactagcaactgtagatgatgacgaagcatgggagcacggcacgggggttgaacacgagcagctcgacgtcgtcgtcgccacgggtagctgcagcgaaggaggaggttggcagtagtggaaccatggagtcgtaggccaccttgtcgtccgcggcgccgcggccgacgcgcccggccacgacgcggcacaccagcatggcgcggcgcacctggaggaacgcgaactcgcgctccacgtcgtcggggagagaggcgtgcgcggcccggccggaggagtaggtggcgatgccgtccacgtcggcctgcttcccggcgaacccgtggcgcaggatgctgcaggtgcagcagtaggggctcccgcacacgcccgcgcccagggtgcagagcatggtggagcagtagaaccgcagccgctcgttgccgtccgcgacgcaccgctcctccaccgccgccgcgccggcgcccgcgcatcggcgggcggcgcgggcgcggacgaggtcgcggtactcctcgaagcgggtgagcacgcgggggttgtggtggatcctgaggatgcgccgcaccgacggtggctcgccggcgccgggcataacggccggcttccacccggcgaggaagatcatgcggatgatgttcatgctggagtcgaggctggagagctcggagagggagtgcttcatcgcctggtggagctccagctgctgcggcttgctcagcacctcgccgcacaccttgcacgggaacacgtcgccgcgggcggcgaacgacctgaacgacgactgcctggtggtcgcctgagggatctgcctgttgtgcggcgacgacggcaccgcaggagtaatgctgagagactgcggcgagagcggggacaggaacggcgacgcgcatggcgacgacggcgtggacagcaccaccgacgacgaggcctggcgctgaggcaggcacgacgacgactgcgcgagcggcgacgacacggtcgtcgtcaccgcctcgtcttcctcctccgcggctggagcgccagcgccgttcttggctccggacgagtaggagaagatgcggtggaggtagaagcggacgctggtggctagagacgacacctgcctccgcctggctctggacctctcgtcagccaccgtagaagacgacaccgacggggagaacgcgagcggcgatatcttcctcctcttgctgccgccgccaccgccgcccctcccgtcggccccatgtccagtgtcatcttcctccagcgtctgcgtggaagatcccgtcgagaagcagcaaccggcatggccaatgtggatgaacaggaggaagaagagtgacacgaagccacggagcagcgagctgcacctgccaccgcccgccatccccgtatccttgccaccgactgagtcttccgcgactcagatcatatgtgagcaaagcaaacaatgggcgcgacgagagagaggaaggaattctccggtgggcgagtggagatgaagcaaggaagcctagccagggaggagggcgacgaaggcggaaagggagggagggaaaagggagcgcaacgtgggctatgtatcgcgcttttgtgttggcacgaagtacgggagggcaaaaggcgatccggcgacagcaacagggtggcctggtacgcagtaatcagcacttcaccagcaacccccagcacgcaccgcagcgtggtgctgccactctacggggacgatcgtgtcagctgtggcggtggaacgtttagccgcacttaaaacgagaaatgtgattagcatttgattaattaagtattaatatataatatttttatgaataaatttgtaggatttttttaacaactttcttatagaaagttttcttatgaaatataccgtttagcagtttaaaaagcgtgctaataaaaaacgaggagaatctaatcctataagctcaaaacgaccgcaccctacaactctgccagcggccagcgccatgcctagttgcattgaataggagagagtgagattgtgacctttgtgagaatgaccgagttggatgtgctatctatagagaccagctaggcgatcggggctagcaggatgaatgactgaactgggacgtgtaggtttggagggcgctatcattgatcataagctctaaccctgaccattatgtcccccccccccccccccaatctcaacaattattcatcaggtctcatgccaccgcattatcatccatgatgcacgctgtacaggaccggtccaggataaaactagcagtttttttactctgcccaacggacttcactcctcgtcagctgggaagcatgcgccatacgctcccaaagagataaaccaggcagcagcaggcggcagctgcgctgaggcgagcgacagagggcgggacaagatacgcctgtgcctgcctacgctcccaaacaagggcaaaacgtgcaggcaacggcggtctgaccgtgcagatccccttgcctgctgctccgtcctccgacttccgtgctcttcatcataccccacgacaaaacaagctggatttggcataaaatacatgcattttgaggtgggcacacaagtcagatgtcgatgtgaatcctactccttatcttaccttgtcaacaattcacgctcatctgccataatggaggttctgaacatccgatgtgcctcaagtctcaacacagcgtagtaaaacagatcggaagccacaatccagcaccggataatcatctatccaggcacaacgtactcatcagttctctggaatccgagaagctgcaaagctcagtccttttctaaagtttggatccaaactttacatcacatcaacctgtcatacacacacaacttttcagtcacatcatctccaatttcaaccaaaatccaaattttgcgctgaactaaacacagccacagcccatagtgccgcgccccaaatctgcgccttgcacaaggaacgaatgatgctggctgtccggcgcacaaagacacagcagcgctcttgagattcgctgtcattacgatgtcatggaggtgactattgtaccgttgtctgcgtttcttttcctaaacgaaatattagctcatgctttatggtacaactcgccatgttctgagccaaaaggaatacttgagcccatgcatagaaacagtgcaaggagacaccagattatgtgttccaggactccatcatgaaacgcaaaaaggtggtcatgggactagagcatatgaactttatttatgaatcatgctagtcatgggaacttaagatgaactcttaacttcctactcaaagtctacaggcataatacaaagataataaagctggaagtacagtacggaatgaattgaagtacaaataacaagcccagaacagtaaacataccaactgctaatttatgatacaacgcaatatctagtggcccatgaaactaaatgtcacacctacccatcaaacccattcggcagactacacatcgcgtacagcccttagccatcaaacctcatactccctttgtcccaaaatatgatgaaggattttggttggatgtgtcacatccggtcaaaatcacttatattttgaaacgggggagtagattccaacaaatatagcgtgaagctgtgtggacaaataacgagctgtaaattaacatcaaataagtgcagcatagaagcaataacatgttcatcatgctctaatgcattacaatatgtttttttttactgtggctactagcctacaaagagagtactggtgcatcacataacattcgaacatgaccaatcaagattaatctatgcctcccattgccgtatgctgatgctaataaaaaaacacctatttgatatcatgcacaaaaaatctctcttccagacaacaagcctccaaagtccaaagaagacaatacgacgttttgaaaaaaaaaatacaccatcattcttcacataacacttctttttttgtggagatcgcaataactttttttgagaggacataacgcaataattgatattgataaagtgagcatgctcatccgattctttccttgtgctactctaagggttatctgagataagttctcttgacatatgacacatccactttaccaactaaactgtacataatctgaacacaaaaaaaacagcacttttgctccttaaaacataccaatgatgttgcaacttgtaacatactgttacgtcaaatgaagcttcaaattcaggcaaggtttatcataaaatcatagttcaggtttcttcacccaaaaaaaaagttcaaatgccatgacctgctgaatcagacatggagcaaaaccacgagaactgtttaaaagagatgatccttcatagaaaagaattgcgatgctagatgtcacttgattggagagaaagtggagaaagagaggatacactagacctctaaaagaaaatataaaatgaggctcatatttgtttttcttgtagaactggggacacaggaatgtactccataagaaatttgatagctctattctaatgttctaagatcctccataagaatcagaataccaatcctaatgttgtgaaaattctacaacaaaaaggaccgtcaataataattcatttatatcaacacatattgtttagaatataagcatctcggccagcatcatagatttttggtacattgaattttggcaagccagcataaaaatagagtacgaaaatgctcaagcatatttgacccaacaaaagattggtacgcaaaattcaagggcaagtcagcggaggaatttacacttccaaaagaacctatccattagctggtactatgttctactattagcttccagaaagatatgatcagctatatcaaattatcaatgcatttttaggaaggtaagaagaaattaagaatgataagttagttctatgtcatgctctttccgtcaggataattaagagtaagctgcataacaatgcctcatagcattgaggatgctaaggtttgcttgaaactatcttgtattaagctgagctcctcaagctaagggattaggaaaagggatatgaaataagcttaccaacatccaagggatttgatcaccacaaaatacagatgcagaagcaagaattataacattaccgcatcatgacttgagaggaattttcagtactgaataatgcgatgctatggtagaaaatgcacactcacgtttaatagaaccacctgaattgccacaggtcaatcatgttcagacaagcaaactgctaagagatagagagatagcaccagccagctgggaggtctcccacacctccacgccttgcatttcttctctggtaacaaataagcggtctccacccccttccatgatgtgtatcataccacggtcagcatcctcttctgtatccacatagcaactcctaaaacagttctcgtttattccttcgttgttgatgttttcctttgctctcgtttgctccgccaagttggctgtgccattgctctgttcttccagtcgagaccaaacctccaatccatccttccggctgacaaacacctgagacttgtagcaatgcagaacactgccatggccccctccactccctctaggtcctgacgacatataaacccaagggtctttaccaaggcatctcaagtcagcggctccaatatctcctgactttgagcacaccttgtatagtatctgttgcttaacgtcaacatccacatctgcaaatggatctccaaaccggctgcttcttccaactccccctggctcgcttgtttcccacaccacatccccagaacgaatgtcccacagcctcatgtacccagagtaaccaaatgcccccgagctcacagatgccgcaaataccagcccaagctcctgcaggtgcactactcggcctggcgccgacgacttagctgcgctgccagtttgccggccaatctcttgaatgggctttagagttacagggtcaaacaccaggatgcaattctcccggtgtgggcactcgaatgtagctaagatgggtgaattcttatcagctgcatcggcagcaggacgggcggcaatggcaatcaccttggccttttgaacgcgaaggtcggtgggatctgaccattggacagaggcgacgtgccgacctttgaggaggtcgtacacatggagccccggggagaggctggacccggcaacagcgaggccaggaggcagctgccggagggaggtgatgcggtggagatgggtccggaaggtggtgaggtgctccagcgcaggggagtagtgggtgagcaggccggcgccatgggcgaggcagagcgagccatcgtggcgcggggcgagcgcggtggggaagggctcggagggcggggagagcgtggaggcgcgggaggcggagaagccgaggaggggcggaggggagagggcggcgaggagctggtcttggaggccgtaggagtgggcctcgtcgaggaggacgccggcggggaaggcgggcgcggcggagggggcgcggatggcggagaggatcgcggagagaagggcggggtcgcggtccacgaagattgggtttggggaaggcgagagagagagggagatcgggagggagcttgcctccaaggcgaagagcttgccgcccacgttgagctgcttcaccgtgccgcgccggccgccggcaccggcggcttccattgatgcttgctctcaccagtcgctagatgctgcctgtcgaggcgacgacttttctgactccgccgactacagtcctgctgtctaggatacggccttggacttgggctagcccagtccgcctaacaacgtcagcccaactgcctctaggcctaacagccccgtactgtttctctttctctctctttcctttgaagaggaagcatatacaccctccatccccaaaaaaaaaaaaaatctacttctatgatgaatttagatatgtatttgttcaaattcagccacagaagttggttttttctaagatggagtagaggttagtggctatcatgctcctccatgttggtgtttttaccatgagatatatttgcaagttcatggggtttgacgcttgtaaaacttgatatcaggaatttatactcacgattttagtcattttacatgcctttctactatagagaattcctcgtgtccgtccaatagcctaatataatcatcagaaatgtacacggggtaaacatatagcgaaacattgactttataacgaagtgcaggggggcaaacagacctagctagagcagaagatctcgaactttcactggtctttttacagcatttgtgaagccctgtaaatgaaaaaaaacttcttagtgacattgcccaagaaacacgagtccaaactctaacgacaattgagtggaagtggacagaaataaaaagggaatacagaggaataactcaaacgccacagcattatgcgcaacattatgtccccattagaaaaagaaccacgtgttaattctgagacaaaatcgagcaggatctgttcataactggggctctgagcaagtaaaaatactcacttcgagaatcaaatgattgtctagtgctgtaagtatatagatttaacagcaatgtaagtaagataacgtaatgaacttcagtaataacaggaaatgtgacaatagcagtttatagttactgtttatttggcactactaagtgcaggtcatgtgggtttccaatgtattccttatagtaatgagcgcacaaagatagttaaagatagatccaaattgtggcatcatgatgaataactcaaggagcaaacctcattgtatttgaagatcagtggacgcgagtctcttagagttgtagctacttgttgccctgcgtcatttcgagcttttgcatccactggtctctcttttctaaacctgtattttttgtgttaacgaggaaaaaaaagcctttattatcaccgtcttgcaataataattgcatcttgatgtctaatgaaattatcagtattaaattacctatcaaagaaattaattccgtggttggagtgcttctttgcaggtgcaggatctttaccactcatactagatgctgagcttaattgcatcttaagtgtagtcgggttgctcttggaggtactcttggtagaaaccaatgcagattttttctcacttacggaaacttcatttctcttatctccttcattggcttggttcaacaatttgccagcactatctttcatgatcttttgcttctctacctgaaaagcaacaacatacattggtcagagaataaaatcttcttttaataggaaatttcccaatatgaaaggcttctggcaatagatatctgtattgagaataaaaattaaaactataatagtaaaagttcaagtagcaaacacatggaagtgaaatatagaactgatacttaagctcagccttccaatgaaaaggaagtaatctatatagatacaaaagaagatttctgctgcatccacacgttctaaagctccaagtacaagttaatgctatttaagtgcttgtaaaattcagaagtcaaaaccagtgctactgctgggacatggttatcctactatggcaagtaactttcatttcaacagctctggcccttagaacttttgcagaaaagtacaattcaaagttgtatagttaaaatcactttgttcaatagcttattaccaccagcacgagatgctaatacttccaggttcaatatagtttgccaagcaattataagtacgtaacagatggctatcagataagtgttgcatagaagcaatgatttttagcctgcaaataggttagaacttagaagttactcctacttaaagcaaattaggtgttgtgaaggtagcaagcactaagcatgagaaataaataaaggaatccactcatagaagttagaaatgccactgacctcatgcaccaagacttgtttcatggccaaagagagaccaatatgctcagattgatatccctaacatgagaagctctgtcatttacagtgagaagagcacggtagggtaaaataggacagaagtttcaaaaagaaccttgaagtttataatatcattgattgcaggatcaagagaaagtgaaggaacatcaggagacaccatagatccacttatcctttcttgaggctctaactttgtgtttctgtatgtaattgagtaagaaaccatggtatcaactagctgcacaagttcatccttttctctctctgacagcaaattcagtgccacctgaacaaatcttataatgtcagcattcagcaacctaaaagagatgataatatgtacaaaaatactagtagtaatagaaagttgcagtgctactttcttgcaaaacctcttacaactcatcagttccaaactaagatctaactcatttttagtggttagtcgctttgttaaattggcaagggtattcactccatccttcatttgtgggggtattgcaggatgttttgggttaatggcatagacattttactatgccatcctttattttaattcttgatcttacaactcaagtgaaattaaacagaaaaattactatgtgcaaacagggaaggtccatatcaatgattagcacacctaagtaagaacttacaggtctcaagctcgatggagaaataatatgtaagaagggagaagcaatgtcctccacaaaagattctactgacaggtgcctagaaattagcggtgacatttggttttgccaggtcttcagtttatccttcttttccaaaagcattgttcggcacctgaaaaatatatccacattaatcctgctaatggatagctgatagctctatcaatgcgcaagaattacctctgcaaagattttggccattcaatatttggtttctcaacttgagcaaccagttggcttatagttatggcaacaggaggctgatatactgaagtacagagtcaaactatgtaagttagtcaagtatttatacaaacaaatacaataaaaaattggatgctaccatgaagtgacatctgctgagtccgataaacatattgcatcaaagaatctgaaactccaagtatatcgagacatttcacctgtaaggtcttttggagttagacaagttcacggatatatttacagaagcagaaaataaaaaataaaactcctgtaatataactagaatcaggatttcatgcacataccgtcttttgcaacatcgggtcatgataattaagtttcagaaagttctcgtgaattccatccatagtaacatcatagtcaccactgtacacatgatgtgatgtgaaaaagtgaagcaattctaagaaacaaagcatgaaatcaaccgcagaaaacttaccggttagaaatgagtgagaagagagaatcgatgtccttgcctctgctaaaattactatc

SEQ ID NO: 58044 - DNA, 2251 bp, Oryza sativa
catatgaaatataacacaactgtcctggtatttttatttggttttcctatattatgtattgaaatcaattaaaatgtatataactaaaggatctacatgctgacacactttgtggaacctgattttcctgcttgcagttacttaggttactagtaactacagtgtatgcacttgatctcacgatggtgaatggagcaaaagaaaccataccagtatactctgctaatgcagaaagggcaattggacttgtcttgaaccgttcctttttgcaaatgtacttgagcctaagacccaacaaagacatggtcattaacaacatggaccataatatattgtggctacataaaaaaaagtttggtgtagtgagatgtaacaagagtatttttacataagtacctgttgacaacacgactaatcgttggctgaacaaacatatgaaccctgtaaatttaagcaagtccttgtaagaaatgcttagatgatttaacaacggcacagaattacagtaaaaaccacacaagaattattacttagctacttggcgaagttgtctcagagctggagcataaagatcattgcatatacaaattacctgtaaataaatgcattattatttaatcataatgttaaggcgctaaaattatggcaaggaatggctagattgcttacaggtctcatcagttttggtattttgtgacctttctttgaggactttcgtacttgagtatcttcagcactagtgctgctgttagaactgttgttcttttcagcattgatctgcacaaaagagtcaattatcaatgaactacagtaacatatgaattaagctagaattgatgcagcatttatcactagcataatgcagaaccataaaaaaaacaagaagagagggaaagtaagaaaaggtagcaaaacatcatgttgttgaaagtgtggattaggtgctaccatctttaaaataacctcgactgcacctttgccatcaccaagtgctccatcaatttcatcaattacctacacaagacagcagaggtctataggatacagtggaggtaatttatttatctgacagcatgattcaactcaccagacacttgggtttcgaatcagacatgattgagttcatctgaatgacatcaagaattttcggttcaatggatgaagcagaacgatcatcactcgcatttatctgcatgtagtatgatgtaagtagtgtataaatttttaaccaaagataaagggcccaacattctaatactcaattagccaataaaccataactaacaagaggtgatgaggtcagagaaattctgctaagagcatatcattattttctaataaaaattgcaatggtcccagttttccagcttataaaatgtaccaaaataatatgaaacggaagaaatcaattcgtgactagatggtatgtacagaacagtagacaacttggaaggatatcaacagatatgtttgatgcagtaccagataaaaggggtgtatactcctcgttatatatgaccaaacagtcaaacataacagattatacaacactatgttgaagaaccaaaaagaactacacaaaggacatgaaatcacataatcagacctccacaacatggtagccacaatgtttagctgcaacatgggcaagtgttgtcttgccaagcccaggtggaccacatagtagtaacacctgcaacatcgaaatgttatctaattgcactagccagcaacttcttggtagaaatatatcctgcggtcaaacatatcactaaagacatacaaaacaatgctactaagccaccttttgttctggtgcattatcagtcgtgggcctcttgttaaaggagcttgtcaaatcctctgagttgctaccatgtgcattttggagcatgttgtcttgactcataccaggacctcccttactcttggagaagaaatttctgttacttgaattcttttgaatagcagaagaatgtcggcgtaaggcagacaaaacatcatcacctgtagcacgaacgtgggatccaaacacacaggagtcccactgttttagccacagaagtacctgaatggcatgcatccgtacatgtcaagagaaactcaagcacacactggaaacctgacaccaaatagcaaaatctctatggcggaaggagattattgcagtaaaggccttatttataagtatatattttaagagagttgaatagacatttacctccctgtttgtgtgttcatcacttaacag

SEQ ID NO: 58045 - DNA, 4745 bp, Oryza sativa
gcttatgacctactgcaatcaacatggtcttgagcggatgaaaaaatgttatggtaaaaaagaaaccatttgtaccatctattcagtataaaataatgttaattatcattacttaaagagtacttcacttttttaaaaaaaaaactattgtcaataatctcatatacacatatacctttgctagagcctcttgctcagcacgacttgtcagcgaatgaaaggattctgagagaagccctgcagaaggacaaaaggcgaaagcaatataatgggctatcaaaaatattagtcgagtgcatgttggttctcaggagatatttgaaagcgcaaaatagaagtacacttagtaactgacccttgtaattgaaatttggtttggaaatgcgagtcctttgtctagttcccccgattcctcccccatccaacccgtctgttgcaaccttcgcataaaccctctcaccattgggcgcggtgacagacatacagtccccccggatgtccgacgcgaaccgcgagattgtcttctcggcgacaacttcaacaacaggaggcggcgagtaccgcagccagtcctcgtccccatccccggaatcctcacgatccacattcctccgcttgctcctctcctccccctgctccggcggaggcggagggggaggccgcttcaaattgccttccgacacttcatcttcacacacatttggccaaccgcatcagcagtcgaaacaaaatactctcgagactaggttaccatctaccgtgagggagactgtgcacgcacctgcaggtttcgagggggcagcggtggtctcctgcggggaacgccgcggctggtccgctccggcggcggcagggaggaacccctcgtcctcggggtcgtcgaagtaggcgtactcctcttcctcctccgggaggagcccgtggctctccatccactcgagctcctccggatctggcatatccatgtccgcctccatcgccgccgccgcctcgccgacgcagcaccgagcagaaggggagggagctaggcggcggcgaacgggcgaagtggcggggaatgggaattggtgattggggtgtttcgcgccttccggcgagtggttttctcggtctccgagggagacgcggggatggtggtaggtctcggcccaacttgttacttggcccaataatgtcttcgaagtccattggattggtgggcttctggataggaataagtccactttaactcccttaaaaattatagatccaatttgattcatatcgctgaaccgtaatgtttggatatcttaaccccctaaactataaaaactggtgtattttacctctctcatctgttttggaagacgatttcgctgatgtggtactgtgacttgatccaacccattgagtcattttgtggggtccactcatcagtgacccactgacccttctcttccttcctttacccctcctagcttcgcccggtagagcatccatccatggcacgtagtgagtgaggcagcggcgagttctttcgatccagctgcatgctcttgctctatttttccctttcctttgtaaatttggcgagttctagtcttctaagatggaggagaccgttgtggaagttggaagcaacgagtggctcgaagagcaccatggcgtcggcagtggccttggcgcacgagctgccggaggcccggctcggcgctagggcgcggctgaggctaggggcgaagctccggaggaggtgtttacacgagctgatgcgcaccatctcatgcttcaagctcacttggtccttctcctcgttggtgagccgcatctgcgtcacctccagcttcaactcctagttctcctaccgcaccgacacgtagttgacctgtggcgacatcgccccgctcccccaccccactccctgccgtcgtgcgactacgtcgcggtggcgatggcggccacacacccgaagaatgagcgttgtgttgtgcccgccgccgccctggattgtgcgatggagctgctcagctgctcgaaggagagcatgtgcaccgctatctgcacaggcagctactcgttctgcgccgtgtgcaaaatcctgtgtcgttgctctgctggcgggtaggctccacatgatgactcagtggattggaccaagtcaaagcgccacatcagcaaaaccgtctttcaaaacagtcgagagagttaaattacatcggagtttatggatcaaaatatctggtatgcagttcagtttcaaagatatgaatcagattaaacctatattaagggagtcgaagtggacttattacgtctcaatattctggcgagattgggctttccagtttgtaccttggatctgacgccgaaagctcatcagctgacagcaatggtgaaacaaagatttgcagtagtcccacttcgccttcgctgctacggcgatgctctgcgaatctgcgaaaaacgcaaccgaccaaacaaagttttccagctcggaccgcatgcgattctttgattgtgtcggggtgtcaaatgaccaaacaaagtgttgattcgttgtggacttgtggactcggagcaacttgttcagttatcgttgtcgttgaaggggaagttgcaaaatccatgttttgtcccttcatattgcttgatacctgctgggaaattcagggtttcaggcacccgtattcacacacagatgttcgcctctatgatcacttctcttctattttgccagactattgctgtgtagttgcagttgcaggattcatatagccaagctcaaccgtgcaagacatccgtgtttaattatcaccgaaaaaaatgcagcagcatcaacgagtacaaaatgctagagcaagttgcaacacagctcgccagtctctttctttattctccactccagatcttgaatcctgattagcaccgctggttttccacccacggaacgatgtggagacgagagaattgcttcgacgacaatagcggagaaaagcgaccgaaagaaaacaagcatccgcggttaagcaaccttgcacgccatttcctgaatataaacccgatctttgtttgtcttgatttctacgaaagctcaatgcaagcctgtcgttggctgagaatttgagaagtggagatgcttgttgcacctaaaatggaagcattccgctgggcccaactgtaccatcctgaccatggtgtctgtctacagcttgtagtagtaggacagcgtaggagccacgagactgcacgatctgctgttccagataaagacgatgatgaatgccagatgctcctttgtcttggaccagctccctgtcgtcaccattcaccaacccatgaggacgggaaaaatcaatcctccgcatttttattctctgcaatcaagtcagcacacgatgggatcacgcccggcgccggcatgtcgatcagtagtctcatgttcccctacgacgggggaccgtggcactagctttcttcttttcttcggtgttcaacacaaggatctccaacttaccacaacttctagatgaaaacgaagtggaattggacggataatagcaacgcctatattctaaaaacacccgaccgagtcgctctcacccgcaccaataatgccacatgcagatgatatcacaccgggaatttctgctgctctcggtctcacgaaagcggtcgggcagagcttttttttttttttagagaaacaaccgtggcggcagtagagaaccatatagatggatctgactatctaagtaaacttaggctgtgtttagttccacgttaaaattgaaagtttaaagaaattaaaacgatgtgacggaaaagttagaagtttgtatttgtagaaaagttcgatgtgatagaaaagttagaatctaaacatggccttaatagaatacataaaacatcacaaggtcatgtgagaaatacgtgactccatgtgcgtcccaaaccaacgggaaaattattactgtgtgcagatgcagttgtagccagttatggccgccgaagaattgagggtttgagaccgtgggagtatgatacacagtgatcgtgacagtaatttacaggtgcctgctttgtcatttgtcagctagcagctttggcatcttaacgcccgccggatcagcgacctacccccattttcttttttcttttaccggacatgcgagtagatctggctaatacgaggtgaaaacagatgctttgcttggataaccttcttaatcacaatagctgagttgcgtcaaactccattccggaaaagaaaatagctccatcatacatccatacgtagccagtaggcggtggcgtgttgccaagacatcatggtttagcgacgggggcaagttgtttgtacttgattatacataattatttttaaattatagtcgtgtgttaatctatgtagataaacgtatacttaagtatgaaatatctacatttagcgatatgtttataagtatccatcatttatttttgatagtaatatatgttaaaagacggtgttatatttgccgagtgagtatgcgtgcgcatatgatccgcgcacaatagacagagagttccacatccatgatccgtcgtgtttgaaaaatgtttgccattaagaaaggatatcacaatttgtttctccactaaagaaagagataggcatcaagtacttcaccttgctcttgctgatcgtatatctcaattatacttagcttaaacggtgggcaatcctcaattgccatctgctggtcatcgtgacaaagaaaaaaaat

SEQ ID NO: 58046 - DNA, 17185 bp, Oryza sativa
aaacttgaagacgaaggccaaccaccgatcgccaagtgctcaagccaagtcctggcactcacaaactcagatcctgcaagaaatccactccaatcttagtttcaaaacaaaaaggtgatgcgccttgagccatttcactgtttagctttcatttgtggggttagcaagcctttagataatcatccattggactaatacatgtgttcaacacttaactagctcatttgtactttaattattgctggaggtaggccataagatttttttagctggcatgcatcatcatatggtaatgaagcataatggagcatggcgaagccatgagaagcatagcgagacatggcagagcgaagcgaaatgcaacaaagcagagccaagtaagcctgccaatgggctggattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaacctagcgtcatcagtcgtccacggctccactccttccaccgccgccgctccctccccttgcttcgcctcctccacctctccgccaccgtccgcgaatccgccgccaagccgtcgccggtcagattccctcccccaccaccattgcttttctttttccctggtttttctcggtctttgatctatcctggttgttttgtttgtatttttttttgggtctcttcctgatcttggtggttgcaagtgcaggtgaagcagaagaagaggaaggtgcgtgcgccgccgggcgttggcgaggatgtcctcctccggtggtccggccgcgtcgccaatctccctgagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgaaaattatttaacatatcattacaaattgagtcctgatatgattttgagatgcaaattaattctatggtcaatcgaattttagtgtgcaatttttagattgtagcacgtgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattggcagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcaggtgccattcaagaaaattgaggatccttattttttggagtgggtggagtccatgcagccaactttcaaagttgtgggggcgtcaaacacttcatgatgatgcctttaacttgtatgagcgaatgagggaagacttgcatgctgaattacataatcttgatttgcacgtatgtctaacatccgatatgtggacttcaattcaaaatataggctacatggttgtcacagcacactatattgatagagagtttaacattaagaagaaaattataagctttaaggaattgaagtatccccacacgggattcaccattgaagaagctataatgagttgcttgacatattggggcattagaagcaaactgtttactataactttagataatgtcagtaataacaattctacatgtcaagagttgataaagaatcacaagaatgcattgatgtttgagggtcagcatttgcatgttagatgttgtgcccatatcctaaatattttggttcaggatggtatgaaaataattaaacctacaatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacagatctgtcctggatagctatgcaaatcaacatggtgaagttgcacctactgaactagaatggcagaaagttgaatcaatttgtgcttttcttaaagcttttgaagaagccacattatcagcgttagcagataggaaaccaacatcacgtaggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcgaaaaagtgggttctgctgaagattggttgaaggattattatgaaaaatacgaagggtttgtaagaagaaatgatgaacacatgctttcacattctcgtgaaggcagcagcagtgttggatcacctgttcttgggaaaagaaaactcgaggaagagtttgctttatacaagtctcgaaggaggactgcacggcaaacgaaatcagaatttgccatatatttagaagaagatgttgaggaggatagtgagagtttcgatgttttggactagtggaagagacatgctaaaaaattcccggtattgtcatctatggccggagatttcctagaaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcataaatccacccgtggattgtgttgaatttggactgagcaactttgtgggttgggttgggtggggttagctcaaggaattcttggtctggattggagtgacaattttgctatagtcactttgggttgggttaacccattggcaggcttagagccaagccaggcggaacattgcgaagcgctctggagtcgggtgaagctgttgagtccaagattgcgatcggcctatggaacagatgacaaaggccaccctaaaatgccttccgagaaaggactgtcccagtaggcgacctatacataacccactaaaaataaaaaatatatctgtaaatatttctatcaaagggattgaaatataaaagcctatgtaagccaaaccctaggattagctgtttgagctataaatttataaatatcccaaaaaaaaaacactgtaagacattggaaaaaataatacatatcttgctgttccttcatcccaacaattactactattattatcaatcatctaaaacccgtaacggcacactttcgtccatgactgatgctgatgaagttctccgtaatgatatgtcatggagttgtttgtttctaactatcaacacgctacacgcagtggcggagctaccacagggtctctggggtctcgagaacccactaccgtactataaccatgggagatcccatgaaaaccccactaaaattttctgtcatacatctattagaagagggggctataattttatatagtttgttcaaaccctccagttaatcttttctggatccatccctggctacacgtggttgtcatgttaggttgtgtggcttgcgaactgtgttttcctcgtgtctcctttggaatggagggaaattaaagcatttgagttcgtatgggttacttatttgaattctaagttcaaaccggtacttcatgcgagaatcacgtcaggaatatgaaaggctcaaagaggggaaaaaaacatgcagcacgaaccgaggcccaccggaccgggcacatgcgcggccactggcaggcgggggctaccgctggctgcgggggctgcgggccagagtctaggctggactggccggacgggaatcgcctccccgtctcgcacctggcaatcagcatcggccggcgaccacacacacgagtacacgacacatccgatccccatccgtcctccgtacgtgccaatgaaatattcggccggtggggcggaggcacgctgtctgcagccagacgcagaccaccggcgagtgcgatccgagtggccgagcccgagagaaaaaccacggccacaccaaacccgccgtgcgggggaagaaaaaaagcacaatattctccctctcggcctctcctcgccgtagtgccccctcggacctcggttgattttttggttcgcgcacgtcaccaccgagagtccaccaccgcggcgcacgggaggaggcccgattcgattccactcgcccgttcgttcgctcgtcctatttttttcttccccccaccacggcaattttttctctcccacggccgccacgccactgccagtcaacagctgcacctgggctcctcctctcctcgtcgccgtcaccgtcgcgcgccgtcgtgttggtggtggtggtggtgtgcgggcgggcgggcgccgctcgcgtccccgtgacgctgcttcccagcgccgctgcctccgccttccacgccgcgtgggcgcgaaggcggggcttgggagttggaggaggaaggatagggggcacggcacgggtggcagtagtgcaaggcaagcaggtccccgtgtataattcgggcggcggcggcggcgggttggatcggggaatcggcgacgcgggccagaggaggaggaggatggggcagcaggcggcggaggcgcagccgctactgctgcagggggaccaggtggacgccgagtggggctgcaggccgcaccgcattgtacttttcgtcgagccgtcgcccttcgcgtcagtgctctctctcctcgtagtcctactagtcagatcatcgtactagcttagatcagatcgagatgtcaaacctgccgctctttcgatctattgaactgcaaagtcaatagtttttgctcgttgctgtttcgcagttacatctctgggtacaagaatcgcttccagaacttcatcaagcatctgcgagagatgggcgatgaggtatatgatctttttacttcatctggctgctggctgcttgtgtgtgtagggcgtgtatataccttggaattgacgtgtgctctttcgaaacagatgttggtggtgaccacgcacaagggagctcccgaggagttccatggagctaaagtcattggttcgtggaggtaatccaatacaaactagaaactacttttaccttccatttagcattcggtctacctgaggagcaccaaacacagaatacaagaattactttcctgaaagcacaaaacttgctctcactgcgaaatagggccttactcgcatgctgaagcaaaaggaaacaatgcaagcgaagtgtcatctagtcaactagcatgctgatttggaacatgtgcttgttgtgaggtgaaattggtgatgttgcacttgttttccaatattttgtctggtcaagtcgtcaagtatatatattttagaggacactagaattcttcttgttgaaatttcttctatctgcatgcacttaattgcctaaatttctatttctcagttttccatgtccgttataccaaaatgttccactctcgctggcgttgagccctaggatattttcggcggtggctaaatttaagccggacataatccatgctacttcacctggagttatggtaatcattaaaaacccaataggtatcattgtcctttctttttgtagtttctcactatatattgtgatttcaggtttttggtgctcgctttatcgcaaagatgctttcagtcccaatggtgatgtcatatcatacccaccttccagcgtgagtttctcttcttaaaatcatgaatacttctgcgatatgagtcctgcatgcataatattgttacgagcagatcttacagcctctaaattagggaccagatatagtactgtagggcaagaccatcatagtccagtgatttccctggcagagatatttactttcgaaattttgggaaaaaaaaacacattactatgtcatgctattggaggattaaaaaaaaacttggatgcatatgcatggaatcaacaggcaaaagtgttgcctccccaatgttgattaaagcatccaaccgaggcacatcattacaacactaattctttctgttgcaaattataatacctggtgttgattcttgagctgaattcttgtcatgactttcaggtatataccaagatacaatttaaattggttacttggacccacatggagtcttataagtaagcataacatcacctctcagtttgttcttcataaaagaaataatctgacagcaaaaatacaactgttctttctcattaaatttgtactgacactcttattttgttttgaaggatgtcttcataggtctgcagatcttactctagttccgtcagtagctattgccgaggactttgaaactgcgaaagtagtatcaggttaaacaattaagataaatctatatttcttcatttcattccttcatccatcataaccgtagtttccttgtctcttcagcaaatagagttcggctttggaacaaaggtgttgattctgaaagtttccatcctaaatttcggaagcatgaaatgcgcattaaattgaggtttgacctatttctttaatattcaatagcagtatgtgaaaaaaaattgtgcatagctaacttattttcctttttctctcttgttagtggtggtgaaccagaaaaaccactcataatacatgtgggtcgtttcgggcgtgaaaagaatttggattttctgaaaaggtaatctttttggcttgtacatatcactgtttgtcagtgtaaaatcaactccaaacaaaatttgaagaatatagatgggggaaaaatggaaagagaaagctcctcaactaacaatggattatttcatagtacatccgtcccaaaatataacaacctagaaccgaatgtgatatttcctagtactatgaatctggacaactacagtgaaaacatctgtggcatgttgttttctctggcatggccattttcattagttgtccctgagttagcataacttgcaatcgtcttagccttttagcttgaatcatgcttgtaatatgacttacatggtcctgtttatgactttaaccaagcagccatttcaaattcgtcacatgtatcatagatcacttatctgtatgtcacatgttcactacatggttgttattttgtcatgtcatcagaactttgcttattttggtgacaatacagggttatggaaaggctcccaggagtaagaattgcttttgttggtgacggaccatacaggtgcattccttaatgttaaatatttttcgttatcaacaagactcatacatgataacatatatattgaaatgacactatttggagcacttcagttttatcttttgcgtatgactggtattatatgcacaactgtaggtgcctagccatctgtttgatccctatagtttcatcttgaatttggagaaacttatgcggcctgtttaatctttggcagggctgagctggaaagaatgtttactggcatgcctgcagtattcactggaatgctccaaggcgaggagctctcacaagcatatgccagtggcgacttgtttgcaatgccttcagaatctgagacacttggtcaagtagtgctggagtccatggcttctggagtcccagttgtcgctgctcgtgctggaggtatacctgatataatacccaaggacaaggagggtaaaaccagtttcttgtttacacccggggatctcgacgagtgtgtgaggaagatcgaacagctcctttcgtcgaaggttctaagagaatccattggaagggctgctagggaggagatggagaagtgtgactggagagcagcctcgaagacaatacgcaatgagcactactgtaccgcaacgttgtactggaggaagaaaatgggcagaactaactaggtttcgcttatcgattcaggaatcgttcaccgccgtctccacctagttactgttaataaccaaagagtttgtacattgtatccaacagcagctcgcgagtttgtgcggctagctgcattcatgtgttcacaaatcacaatcatgggatggccactgaccaaaagcttgtatgcgagtcatgtacattagacagctctttgagattggcgattactatcgaagtgctaactgctaatttagaatactggaggagttgcctgctgtagtgctgtctctagagtgaaagttgaattgtgtgttgttactgtgagctgctactgccaactttctgcctttctggtagctttgctacatttgcgttttgaacattgccatagcgtaaaacctcgagactacggctgtgttcagatccaaactttggatctaaactttcaactttttccatcacatcaaccttacatacacacaacttttcagttacatcgtaccaatttcaacccaaactttcaactttggaaggaactaaacacagcctactgcattttttcatgccgactgcgagcttggcagagtgttgagtctgttccaccagcagaagtgtgatctgtaaccctgtatcggccggcagttaagctgcaggtctaaacagcacatttcacgcatacctatcttatcataatatttatgtatacaggaatattattaacttatataagcacaaaagcgaagatgaagtcaaacagcaagaaatacgtcctgatgtaaatatgtactacttattgtccaactccaccaaaggctgcagtacttaaaaacaaagctacaacttaggaagaaagggtcaaacagcaagaaatacgtcctgttgtaaaaatgtaatgtccaactccgacaaaaggctgcagaacttaaaaacaaagctacaactttatacttcacaagatgaatcaacaaattgaatgagcgcggaaaaatgtggacttaatatggttttccacagaacatatacaactattgcagcaaaactaacactacttaaaacaaagctacaactttccattttacaagatgaatcaacaaattgtatgagtgccccaaaatgcggacttaatgtggttttccacataacatatacaactattgcagcaaaactacactatctctatcaacacaatcccctccgccccaaaaaaaaaggtgatatccatgcaaacagcacaagcaacatgttttcattgacaattgattaacaccacaatattactccctccgccaagaaaaaaggtggttttcatgcactatggcataagaaacatgtaattgtgcacagtcgatgtctcagcaagcaggttttctgtctctgctcattacttgtttgcatttgacttgctgaacaattaaacagaaaggccatggaccgtgacagtagtagaaaatcatcagctgtacgtttggagaattggaccttccatgtactgaatggccctatccattatgctcaccaacaaaatggtaagttttcagaggaattgcagctgcagatgcatctcactacaaaatcagtcctgaagtatgtacgggtaacaacaagtaacaactgcaagtcacatatgagaagcttcaagctattgctgtagacttttggcatttgaagcagcattgttattcatcttgcagcactatcatgacttctccaccttgactgagaatgctgtctagaaatgcaataagtttttctttgtcctgaaactccttgggtgcagaaaaatcactatccaaattaaaccaagtgccattaatgcttcgaattgccacccaatgccggccagtccaaagccctctgaacctcctgacgggtacattgatcatcagaccaaacaatgcatctgcatccagatcgattgaagaagcccctttccgatgatcatgccagattaccttcttctttctagcttctaatgctgtgatgagtacatttacatcatagttcccggtgaatacgttgtggtggggcttaaaaatcaatgacataggagtccagtgctccttatttggatcaatctggacgagatttccagcaatcccatctaactcagctcgggtgaaagattccttttcctgaaccatacaaagcataattgacagttaaaaatcggtacacccatgctgtttctggtaggatcacccactaccgttttcgtgatttggtcataaacggttaagcaggcaggaattgaaaaacacttgtttgtaatgctcatgcaatcatatagactccttgcttgcaagtacaaaattactctcagattcacataagcagcaatttcacatgtcgtgaagaaaatcaacaggacataaagatttatctctactaagctatcagctgaaattcatgattgacgagagctttaattatgattgaacaaaagcgtgctagacgaatgtgaaatagatataaatgtgatgcgcggttgatgaattcatggaaaacattgtccaatccgccgaaccgttccaacaaataacactgagagtgaccgacttaagtatgctgtagctttcagatgcgaaagaacactattccagttttcctgcgtccaatatcgtgagatatttcaccagcacacaagttttgatgacatcgattcacatggaaaaaaaaatgcacatcatggacaacagaattggagtacaacgttcaactgctaacaatttcctcactaatatcgattagtgacataagccacgcaaaataaggaaatcatacgaaaaaggaacggaagttatgtgaaactctcgagagaaaaaaaagtagagacggtagatagaacttcttttgtttagaacacaacaggataacaccggaggggagagagacgacagacgagctacctgcataaggttgttgagggcgtggaggagacagaactgcagccgttgcctctcgtgatacaccttgctgcttctgctgctgccgccgccgccgcccatcgcactcgatccctcctcgtcttgttttgcttccgatttgggccccgattccatgcggagatggtgcagggaggagaaggagggttcgggttcgaaggaaagattacagcggcccaagattcctcctctttcttctcgccgccgcccgacggccgccgcgccgctacccccggcaggaacttctgggtcgtccttcccttctttaccaaacgcaacagcacacaggacaggagattcaccgagtcccggactcaggacacgtcgcgtgttgtggtcattgctatttcgcgaatacaatttcgaaaagaattctctccatctcgcttcctataacttttttgctaccgaaaacttatatactaccggtcactgaaattaggaaaaacttcagccgacaaaactataacattgcaaaatcacgagttaaaaacacatgttgaaaaatattatcttatgtgtcattgatacatctgtttagacttcacatattatgatactttactactcgcttatttttatgatggcaatttttaaaaaatttctcaattagaaactccaattagaattgctgaaacaacatcacttttacagctttaccctcttttctagggtagggaactgtttacactaaaattgtctgtgctctaaatattcgtagtttcaaaagtaaacatatataataaagaactctaggtttttaaccataccagcaacctcaaattctcgcttcatcgcataagcatgggtttggttaaatgattggaatcggttgggtcgggataaacctattttttagggtgtttgatttggatgtaagtgagatggaatgttccttgaaaataaatattccccctaaattcgaattagcactatacttagagcatctccaacagatgcctaaacaggtcccaaaaattaaattttaggattttagttcaaaggaaagctccaacagctgcccaaacttgctcccaaaaatcccccacgcccaatccagtcccaaaaccgagtcagatttggggcagccctgggcgttcccaatcgcagcgatcacacgtagatttctttgctcgcgccaatttcttcctcctccctcctctcctcgccgtgccctgctgccgtcgctcagtcccctctcctagctcgcatcagatgccgccaccctgccggtatcgggctttctccgttccattcgtctctgtccagaccggcacctccatccacgccgtcgtggccgttgtcgtccacgccgctagggccatctgtctgcatactatcggcaggtcatcctgatccacccgccgatctgtaagctgctcaagccctagtactgaatgaacctaacggcctgtttggttggagggagtttttaggagggattgggagtttagagggatgaggctattaagagttttgtttggttgggagacatgagaattttggtaggatggagatagggaattgaggaaggaactcccttcttttcaatacctgggtaggggcaggtaattgggagggaattcctcctttactttttctaagcaaatctcagccatccctttttattaatgacataatctccaactaaactccttatcaatttccatcacctctaccaaacaagatattaggattaaaaatcaaattcccatcttaatctcatcatcaattccctcgtgtaaactcccaatccccttccctcgagttaccaaacaagccgtaaagaaagttttgacgatgtgtatcgttgtactttttctagagcaaattgaatctgaatattgtttggtggatgtctatttgctattttgcttgcacacaatgacaaatatggtgttaagttttggttgattgagaaatcattattttgaggttaaattgtcggatgagggcaacactgcacttggttttcagtttgctcaatgtttttcaatttgcaacactacactgcactgcctgtcatgaagcaattgcatactgaagcttcaagagattctgcaagctatcaagtctttgatgctgaataatttggcgttggtagtactgacattgctgaactgaataatctggtttagaatgtagtctgaaaatctaaaccatattatgcgtgtggtacagtcaaaatttcagtaaataataatatgtttatgcctttttacataactcaggaaaaggagagggcatgacctagccttattcttgtgatgatttgtgacaccaaatcagggaaggagagggctagaaatggtaatgtttgttggcaatcataattggacttcagaaattcaatgtatttgttaggaattcacctagatatattcacgggtattatgaattcaagggatttgttttgtagcgatttcagggatccctgtttatggttatactttttttagataatggaagctttattaatctcaataaaactctatcaagtgatacaattattctgagagcacctccggcttctgcacccaaagagtgcacacaaccaacaagaaagaaacaaaagataaactcatcatccaaatagcatggacaaaaagaacttcaggagccctctaaccgtagcctagaacaccacccatgcgccggagtagaaaactccatggccactagctccaattgttgacaagccgcaatgatagtaccccgcaaattgaccttctgaaggatagcccatgagcggagccaatgtgtaataaaaaagataacctgcaaaggagaagatatgttttttctttcaaaaaccacatcatttctgcaaagccaaatagaccaaatagtggtagttgcccctaataagaccaaagatctcaaattgcgtggttgtcttcttatccaatgcccaaacatatgagttgtactattaggtaaactaatattcgaagcaaactggattaaagaccaaactgcgcgggcaaaacgacaatcaaagaacaaatgattaatagtttcatctttgtggcagaaagaacaagacttgtttcctctccaattccttttaataagattatcttttgttaagactactccatgacgtaagtaccataagaagatcttaatctttaggggggctttgatcatccagattcttttgtttatattgggaacatcggtctgcaccaacgaaagataaagagatttaaccaagattctgtcatcagtggttagattccatttaaactcatcttggtcatgagataatataatattagcgatgcgtgagagaaggtgattctacgccactaacttagagcgagtaaggtccctgcgccaagaaagtttatggttatactatgtcctcattttcaatttcaagtaaagcttgtaagcatttgccaattatagtcatcccaagatccatgattgttggagagctcagtttcagcacatatgtttcgtcaaaccagaactttgtcatagtgtaatctttacttgacctagatccacgatatagtgtcataatgcaaggcttactagctgctggcaccctcaccgtgccgcaggctggccgcgcattgcccgggctaccggctcccagctgcaatgccccgatcgcctaaccgtcatgtctctatggtgattgcctgctagcctgctaacgactactccctccgtcccaaaaaaaggcaaatcgtgggttcccgtgccaacgtttgactgtccgtcttatatgaaatttttttataattagtattttcattgttgttagatgataaaacatgattaacactttatgcgtgacttatctttttaatttttttataattttttcaaataagatggacggtcaaacgttggacacggaaatcagggtttgtctttttttgggacggagggagtatgtggccgcgatcggcctgccatgccctgatcttgccaacgatcagcctagtagcgacatactccctccgttttttaatagatgacgccgttgactttttctcacatgttttactattcgtcttatttaaaaaatttatgcaaatgtataagatataaatcacacttaaagtactatgagtgataaaacaactcataacaaaataaattataattatgtaaattttttgaataagacgaatgatcaaacatgtgagaaaaagtcaacgatgtcatctattaaaaaatggaggtagtacaagagaaaccagattgctagaaatagttgaagaggacccaccagcgatgatgtggcataattcaatgcttttgggaactaaaaatagggaagctcgtggacaagggggtgatttttgggctcaaattattttgggatgaccccaatctgagatttttgggagttaaattttaggcatctattggaaatgctcttaacaactagtggaccaattcaacccacttcctctcattgattgtggaccacaccctccgattccttaaaaaaaaatcatcacatccctcacgccaaaatacatacaaatggtccctttgaatcacatgagtggaaaacggaggaataggaaaaacataggattataacagaaatgcaaatgtaaaataaatgattacaaaacacaataaaaacatgtgaatgaccgtttgattgatccacaagaaaaatacatgaatttgaggagagacaaaaactcaaaggaatttttccatgaagttctacctcatgttaaactttctcaaaaacttatatgagaagaaacattccataggaatttcattggatctcatggggtattcaaagagcgaaatcctctaaaatttctataaattccctttgaatcaaatggagccatcccattccaaaacaagggatggacctaagtacctaacatatcccacctcatgccaaatcaaatacatgagtgttgttttgaacacaatctaagatgagaatttgttttcgccgctcattgaaatcatatctattgcgccatcgacaattttgagatcctcccgtttgtcattacttagttggcgctctactgctcatccctatttatcttctgtcattcctctctatcaatagtgcttggtcaacaaatttgccccgaaagacgattaaataaattttatagtgggagaaaacacatgttttttttaaaaaaaaacttcaaaaaaaaatcagcattacaattgtcataagaatgggaaaacctgcaacgtcccaaacaaggccttgcaaaggatcataaggtcttcccagcgctgatgactgatgagtgatgagaacgatgggcgatccaacgagaaatcaagggcagcagcatattccaagggttcgacttaccgccggtaaccgcgtgtttaccgtgattaccggctttatcgcgggggtacggtaatataaataccgcggtaacctccttaaattcaaataaatttaaaaaataatttgaatttttgataaattttgcaccatttcgtacggttttttgcggtaaccgtgcttactgccggggcacggtaaccccgcccccggcggtttgggaaacctgggggcggtttgggaaacctgattccaactcgcaggaactcaagtatactcaacgcagcagtacagcgcgagaaaaccatgttaacagtaaatctatttatacatcgctgtccagtcttctcctatgaagtgtacagactgcgccatctccacaacacgccaagccgtgagatattctgcaatatccctctgttcccttttcatctgaactaaaaacctgaagggaaaaaaaagggctgcaggaat

SEQ ID NO: 58047 - DNA, 24935 bp, Oryza sativa
  unsure (1)..(24935): unsure at all n locations
gtgcgtctgccattggcttatgctgttatgcattgtgttgtctttttctcggtatgatagttgtaagctcattcttgttcttaatggtttacttatgatgaacaaccttcggtgctgttgttttgtttgcgcagatgtgttaatgtacttctcacaaacccaatttgggtaattgttacacgaatgcaagtaagtaatgcacattattgcagtattatttcccaactgactacttttagtgtaataagaaattcagtggcacatcctgaagtataattcattcttgtctgcagactcaccggaaggcaaacaaacagcagagtcctctggatttgacgtgtgttcttgacaaggccctacaagctcccgctgttgaaaacatacctcacaagactatccatgttgtatgtaactttgatcatttctctttcaggatgagatactctattcttgcaattacatgctgctgattactggatccaagactaacagctgttcttatatggaaaaaaggcctcatttagtttttcctaggcctcatcccagttcctaaactgttagctcagctttttttttttgtccctaaactgcggataaaacccatccttcatctctgaaaaccaagtaaaacttgtcctcctaagtacttcatatagtcaatatgcaagtgctaatgattcagactttgtttggggcatggttgattgactccgtttggctgcagattcaggacctttacaaagaagctggatttttgggcttctggaaaggtgtagttccagctcttattatggtaagtcttatgtcgcattttcttttgctaagttatttcttttttacaagttattgtttccatgtttcatctgtcatcaggttagcaaccctgcaatccaattcatgttgtacgagactcttttgaagaagttgaaaaagagacgtgcctctaatttgaagggagctgatggactgactgctcttgaagtaagcttttggcttttggcttttctggtgactgggatcattgtacagatttattaggatataaccaatttgcatcatgctaacttgctgcattggggcctgaatctacccgtaacgctgacttgaaagtttgttcttctagtaacgatgtttcatgtccagtaattatatgttgcatgtcttaacttcatttaccatgatgatttgctgaaaacactagtatttcttatatgctcctaatactactatttctttgttagttagctatgttatagaccgtcttcatctcacgctgtaaaatccttgttcagattttccttcttggtgctgttgccaaactgggtgcgactgttgttacatatcctcttctagttgtgaaggtgattatttgaacaccagttacagcagcagccgtttctgtgcacaattgagcagacatgtcaagttaaaccatgttttttttttctacaggcaagacttcaggtgaagcaaataattgatgatgacaagaggcaccgctacaaaggtacatcgctggcctttattctttaaacttcattttattatttagagtgaattattatttaatgagtgatgttgctccatatcctgtttctgatagtctttacttctcttctggtaataatatttgctgttctctgactttgttaccaaatacgctatgcaaattttattgcttgcaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagattacttgagtttctttagcttgtttgttagagctaaccgagaagaggatcgcaatcgtgaaaacttcgcaagtgttcagaacaaaagtagaagtagaaaatttggagttcctgtccatttttagcataactgtgtctatggtgcgccccatctgtcaatgtggttctcaggcaactgttctgatacacaagtgctaatgagcaatctgacccgacaaaaaggaaatgaaatttaatttgattatttcaaactcattttggtgaaactaagcctccttctttactaagatgcaaattcttcctaacacattttttaaactgctaaatggtatgtttcatatgaattttttacataaaaatattttaaaatatcaaataaatcaatttcaagtttaaaataatcaaaacttaattaaacataagctaatgggccgttttcattttgctttcctattttatttcatctttattagaaaaaaaacaccatctaatagactaatactgcctcgagggtttttctttaacaatatctaagtttttttaatgaagagatgcttcttctaaaatccaaacacatagtagtgtgtgtatcttactggtctggcgcgaccgactaagctgacactcgcgagagtgtggccggtccggtcgggtgggggtggataaggagatagagaagcggccgctccgcagctgcagcggcaaagcctccccgtcgtccagcccacgcagcgcaccgcagcgagcgaagccgccgcaatggccgcctcctccgtggcctcgactctcctcctctcgctctcctcttcctcctcgcccttcctctcccccacctcggtctccttcctcccatccgccgccgccgccgcctcctcctccccgcgcgtcgccgtcgccgccggcaagcagaaggcggctatctccgtcctccgcgcccttcgcgccgaggcggccaccctcccggttctctccttcaccggggagaaggtcggggaggtcgccctcgacctcaagtcggcgccgccctccaccgcgcgcgccgtcgtgcaccgcgccatcatcaccgaccgccagaacaagcgccgcggcacggcctccacgctcacccgcggcgaggtcaggggaggcggcaggaagccctaccagcagaagaagacggggaaggcgcggcgcgggtcgatgcgcacgccgctccgccccggcggcggcgtcatattcgggcccaagccccgcgactggtccatcaagatcaaccgcaaggagaagcgcctcgccatctccaccgcgctcgccagtgccgccgtggccgacgatgcattcgtcgtggaggagttcgacgaggagttcgccgcgggtcccaagaccagggacttcgtggccgcgcttcagcggtgggggctcgaccccaaggagaaggccatgttcttcgccacggattttgcagacaatgtgcggctcagcggaaggaacattggctccctcaagatgctaacccccaggactctcaacctatacgacatcctcgatgcccgcaagctcttcttcaccccggccgccattaactatctcaactccaggtatggtgccaccgtttttgatgaatatgaggatgataccaatggcgaggatgatggtgaggaggaagcagaggagttgcaagaaggagaagggagcgcagaggaggctgctcaaggtacatagctatgcatgaacaatttccaggtgtctttttattgtttctatggtgggcatgtgcgaaatgactttgagtaactaatgctatccagtgatcctttattttacatgttttagttgatagttaggagagaaaatgctctgctttaatggcatgtacagtagtttttttttttatcttttaactcttagctatgctctgttgtaaatatcatgatcgatgctatacgtatgctgataaagatcctgacatgcgttttaagggtaaaaacaagataacgtggcaaagaaacagaaaatgtagccagttttgtcttatgaataccatcttaattattatggagaaattctttgtggccttgtagacttatggagctaatttttttttcgaaatagttctcttatccttaccagcatgcaaaaggaaaaatgcttaccatgctaatgtacatcgtatggttttttttcctcctgaaagatccaataagtccatgacataattcaatggtctattttagaagcatgcttagagatcccctacccctatgctagctctcagtagacccactgagtctgtattttactcgttattttgcacctccttagggtttttattcagagctcatgagcaactcaacaatttgcgaatagaaaatgacttcacctaatggtggttaaattttcggctgaaggtggattaagtcctaagcactaaactaaaaaataagaagaaatgagactgcatggaatccatgaacaccactgaaccagaactctggggatactggtacactccttataatagtgtcacaatctgctgtgccacacagctacccctatcacctatcacttgaaacattgtcagccattggcactgtcatcattcacttcaaagatgttctgttagaccttagaaccatcttaataaagtagttagctgtgaatatgctggtttaagttgctttagaggtaaaacctagttaaacacatgttttctccatcactcaagcacttccttttcgtaaatactatgcatagctacaggactaagttattattaattgacattcagttctctgttacattttggtgctgcatattataactttctcttattttgagcatttctcaggaacttctttttgtatgactttcagatgaggctgcagagactgaggctgatagcaattcctagggaaggaggtgtagatcgcgtgtttttcgtttgttggtctggtaattgcttccctgatgcagaagctttttggcttacttttgttgtaagtttataatgtttttttttcactgatgcagtatattagatcttcaaactgcacatatattttcaaatacaatgtcgtgtcaaccactgcatatttttcttccaattttatacagaaagtgcttcccaatcttgcttcaaaaaaccagtgttgacctgctggttaccactaattttctactccctccgtttcatattataaatcattttgacttttttttcctagtcaaacttatttaattttgaccaaaatgatagaaaaaataataacatttttaacacaaaacaaacatgttatcaaaaatatattcaaagttacatttaataaaactagtttggtattataaatgttaccattttttttctatatacttagtcaaacgtacagaagtttgactccgaaaaaagtcaaaacgacttataatataaaatggagagagtaacatcttgagtaggggtatgattacaaaatcttgtctccttaaattgttgaattgttccttgttatgactaactttttcgctgggtgagctctaacaagtaacaactaacaagtcttttcagaggacttgctgcattttacaatgtggaaagtagcctagctcaacttggacatggagcactggagcagcatagcccgggttagatgctgatcttgaaactctaagcccagatcagtcgtaaacaacagaccattttgctcaggtttacttgtagatcacctgagggtttagtgaaccaaccctctgcttatgcctaaccataatgattccatcatttttctttcttacctgggtcatgcaagaagagttgttgggccatccttaagtccacccagacaactttggaccagatcatcacctttctaattgttctgacattgcactacaagtggattatgggcttatgggcaaagctgcgtctgtactttagaaaggtgcaagatctggtcttttgctatgtctagtattttatgtcatttttagctggtgctatcggtagaatttacttatagtttgctctgtcttactctgctttcaacaatatctaaagaaatcatttgtgagattgtgactgacataatagtgctgtatctatgaaccgaaaagggaagagtcttgcttaggttgagccagcttctttggcactatcttttaaactttttggtgggcaaaaagctatccatattatactagcccactatgcataaaaggcatacaaattatggggatggacctgagcacataatttcactctcttttttttttcttgagactggccattgattggttctagtttggaatattggatcgattgactataactgtttccgtccctacatgttaggtctgcattatgctccttggaaggaatcattagaaagaaaacttaccactacactaaatgtcactcaccgtattaagttctgtgcaaatatgcagcagaattctattgtgccactggctgctgttgtgcaactgaatttactgggtgggattcttaaactaaaaatataccagatcatctcagagtctccggaagtaacaggaaaaacggttgattcatccttcaggctactgttaggacacgaaaacaccagtggaagaaataagttagcatgatggtataaatcttagacattatcgtcgttgtcggttgcttttcggcgtgttggtctgatctccttcggagctcttttatcatccgtgtcgtaaagtttgcacacgtcgctgtcgattagtccatccacagctttgtggccaatgggccaagttactttgctccgattcatagtgctttgtggttgtttgacccaaaagctttacagtccatcttttcatttatatttatacttattagctaaaatttaaatttttaactctaaatttaaagttgatttaaaggtatttttatcgtagtttattttccagactttgcttttagatcgttaagaacacatctataaaagttgtattcacaaattaatttttgttacaaatatgtcgtttcttttttttcgtccaatgtcccaaacgatgggtctattagtttatatgtgttttgactgttgtcgcatttccgtgaaattttcctcggaaaggcatctggtatggttggacccaggcctttatatcctatctcccaatggaatgtgcatgcgagttatgggtgtgccgtctatacgtgttctgctcagctgctctccatgctctgcatttgtagtgtggaaaataagaatttagggccctttgaattataggaatgaaaaaatagaggaatagaaaaaacataggattctgacagaaatgtaagtgtaaaacagaggattgcaaaacacaggaataacgtaggaatgaccgtttgattggaccacaggaaaaacacagaaatttgaggagagataaagactcaaacgattttttccatgaggttctacctcttgttaaaattcctccaaaacttatatgggaagaggcattccataggaattttataggattccatagggttcatttctttaatttaaagggcttggtaggaaaaattactataggaacgaaatcctctaaaatttctatgaatttcctttgaatcaaagggtacaagtagtctatacgtgttctgctcagctgctctccatgctctgcatttgtagtgtggaaaataagaatttactaggtacaagtagtttgagggtaattgaaaaggatatatttagattgatatgattttaaaccatactattgaaagtggctatacattaaacaagcctgtagatctagatatatcgatttatacaactagaaatatctagttttacaaaatcttggatccgaaagtgtgttaaataagatgttaggaaattcataggaattttaggcccctttgaatcaaaggatttatatagaaatttcataggatttaaattctataggaaatttttcctatttggccctttgattcaaaggattgaagctttccaaatcctatgaaattcctatagaatggcacattgcatatggattttggaggaaatttagcaagagctccaacctcttggaaaatttcctttgagtctatctctctcatccgattcctacgtttttcctgcactccaatcaaacgaccattcctgtgttttgcaatcatctgttttacacttcaattcctgtcagaatcttgtgtttttcttattcttccgtttttctaccctgcgattcaaaggggcccttagaggattttattcatatatgaatttttcttacaaagccctttgaataaaaggaataatcctatggaatcctatgaaactcctatggaatgcctcctctaatgcaagtttcagaggaattttaacaagaggtagaacctcatggaagaaatcctttgagtctttatctctcctcaaattcctgcgtttttcctgtggtccaatcaaacggtcattcctatatttttcctgtgttttgcaatcctctgttttatacttacattcatgtcagaatcctatgtttttttctattatttcatttttttcattcctatgattcaaaggggcccttagtgaatcctatgttttttctattattttatttttttttattcctatgattcaaagggacccttattgacctagcgagacaacgtatggttctgtaaaataaaaactgtaaacacacagcatgagcagccgagcagggagcggtgtagtgggccaaggcagccaccgtttcttcccatttccccccaagacaaaccaaatgaatcgctagttgctatgcctattagcgatgtctgttatctttatgtctttcgattgactctaattttgatctttgagcaaaagggcatttagctgagtagttacaaagagtctcagtacatcttaggtccagagtttgattttttgtgggagcgaattttccaacatttaacggctttgtgcttttaatggtagacgacgtatctctaggatggatttgccgacccagtcttcgaagatgcttataggggtagggtctgcatgcgtgcgttcatagtggtgtgagtgtgcgtgtgttgtgaatgtctgcgttgtaatatgtaatcgggtagctaagggtcttattccaccatgggtgacatagttacattagaattgctagctaaaaaatcttcgtggttagtcaataataaatgagagttgaggatttgtcccatctttatttcttattctgacttatttttatctttactattttttcaacaaacttataattgtgcgtctcatgacagaagccaaagatacaatccatttttattacctaaaaattagtgataccctaattcaatcaagaccgaaggatcccaaggctcccagctgcccattccagatggacggcacggatgtacgctgatgacatctgcgctttactggttacaaatatagaggatctgcgcccctcgcgtcctgcctggccttttccgtgacgagacgacgcagaacagaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttcattttctttggctcttcagagttttgtccatctctatcttcagagttcttcagagtttgcttaccatatgatcgtgatcaggtttgtagccagccaaatcttaattcataagaatgcaagatattcatgccttgacatgtgatttctttatttgtctatccttttcaggtatcggaattctctttatttataactacaatgcaatcgctcattttacccgtaacaattaccaagagcttgtttagttgacaatagagatatcaagtcaaataaggttgtttgtgttacacaagataccgatgaattttgtagtgttgcccttctattgggaattcataaatgttgccttgatgagatactacagtaccaataagttttttttaatgcctagaggttaatgaaacgtatagcatatggtccgcaaggctaaccaacagtggatcatcccaaacgaaaaaaaaaaactatgcatgtctctcccacgcgcattatttttcaaggtaacatacatgagccttttatgcacaagtgcatagaattgcaactataagatttttttataatagctttgatatatttaaaattttattacacatgtcctatgctaagtttcaaatgtaagttgaaaaagttggtagataaattcatggcctaataatgatacctacatgaagaggaacacttctacaagcgtcatcaatgttatatctagctatctgcaagttgagggttttcgtcaaagtatggcatcactcaagtcacacctacttaattcaagcatggcgaaccaatgaaataggactaaaaccataaatgctagataaatcatgctagaaactcctatcataatatattgctactaaatcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcagtttttttcagcctattccttttatccctcatgcctaaaattgtacaatggttagccctactgcaaacgaccttgcacaataaaaaaatcatgcataattgcatattcgagtgtaaattctttttgcatatgtcttttggacagtacacctgatatgtactcactccatttttaagaaagactaatttttaactataaatatggatataaactatctttagatttgtgttaaatggtgtgaagttaaaaataaatgtggcatcctaaatcgatccatacacactattttgtctattggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgctttttccttgcctctccccaccacaccacaccaccccatctcccatctcaccatccccctttcccaccctcccgtgcgaacacacccgcggcgcggagcccagatcgggatcgcgacggatcggcggcggcggcggcgatgggaggcgaggcgggggagcggcggctggggagggcgatgagcttcgggatcccggacgtggcgctggggctggtgatggggttcgtggaggacccctgggaccgggacgccatctcgctcgtgtgccgccactggtgcagggtcgacgcgctcagccgcaagcacgtcaccgtcgccatggcgtactccaccacgcccgaccggctgttcaggcggttcccctgcctcgagtcgctcaagctcaaggccaagccccgggcggccatgttcaacctcatccccgaggactggggcggctccgcctcgccgtggatccgccagctctcggcctcgttccacttcctcaaggcgctccacctccgcaggatgatcgtgtccgacgacgacctcgacgtcctcgtccgcgccaaggcgcacatgcttccttttcaagcttgaccgctgctctggcttctcaacatcctccctcgccctcgtcgcccgcacctgcaagtaattattttttacccttacaaaatattactcgagtgagtcatttaaggttctcctttgttcgcttaaaaagtgttgttgtaaaagggatttgggtatggtttgcttacggaagggaatactacgtcttaggagttctctcttgctttggtcactataaaaacatcttagttctagaattcaactttggagataattgtagctcataggtattaaggaaatggtgtgctttaactgtcacaccctaattttctagtgaggtgcgaggatttagcttagatccaaggctacttagtggaaatggataagtagaaataggttactgcaagagtgcggtggatttctagataattgaccagccatatgttgtcatttgcaggaaacttgaaacgttattcctggaggatagcataattgctgagaaagaaaatgacgaatggattcgggagcttgctaccaacaatagtgtccttgagacactgaatttctttttgacagatctcagggcatccccagcatatcttaccctccttgtgcgcaattgtcgaaggctgaaagttttgaagattagtgagtgcttcatgcttgacctggttgatttgttccgtacagcagaaatattacaagactttgccggtggttcctttgatgatcagggtcaagttgaagagagtagaaattatgaaaactactatttccctccttcattgctccgcttgagtttgctctacatgggaacaaaagagatgcaagtgctatttccatatggtgctgcactcaagaagttggatcttcaattcacattcctttccacagaggatcactgtcagctggtccagcgctgcccaaatctggaaatcttagaggtatttcctggtagattagttgcatgtctttttgttatgtttcttgctttgaggttttataggaatattcaacatgggctgataatcctttttctcatgtcaatccaacaggtgagggatgtcataggggatcgtgggttagaagttgttgcacaaacctgcaagaaattacagagacttcgagtagagagaggagatgatgatcaaggaggtcttgaggatgaacatggtatggttacacaggtggggttgatggctgtagctcaaggctgccctcatttagaatactgggcagtgcatgtcactgacattacaaatgctgctctagaagccatcggtacatacagcagcagtcttaacgatttccggcttgtcctgcttgatagagaagcaaatataacagaatcaccccttgacaatggggtgcgtgctttactgagaggctgcaccaagctccggaggttcgcattttatgtaagacctggggctctatcagatgttggccttgggtacattggtgaatttagtaagacaatccgttacatgttacttgggaatgttggggagtctgaccaaggactgcttcaactctcaacaggatgcccaagcttgcagaaattggagctgaggggttgtttcttcagtgaacgtgcattggctgttgctgttttacaacttaaatcactgagatacctatgggtgcaaggatacaaggcatctcccaatggcactgatctaatggcaatggtgcgacccttctggaacattgagattattgccccgaatcaagatgaagtttgcccggacggtcaggcacagattcttgcatattactcacttgcaggaatgagatcagattaccctcactcagtaattcccctctatccttcggtttgagtgtatatgtctgataccaggttgcgaaactcacactctagtataggccgatattgttccaaattctacagtttgctgctcttattctgtttagcaatgagcacagaacaaatgacaaataaaagcaggatagctgttagttcgaggaacatattataacatcttgggactaagaattttattgcatatctgaggggtatcacttctgcgaaagctcagctcaattggccagcacggatatgtaaacttctccattttgattaggatcggacacacaattttgtaataatgttccttgttcaatgtttagtagtattatttgactctttagctttgtgtcacattgtctcttggaagatcgccgcgctgtgttctaataagtcattcgctgtacaatatttttatcatccacagatcacactactggctgtattcttgctgtgacttttctatttcttctctctttggttgtgtaacgccccttgattggtctgtatgatggcgcgctgcttcttactttatcttgtttggtggaaatgtggaatcatgcatatcgatatgtaattacatatttcaataagagaaacaatagccaacctcacttttctaatctatctatgtttactcctaaatcctaatagatttgttgataggttctatgcgtttttggtgcctattcattttgtttggtttgggagtgccggtttgtaattgtgtatgcacatgctcctcctttacgtcctgtccacccttttttatttcgagtatggtgttgtcggtttacaaatttatgaggtgaggtggatgcaatctacttcctccatctcacaaagactttatttttagattttcgtatctaacatttaaccgtatatcttatttgaaaaaaaaatgaaaaaaattaaagaaaatagtcacacataaaatactatttatattttatcatctaatactaataaaaatattaatcataaaaaatagttaaataaaacgaagagaaacattatatctaaaaactgaaaaataaagtctctgggagacgaagggagtagcctataaacttgattcggtaacttgatttgcccacagtagcacaaaacccagcctgactgcctgaaccaactgtgtctgcctgcgaaaatgacagcataacagaacctgatacaacacacagtaagtatcaatatgctacagattgtagatctggacaccataacgaaccaccaataatatctgcctacgaaagtaagcataacatatagaagtatccgatacaatacgacacaaatattatggtacacggtttctaagttggaaacaggtgcaaagtaagcttcacgagatacagacatacacttaggcatagagagctttattgatctctagaacatcaagcttcaattcattctgagcgctccctggagacagaccttgagtaggaactgcggctgtgagagtagctctccctagaatgcctcttacccgacgacctgctgcgcgacggtttcctttcactgtatcttttccttggagaatagctccctgacctctgagaatccggggaacagctatgggagtagctcctctgaggtgatacactgcgagaatagctccgtcctctagcacttggagaatagcaccttctatagtatggtgaaacagaatggtcataggaacatgacctctctcttctgtaacggtatggagatcttgaacggtagcgggaaccacggtaagatgagtatgaccgacgccgtgaaccacgtgtgtcatagggagagtatgatcgccgtctaccataaggagaaggggatctgccatacggagagtaggactgtctcctttcatgtggagagtaggatctacgcctctcatagggggagtatgatcttcgcctgttgtatggagaatatgatcgccttctaccataaggagaataagaccgttctcgctcaggtgagtagcgtgaactgtagcggtctctttcaacaggcgagtagcttggggaatacctccgtgctggtgtcactgtataataaaaaatattcagcaatcagttgtattatatcaggaaaggctagcaatgcttcctattttccagagaaatgagaccaaaccatccagacacagcagcagttaaatcaaacttaccacatgatgattttgtgcctagataccttccgggcgttggtgttcgaccacgtcttctcttggcctgtggaaaggattcaaataagccttttcgccatattagcattaaagagtgatgcaacaaattgggaatctgaacgacatgattaatatggagactatataatgtagggcatacaaccctttggttgaggtagcatgtttggctgttaggttgtaaatcttttgaatttgacgtagagcagcaacggacatctaccctgctgctgtcaacaaaagcttcaaacggaagagcactcaaatattcagctcagcaagctaaatgagcatataaatttcactccaagtagaagtgaagaaattcagtaaatatattgtgattataccttctctacagttatcacacgaccttccaacactgagcggtctagatatttgatgcaaagatcagcctccttaacagtagccatggtaacaaatccaaatccccgggattcccttgtccatggatcaagtactatgctagcatcaataacctgtaatacggtgagcttaaaaagttgtacactattttggtatccctttgcagatactctataaaggttacctctccctcagcagaaaagtgtttctccagatctcgatctgtcacacgagcagataagccagtaacatacaggttgttcccagggttttcaacatcacttgagtccacacttctaaagacatcaaaaggatatcacatactcatcagaattacagtaggcaaaaatgttcaccctcgaatatagagtgaaggcagaaacatactaagcgctaagataaataccatacctagaacgactcctataccttgaacggctgctccgtctgggcgatgtagaatatgagtcggactcatatctatcagtaggagccaatcaataatcacaagacagggcttcaaaaaatgtggaaaaaaattaagtttggtaatgcgtaccttgatcctctggagtacgacatctgcaagatagacatatgattgcatcaatatccactagagaaacaaatatatacaaaaacatgagatgccacttgaaaatgtaattataacaaacagtgggttcatagccttttgaagttgtaactgattaatttatgacaccttggtgacaatannnnnnnnnnnnnnnnnnnnngcaaaacaaaattattatcttcagaatgaagagatgacccagagtatatacctagcgcacgccaaaaataatccacaaaccaacataacgaaatgaacaagaaactgcaagacaggagattctttgtttattttcagcatggtaatcatgaactataacttatgcaattgcgctcagcaattgaagcttccaaccatacagtccctaagataaatcgacttcctaacactgtccctaagtttcctccgaggcatgtaggggcactatgcaagtttcgaactttcgacagttgcgtttcaaactacatatacaatggacaaaaaatgattatgccacaagttgtacaacaatttgttcccttcatttcttcatttcgtgcccctctagaaacccatgtactagcaatctatacctcttcttttgcaaagcaaatacacgcaaatcagatcattttaacaaatgagccgctatccaagatggggaactcctgccgcaacgcttcgaactacagctaggatttatctttatatagattaagaataacaaaaataaataaatataaacggatgtttttatacagatcagaggggcaaaccatcgccatactggaacagagaacgaacggattcaccgtctttagcagagataaaacatgaggagaatcagaggcagcaataataccttccttcgtcgcgacgatccgtgccctagccgagagcgtctctctgtgccggcctctcttgttctcagtcacggcgctgcctttctgcgcgtcggagcgcgtgcggttgggagaataaatggaagtgtggaatggggaaggttctggacggaggcggacgcgaaagtttctcaaatctggttgatgaatcggttgcgcgcacgaactccgccttcctcttcacgccttcacacatggcgcttcttggagccattggtttttctttcggtttgcagtaaataaaagtttcccttcagggtttggtttactttccaactttttcttcaaacttccaattttttcattacatcaaaaatttttacaaatataaacttttaattttttttctttaaactttcagttttaaccaaacttctaattttagtgtagaactaaacacacagcctagacctcttttggtcctatagaaaattagagcattttaattataatgataattctaacgagttttttttaaacaaataattcaatcctatactcccctgtaaaatttctataaaatggacacccccaacagagattttaatgaaaatataagagttacaatccttatgtgtcttacaattgtattgttcatctatgttacaaatattagggcatgtttagttcgcggaatgaaattttttgggtgtcacgtcggacgtttgaccggatgtcgaaaggggttttcggacatgaatgaaaaaactaatttcataactcgcttggaaatcgcgagacgaatcttttgagtctaattaatccaccattagcacatgtgggttactgtagcacttatggctaatcatggactaattagactcaaaagattcatctcacgatttcccccctaactgtgtaattagtttttcttttaatctacatttaatgctccatacatgtgtccaaatattcgatttgatatttttggaactaaacggggcctaagggtgtgtttggttcttccctttcccaacttcaaatctttgttttatgtgcgcacgctttccgaactgttaaatggtgtgtccttttacaaatgaaaaattctatgtgtgaacctcaacataggaaaataataataataaaaagaatggttgattgattttgctttagctgttctatttgtcagagtaattatcgagttatgaaatgctatctccatccaaatcgcacccccattggttggcttattcttggaataagccaaacgacacatttacaaacaataagtaatttgtgaataaagcatttatatacgtgttcttagcgacctaaaagtaaatgctgaaaaataaacttcaataaaaaactctaaaactagcttcaaatttaaggttgaaaattcaaattttagctgataagcataagcataagagaaaagatgaagccgcatatggcgtatccaattaaactacaaaacatattgctaggtttaatgcaagtaggacatgatataaagtagaataactatatttacttttagtcactttattacggtggttcttgcaatcagtactcccgcattcaaattagtgtcaccgagcgctatttgtactttttaaaaaaccgctatttgtttttgggttaattggatccatgccattgcaactttgtgaaattaaaaaaaataccactactattcgtcatatcggctatatgccactagaaatttctaaaattgaaaccataccactcgcgtctcttttttcgtcttctctctcacaccgtctctgttcctgtcctcatcccctccctccttcctcatctccgttcccgacttcatcctcctctctgcgtgagcagtagaacttgatgagggagttggtgacgacggggtcccgctcccgcgtgcgccttccctttccctcttcgtcgctgacacggtctcctcctccccgccactacatatttctcttgccggcgaacttccaccgcacgcgcacaagcacaatcatcacagactccggcgatctccatggctccattcagtggggtgatgacgggtgcgcgagcgcgtcgtacttgaatgcctgcgcgtgggtgaggcacgcggcggcgaggcacgcgaagcctgcggacggggaagggggcggggaagacaacgacgcgagggcggcaaggaggagggagagggtggacggggtgggcggcgaggcctcacagatgcgggagtagagggcaagggtggcagccgcgggggcacagcggcaggccagcgcagcgtggagcgggcagccttgggagggcgccgacgagaaggcggcagctctgcggagaaggaggaaggtggggtccagagccaggggaggaggcagcagaggcggcgtgagagcgcgggcatggcaggagggcttgggagccgccgccgccgtcgctgtcctcgatcccctctatggccgttgcctccatcctcgacgcaatttggagctcgggagtcgccaccgccgccgctgtcctcgatcatcgacgggaggtctcgggagctgccgccgccgccgtcctcgatgccatccgcggtgggagtgctcgggagccgccgctgccaccgtcctcgatgccatccgcggtgggagtgctcgggagccgctgccgctgtcgtcaccgctgtcctctttgcaatcgcagggatggaggaaaagatggagaagaaagaggagggagatggaaacgattaaatagggaagaacgagacggcgtgggagaggagacaaaaaaaaaagggatgggactcaggaatggcatggtttcaattttagaaatttccagtgaacatgtagccgatatgacgaatagtagtgatatttttttaatttcgcaaagttgtagtgcattgatccaattaactctttgtttttagcatttgaccattcatacttaagagagaaaatgtgaaaccatatataaagttctctagattcataaaaaaaactaaatataatataggcacgacacacattcacataaaatctcatctataaactcaactttgttcgaggtaataaaaaagatagatttcatgtgaatagttatgtgttattgttcatcaaaaaattgtcatttttgttactaccaaataaaattgagtttgaacttgagatttggtgtggatatatttcatgtctacgtcaatctccaataattatttttctcagatttattaaacttttagccctggtttttaggggtttttttcttatttgatgattttcaatgaatatgtaccttgcttaaaatagtggcggctggtgtggcagcagtcatttggactatgtggaaagctagaaatgcagcatgtttcaatgataagaaaatttaagatgatctcgttgaactaattcatgaagtatgttattggatcgaatcttggtccattttgcagatacaggaggacgagcgaaagaagactacaactgagggtagtgctgctaaggagaatagccgctgagctatacaactctgtaaatggatggaagctgcaaacgttgaggctgaaatgaagaaagatcatgttttgtcgtgtttcgtcgtatatgtctgttgcaagtcctttggggattcaaatttgataatggaagtctattatctattttagtttagcatgcagttactgggtatgttgagttacagacttaagttcggcacctgaggttggcaactaatcactgttgcatggaaaacagagcggtccatcagtgcatgattagttaaatattagttttttttttaaagttgatcgatatgaattgtttaaacaacttttgtatagaaaaattttataaaaacgcactatttagcagttttaaaaggtgtgcgcgtgaaaaaaagagggaagtgagctgggaactttggctaccgaactcagccttacaggtcatataaactctgttaaaagactttgctatatgcgtttcgataaagaaatgggagacgaaccctctctttcttaaaaaaaggtaccctgcttaaaaacacattatatattattaattgtaaaatgcatgatgtaatgtatatgcacatgaaacccccattagtcgtttcatagtagttcaaacattacaataattattgatcaaaggctacattatttaagaacatatggagtaaccgcatataacaagagagaaacctgtttagtgcctttcaaacttccaactcttccatcacatcaaatatttggatatatgcataaagcattaaatatggacgataaaaaaaccaattgcacagtttacatgtaaattgtgaaacaaatcttttgaacctaattacaccatgatttgataatgtggtgctacaatagacacttgctaatgatggattaattatgtttaatggattcgttttgcaatttacaggtgaaaactgtaatttattttgttattagtctacgtttaatacttaaaatgtgtgtccgtatacgttaattttttttaccaaaacaactaaacacggtccttgtcgtgaaaaaattatatatttaaacatagcagtaataggtagatggaggcaaaccgaacatgtaaataagcatacatgtttatattatgttttgcaaaaagaaaaaaaaagaaatagacagagggagcatgctatgtcgatcataataagtatttatatataggatctgttcagattgtagccaaaacaaatattatcaaattttagcaatcgacaatttggcaatatcatcgttttggcatgatttcttatgtatttcctagagtttggtaaaaaactaaatgatgcatatatttgataacttttttaaaaaggtatggtttgaaataaaattaatctgaataacgccatactagttaatttgaatttgaaagctgagtggaggaatttgaatatttgatcggcgtgaaggtcgtctttccttcgcaattcacaaaatcggtccgggtcgaaccaatcaaccaaagcccagacagtacaccaaatccaaattggcggttggatcgagccagcgccgcggccacggcacttcagtgctccatttgccccaacctgacaaaaccaacccgacccgcaaaaatccctcgacacagcagcacacaagaaaagcctctttgctcgccggagagagatctcactcccgcggcggccatggcctccgggcaggactcgtccagcacgacg

SEQ ID NO: 58048 - DNA, 3657 bp, Oryza sativa
atcgcaagtcgaagagggggaccctgagccagatccagaacgagaccatctccgccgccaaggcgctcaacaaggccctcccgcagcgcaacaggaagaagaaggctagtctcccgttgccccaacccccggccgctgccatctccgcaccccgcttccagttctgactctgttgcctctctgctttctcgtgcagcccgtctcgtacgcgcagctggcgcggagcatccacgagctcgcggccacgtgcgaccaggttcgttctgctacttcggttggatcgaattgcgtggtttgagcttggatctgtaggctttagctgctcttgtacctccctttctgcagaaaagttctcagaggcagcttgtgaatagtgtattccccaagcttgcggtgtacaattctgtggatccttcggtggctccatctcttctcatggtaagtatgccgtcctctactgttttagctctttttatggcttcatctttcacgtagacagcgtaattacttggtaaaagcagtaactagggtaattctcagaaaattcgactatgttagcaccacaatgcattgtcactatggtttgagtctctgaggagatcaatgacaaccttttcatgtttaaaacagaggaaaaaaagtacgagtacttaaatatgtgttgcaacttggaactgaaactgcacacatcgcataattcactgttagattaacctaacgagatcttgtttacttcagttaacttttctcttaatcgaatctggttctgtatttacagcttcatcagcaatgcgaggatagaaatgttctgcgctatgtatactattatctggctcgcatattgtcagataatggtgcccaaggtttaagcgctgctggtggcatacctaccccaaattgggatgctcttgcagacattgatgctgttggtggagtgacacgagcagatgttgtaccaagaatagttgatcagctctcagctgaatcaaccagcgatgatgttgagtgtatgcttttatactgtgctctcaatatacgttgaagttgtattatgcaaaacttgtattccaaaccaacctcttgtcactgttttacattttttcctcattggtactgctccccttttgcactgatcacacctcatgattagttctaccatattctaagcatgctatctcattttggtgaaataagtattatgttattttcttctgttttgcatcttagtgagaattatatttctagtaaacatctaattctgcataaatgataccatatgaccaaataagaatgatcacaatattattatgcatggctgagctaaaacaagatgctctttaatttcttgaaccaagcatgcttaattcttattaagttgcattgggtggttcttcatagtgctaaactatggattctggtctttgaagttcatgctaggagacttgctgctctgaaggcccttacctcctcctccacaagcaattctgagatgttggaaaaactctacgaaattgtgtttggcattttggagaaggttgataattgatatgcttttcatattcagattagttcctcaaagttttattgccctaagttcctttttggtatcccttgtttttggctataaaattgacgcttttcttctgtccatgatgtattctgaatcctttcaggtggctgatactaaacagaaacgaaagaaaggtatatttactaagcaaggtggtgataaggaggtactaaacagaacgaaagtactatttattgtatatgcacttaacccttttcttagaggtttcttatctcataccttgctgataatgggagttaagaatacacttattggaacattgtagttaacctggtagttttttcttgactagataacaaagtaggtgacaccacttcctgtttattttgagctggacttaaaattcctcactagtatcagtacaagctgtctgatgatgcctttctaatttgcatttctttgcagtctattatacggagtaatttgcagtatgcttctctaagtgccctgagaaggcttccacttgatcctggtaatccggcatttctgcaccgagctgtccaagggtaagtgtgaccttttttcctctggaaacttaagtttaggtttattttccatgtctgtttagtttaccagttatctactacctccatttcatattatatgatgttttggatttgtcctaagtcaaatttcttagatttcgaccaactttatagaaaaaaaaatcaacatctggaacaccaaattagttcatcatatccaccattaaatatattttaaagtacatttgctttgtgttgaaaatgttgctatgtttttctatagacttggtcaaacttaaagaagtttgacttaaggcaaacccaaaacgacttataatgtggaacaggtcgaataggttattgcttcttttgaggataaatgggggcatgagtattgttttgtggtatcttttatttgattatacaataatagtttttcttattgggagcctagtctaaactaaaagattagatcattgtgatgacattgctaatagtacggcgaaggaggattcttcagggtgtgcttaatggagaatgaatattcgacatctgttggtttgttaatataacctatcttgagagatctagaaaggatgctattctcgtgtctaccttaaactgcaataccgcattagtgttttttagacggatataagattgtgagagccgatgctctctttaggccttaatatggatggatatccagtgttcaagcaggtaagtgtaaagacggagttatcaaatggtaaacttcatcgaaaagaatttctccctacaaagattacaaacaactccttaagctacatatttgtattgaagtcttctttaagcaaattgatcatttcattgtgttgtctgaacataattatcaaatggacacctaagtttttgtctatctatttttatgaccacttgattctgcttctgcaacaaaattacagaggggtatagcctaatcaaaaagtatcatcaaggaacctgctgttgcataattatcattttattctcatcagacctggtacaattgcagggttgaattttctgacccagttgcagtaagacatgcgttgtcaatagcctctgaaattgccgtgagagatccgtactctgtcgcaatggcactgggtcagtttactcactgattgttgttcatcttatttattgttcttgcaagcagacaaaacatgggccattaactcgtggtgtagaacatacttgatcttttatgtgcaaggaattgtatagaatttcgactataaattttttaaaaactgtcagctgtgatatatttagtcaatatgcagtaaatttggctcatgccatttcgtagattctcattctcatgtttgttttttgttttgcaggcaagaacgcacagcctggtggtaatgttttttcccctttcttctgtgtttcatttgaacttaacttgattatgcatctgatttgtgttttagagttctagttgaaccgaccgagtttgtagaattaggatttctaatgatatgggctgtattctgcgaagaatcacgtgttaaatcgcattcatatattgttgtttgatttatatttacttgt

SEQ ID NO: 58049 - DNA, 714 bp, Oryza sativa
ttgagtttgttctactttgatgtactcatttcctattattacgctgtgtcaaatttaaccaggagctcttcaggatatccttcatttgcatgatgttcttgccagagtttaccttgcaaagctgtgccattcaatttctagggcacgtgtattggatggtgagtgtaatttgtttttgtgcctgtcttaaatcaagatgaacatgtcatgattccagagtgaatgcatttaatcgtggttctggtcaaatttgatttacgcagagagacctgacataaagtcccagtacagttctctcctttaccaacttcttctggacccaagtgacagggtctgttttgaggccatactctgtgtgttgggaaaagttgacaacacagaaaggtactgatgaggtttcaccaatttaaatttctatataactttgtttcttcacttcagttcgacttgtacgtctgtgtttttccatataaattactatatcttgcagcacggaggagagagctggtggatggattaggttaacaagagaaattcttaaattgcctgaggccccttctgtagcatcaaagggtattctgtcaaaatctgaaaaatcttctaaagcaaggcgtcctcagcccctcattaaacttgtaatgagaaggtttgtatcttcattcaaatgttcaaatagtcggtctctctattttgatttccctgtatgttttctct

SEQ ID NO: 58050 - DNA, 1305 bp, Oryza sativa
atagtccttgatctaccaccacctcagcctggttcaatgtctggatttgcatctgtcgatatggtatctgcctccgatccaaaatcagctatggcactgcaaagattagttcaagctgcggtaagaacaaattctccactaggttaattttttcattgagcatggaatcacactatgttgatgtcttggcccttcggtggatcaacaggtttggtttctaggtgaaaatgcaaattatgctgcttctgaatatgcctgggagtctgcaacacctcctggtactgcactaatgatgcttgatgctgataaaatggttgctgcagctagctctcgcaatcctacgcttgctagtgctttgacacgtctgcaaaggtgtgcattcagcggtagctgggaggtatgcccttctgaaaagctgatggtattgcatcatcttataacactggcatttttcttatctcattgtttacctccgtagatccgtattgctgctgtccaagccctaaccaccattgcaataaggtctggtgaaccttacagactgcagatatatgagtttcttcatgctttagctctagggggtgtacaatcaaacttttcagaattgcagctaagtaatggggaaaaccaaggtgctagtggtactggtcttggatcattgataagcccaatgctcaaggtcctggatgaaatgtatagagctcaagatgatctcgctaggtatgtcacccccaagattccattggactgttgtagatagtactgaactgactactttgtgtgatcatttgcagggatatccgtcagcatgataatagtaagcaagaatggaatgatgatgaacttaagaaactttatgagacccacgagaggcttcttgatttcgtctctttgttctgttttgttccaagggccaagtacttgcctttaggtcctaccaggtatgtgtcaatctttgggggttctaatctcctaaagcagtaaaactattcctggattcaaaaggttaccttattgctacaactgcttaaagttagacctataaaattcactactcaccacacgacgactattcctaggactattaacctattgcttcacagcccatgtcatctgctttcttgtcataccacgaagcattctatcacaaaaggaagagcataatatttagtaatttgataagttacttctagctgtttcttgatcccaaaagggcaattgggtgtaatgggtgtctgccttttgtcctattattctttcatacctcattttccgtgatgcggtattgtgtaactaccctatatt

SEQ ID NO: 58051 - DNA, 9185 bp, Oryza sativa
aatgacattccaataatattattttcatcaaataaaatttaatttataataaactatttattggtcaataatttagagagttgaatcttaaaatgcgtgcgcgccttagtgagtaggacggagggagtacctgatttcagatgttttgaattgatagaaagtatcaaaataattcaatttgtttttatatgttgcaggatgatgatggaagatcatctgggggatcctctcctgagtcaactggttctgtagaaacatccatatcgtcccattttagtggcatgaactatccgtcgttgttcagttcaaaaccatcaggatatggggcttcacaacaaacggtattcttttacttagtctttttagtgttaaagtgatctccattattgggtttcacacttaataactgttggaaaataacgtactgaaaacctatgaaatcaaatgtatgcatgctgagatgggcatatttaatttaattaaactttaaataagaaaacaaaagcttttacttattcaccatctggaaatcaagtcaccgaacagcaaacttagctattgatgtaggaacctcgctgctgcttcataacaatagatttccagatggcatcatttgcttaaagagcatcggtttgcgttttgtttcagatacgtgaagaaccaccatcatattcaacatcagttctacagaaacgtgagtcattcgaaaacccccttgctgggcgtggtggtcggagttttggatcccatgaggacgaagacaggagttcagggaaccctcaatctgggaaagcactgtatgacttcacagcaggtggcgatgatgaggtatggaggctgaaattgtcttggttggctataacgtaacatcctgagcttcaatgcttccttgatcagagcttgataggcattagctgttgtgaaacatagttatttcagtgaagcgaacctcgtgcttttcatttgttacaagaacttaatatcttaattaattgagatagctttttaaatttatgatttgataagcgagttctgtagtaaaagagaagaccaaatgaaagcacaagtaaattatttgaagtgattaagctggctcttatttcttgtcttggaatgcacacaaaagaaagtttatccatgtaaatttctttcagttgagtttaactgctggagaagatgtggaaatcgaatatgaggtcgatggttggtactatgtaagttctcttctcactttctagtttttcttgttctttagtcatgcgcaaaaacattttaatattggttattattgcttatcttcaggtaaagaagaagagacccggaagggatggaaagacagcaggtctggtccctgttctgtatgtgaattcgtgatagctatgagtcctgtgacataatgctctcgaaagctgattcggagtaaacgggcatacatatggcgtctggggaggttccttctgtgatcttagtagtgcacataaccttttttgagctccctagcatttgacaggcacatgtccttgttggaggccaaattcaatcatcgtgatgtctgtaagacgcagcaattttcttgctggttgtgtttctttgctttatacacaccacgagtccattcaattcattgtttatgtgtagagatgtacacgtgcttcggggttttacctttcgtgtgctattctggcccgtctgttatgattgaaagacgcagtttactcctctagttctccatcagataggcattattttgtcaaattgttgctctattggaggctgtaaactgctgaaggctgtatcttgctccccaccattatttcggtcttgtttatggtgattcagtagaagtagtaggcctgttaatttgtgtaaattttgtcttgtgcggagtatacatacatgaacacatacgacaatggaatggtatgcgtcgataactttcttactctgaacacttaatgcagtatacgctatattctggctatttttatggttttcgattcctgtatgaattgattgttgtgaaattcctggatcacagtttcaaaatgagggctaacatcccgtaattttgttttatagtacttgactacttgtacagttgtactaaagtcggtactcggtagcaacacaaacaatgcatcgatactccctatgtctcgtaatataggattttgctccttccaattatcccacaatataaaagattttggtgtaatacttgtcacatcaatcaactcaaattcaaatttctatctattttaaccttcaactatccactcatccataaacaagggaaagtgatttcatccctcgaggggatatcctctcgtttcgtgcatatcacctaaatagctataaaaaatataaaaaaattggcaatatagattaatatgaaatatatcactccacaaacattgcaagtttaaattgaacttctacaagttacaacaaaaataacaaatatagttgcgaatgtgcgataactattctcagcttaatttgttatttttattgcaacttgtagaagttgaatttggtctttcatatttgtggactggtatatttcatattaatctatgttgttgttgacgtaaaacacgaggcctgggagatctgcttaactccagtgcaggtccaaagctcgccttcgggtgtgttagcgtgccagttgatttgattctacaatcaacaagaaatagaaacaaagagatcgcggttaaatctataaatgatagctgatcggctaagtgccgatgacatatcatttatctttgagccgatgtcatatgtaaatcgatcggcgactataaatagataataaagaactaaacctactcgatcggctgtagatattaccaatatatagttcttatatcgatatatatttaaatcaagtgattgagatagatcggtcgccatgccaagacagtataaatcacttggatcaaactatatattaataacaggactatatatgtttatagcatagccgatcatataaatttagcatgtatcggttaatactccgatactactctatatcaggatattaaaacaagtataatatatcaaacaaaagcttgatatacttaaatgcaataagatcttgacataaagggcggatttaacatgtcactgaagcatatagagcgaatatggttaaatcagataagatcggctgaaactccgatactaccctaatcggcaaccagaaggcgggctagagattgatattctaagcacgacttaatagatcaaactcaactgatgcagcattaagtatgaaaagaagaacaatatctagacaatcaagccgctggaagtttcatagagtggtagatatcttatataatctaaatcaacatcaaaatctaacctaatcggctgcgctctactaacagatgttagccgattgtaggttagatagcgatattgcaagagattatgtacgatatatgataactcgatgaattacgtaaacaatattagagtatcataaagatggaagcactaatcccgagaatacaagccgtcataacaagttttacctcttgttgaagatcaaaaccgatgcagctcaacccgaaagtaagaactcgtcgaaataaaactaaagcaaaaaggtggcgatgcgccgaaattgtattgaacgtgtgtgtgttttttattacatagggctcggggtctatttatacccgagaattataagatatgtccataccggacacgactattatctctaacaaactctaagataccataagtctttgcggcagacttttgccctaaacatatctctaaggaaattacataaaacatcctaagtaatggatataattaccttttcaggactctatccacgtgcggcaatcatcttgaagcatatcaactcaaacccaatgttggatacgagtcatattgccggaatcggctgtatcacctaacccagtctgattcagatttagccgattctagtcgtagccgatctggactccagccgattcttactctgttcccgcaacaacccttatctttggttccgcttcgatcccatgttcacccccgatgctgatattaccaaatttggtcgttaacagttgtcaatgtcttttaaaaaattttaataaacaacgagaagaagtcccctcgagaaataaaagtttacgtcccacaaacaaatcttatttaataagggcattctattcttgcttaatcttattcaaaagagaataatccttgggagtacggagtactgcactgctcctaccttctgcaaatccaatcaatcgcgggttaatatcccagcacaggtcctcgtggacatcgtcgtgttgtcgggcgcgtgttcttgtgagccagcaatctccttcgatctgcgcgccatcctccccgatcgtgacctgcgccatcctccccgattgagactcgcgccagcagaattaacaatcaaggattgccttttcttccacagaaaaaaatcgccttctcgcgggtgggtggcagggtgggtatacgtacacgtctccgaagccgcaaccaaaaccaggcaaccagcacgcgatggggaggggcgagcaggaggcggcggcgagccatgggttcggtagcatggaggagttctgggggttctacctgacccagcactccaagcccggcacccggcggtggcacttcctcggcacgctcgccgcgctcgcctgcgcgctcctcgcggccgtctccggccgcgccgcgccactcctcgccgcgcccgtcctgggttacggtatggcgtggtacagccacttcttcgtggagggcaaccggccagccacgttcggccaccccgtctggtctttcctctgcgacctccgcatgttcgccctcatcctcaccggccgcatcgacgccgagctcgctcgcctccgcctccagccgcctcacgacgccgcggctgcctctgcacaccgggactgatccgccgaagtgctcgcgatagcaacatctggaagtgttgatgtgtactccaccctgtaatttgctaatccaatttggtactttttttttgttgcttttatcattttcctcgccgatctgttttggttgcggggaaagggtttggataagcagtgtatccaaaattagtgtggctaggcagtggctgcttaacaaaataatgaccagctactagaccataacataataatgctgtttttatttcctgtaatacttgctgcccccaaacacaaatctgtgatcgaagcacaagttcttgggagtacaacacggttaacaccacaagaaactccttgcagaacagtaaagatgcatgtgtcctatgtgaataaccaagtgtggcttctttatatgctggtggaatgcatacatctggctgtacgtgtagtcatgtagagcgcgcgttgctcagctgtcacttctgttgggcttgtctgacgccggatacacctgaaaccaacaactggttgcttgcttactgatgcttcttgaacagaatttcaaccaaactctgttgataattgctgaagaacaggcatgtatacagcattggacaacttaaacaagtacagttaccgtgtcagctgatgggatccactcgtttgtagcaggatttcccttgcaggaggcatggcgctccgatgcatctgggtcatcagacagatgaaacgaggcgtccgccgagggcttgtccatcttgatgaaccctgttccagtctgcaggatattgacagtgcacacacaaattaagatcataagtgcactgtgatcagttcgaattaatggatggaagcatgagggaactaggcagcgacgttacgtaccgtgtggtgctgcttgccgacgcagccgagatccttgtagtactccgtctccacgaactcatcccctgccttgccaccctcgcacaccaatttctgcagcagcaaaccaccacgtaataacaccgtaagatcaactctaagctttcgtgggacacatatatgaaagtgcagttgagagttgggactgggagacctcggtgtgggcttcgagctgctggaacctgtcgagctcggggtgggagtcgtcggggacgagcgcgtcggtgtagacggcggagggctcgctgcgggagggcttggagtggcgcttgggcgccgcctcgtcgtagtactcccgcacctcggcctccatcgccgcctccccctccggggacaggtgcgcgtcgctcctggccggcctcgacatttcttccgatctttcgcgcgaagcgcgctgtgccttcgttagctagcgctcgtgtaagcttcaagcagtccaaggacgacgaggggactgtggtgcgggtgctcgggctatattggcgtgatggctgcgtggtccgcgccgcgggtggatatggacgagatatttttgtgacttctgaggataaatatctgcagggaggtgtagaggttggtgggtgggtcgattggcttagcgagaggtggacgtgcgcgtgagatgccaggaggacggaatttgaccgcgcgcgcggtgcatctcgcggcggcgcgcgtactcgggtgttcgtttgcaggcccggaacgtcgcgtatgcggccgaaggcccaacaacaaagtccccgttgataactgggcccccgtccgtttcctctcctcggccgcatatctgcacaagacggcaaacaccgcccactcttgcagaattcttcctctccgcttctctgctcatctgctggtggtggctgcagattgcgctccgatggcgcaagcggtgcggccgtgcaatggtcggcgcgtcggtcgctcgcctttctctactcgatggtatggcttatcctagttcgcgcgcatggctttgattttgtgctggatgttgcagccacccttctcgcgcggctccgtgacggcgaggcgaggttcgagctcctcgaggactccgcggccgcggccgcggcctcgcccgctcctgctccagtttggcccggcctcagctgcttttctagggttgctacctccctgtacgtacggctggtttccctttctcctcctctgctgatctttgtgtcgcggtagggttgtgtgtgattcgtccgggggattgcaggaggggcgggtggtcgggggcgctgaacaaggtggagcactacggggtccagagggtcacgggtgatggccggtgcatgtttcgggcgttggtacgtcttgtcctgttcaattgcgcattgggaatttctctggattctcaaggaaaccctggtgtgtctcctcgtaggtgaaaggaatggcaaagaacaaggggattccattgacctcaagggaggaggtacaagatgcaggtaacctgcaattatgctttgttcatggataaatattcacagttgtttgagacagcctgtgcagctgagctatctctagagctttgaatttacatttacgaaagtaactgcaatagctctgaggaaagtatatttaggctgtgttcgtttgtgtgagatagggtgagaaaacaccttgttttccgcgcgcacgcttcccaaactactaaatgatgcgttttttgcaaaaattttctataggaaagttgctttaaaaaatcatattaatccatttttgaaatttaaaatagtttatactcaattaatcatgcgctaatggctcatctcgttttgcgtatcttcccaatcttctcaatcccctatctctcaaactcacccttagatgctaccgtaatcttttgatacataaatcattttttaaaattttattttgttcagcgcactcctacaacttaaataatgcttattcagaaaacagaacatccactacaaaaaggagggaaaacttgtcaacacaaggcatataaagagagagctcctattattcttgtgagattcgagtagcccacttgtccatcaattgcataaattagactgcattgcagttcttatctttggcttcaaaacaactttgttaaagcatgcattaatttaggatttccatattgttcgttccatggcagaagttttaacttctgaccgtaacttatgtaggaaattaacctagctactgtttgaaacatcaagttagttaggcataatttgctgccaccactgttcagacatttcttgttggcacctcaagaggtcattgttttggtcgaagaatgtctagaacagaattcttgcatttaagaatgcatgtttcctaccagtttcgtctcagtaaaactgtcattgctgaaactgtctcagtaaaatgttccctaccagtttccatgttcccttaccagtaataccacccccctatgtgccactttcgcatatgtgacttgtgacgtgacaaaaagataaatctggagtggcaaaaaattaaatgttccgttatccagggggcatttaaattttttccactctgcaccaaacgagtttaatccctctcacaacatcccctcttacaaagtggcaaattcccagtatatcctctctacccagcagccttgtcaagtatgacttttcatgagcaacttcactctccaaataaacttatgacactacccatctttcacctaatgagctgaagattttgcgcacagatttccattgaagttcgaagtttgaagatgatatattattttaatatacttttgtgttgatatcctttttcaatttcctagatgatttacggatggcagtaaaagaagttatctgcgatgatgagactgaacgacaaaaatatgaagaggcagttatagcaattactgtggatgaatcattgaggcggttagattcttatgtcctcaattcatttttatggcatgacctgtgataaagaggctgactatcctggttttgcagctactgccatagaataaggcgatctgatttctggggtggagagtcagaactcttggtatagttttcataattctaaagttagcatgcactattaatataaacagcaaccatacatcatttagacatatagaacacctgtttctagtatatgtatcatactctaaaaaaagtatgtgcaccatgtttatgcatcgctccttaagtgtgccaaaaaatataatattgtttgatcgtttcgctctgaagattctaccaaaagtaggtttacctgtttctagggatgaaactggttcggatagtttccgtccatccgaaccatttttcggattcggatagtttcggtcggaat

SEQ ID NO: 58052 - DNA, 4145 bp, Oryza sativa
tatccgtcggaatcggaaaacgctcggaaactatccggatttttttttcggatatccgcagacattgagcaaattttagaaaaaacacgtatatatttataactttttcatacggaatcagatgaagacaaactttatatcaacattgtagagctcgatgagatctacaactttattattgactattttattatttgaggtcatttaaaggtctaaatattcattataatataccatattaatttttacaaaatctcggatctacaattcaaacgacatctgatggagatgtgttccatatcaaaattgtagagctcaacggatctaccactttgtagtttataacatttgtatttgaaagcatttaaagtataatacaaacattacaagtttcgaagatgtgaagtaaaataaataacatctccaatttatacactggtaagtaagttatacatctagtaaaaggtcttgggaatagaaaatgataatcatatttgcatatggatctcttaaaggaacagccatgaaaatcgattttcacatacagttgtgggaccgtatacaaaattgatgatataaatgttggagatgttgaactaaaataataagcgatatctcttcctttatcaagaacctcaatttgaggggttttttatataccggtaaatatttgctaccgtattcgttccgtctcgtattcgctccgtatctgtattcgataatatccgatttcatttccgtatccgagtttttgattccgattccgaaaaaaaaatatgaaaacgaatatgataaagctagtttccgtccgtttccgatccgttttcatccctacctgtttcatagtagagtgtaagggcatctcttgctttgtatcagtacatatggtcgtttcatacaaatctattctacatctgacatattgatgtttcaggttttgtctaaattgtgtcggcagccaatcattatttatattccagagcgtgaggtaagcctctatatacatggataacacatatacatgaatgtgtgacccaaaaatgtaaacatgttgtgaattgtgccttaaagaagagagtatttctaattaaatctatctctagatggttgcaaaataaatgttgttttggacattaatatgagaccataaccagcatttcaaagagacagttggcatatcgttgaaggcaaaatgggtgtcaaaccatgaattcgtactgtttctaatagactttattgcaagagaaaaaatagacaccagatattggtagaccaattaattttaggaccttccgtcaccatgcaaattagatctgggaatgttaaagtaccgagaagacagctagaataggcaatgtgccaaggtttacttgtgcttcatgatgaatggttgagagtgagatgatctgctaaagtgattccaaacatctggatttcattctatatttctgttatcttgttgtaatgctctgaatcctaagaggttcagaatttagatattttttaggttcagaggaaaaaaaattacagaacataggaatgcatttgcaactgatggatggaacttaatgaaaatatagtgaacgtctgaatgcttctctttgcatttttcttgcttataactgacccatcctccagtttggagttgctagttggatgtactcattgcactattgtctgtttccttgcaaacaatcttatgttgcttttctttcatagctagcctttacaatcccccatttcagctgctcgacttacatctttcctgtttgtgtaacagtaccatgggcgtggaaatggttttattcctatagcagagtatggactggaattctccaaggactcaaaacagtggaagaaaaaggtgccagtaagactgttatacagtgggaggaatcattatgatttgctagtataacatggttgcaccgaacgttatcagtaccctgaaggtctgaactatttatgacaactgattttgattccatcattccattgttattctttgatcccacgtagttttttgcttgcgtctctgcagacagcttcgatgctactccatccattccaaattgatctaatatagttttttttgaagttattcttaaatgatctacatatttgtgttcatttattgagtattcgttatttgtacattggagtaaatggacattgatgcatgcatctatgcacacaagtatttataacccacatgcaatatcttgatttgctattggctaagaaatattagggatggtgtatacatcgagtttgttgctagagtaaatatagtatgagagagttattagcttttcttggtcttggtgtacctataaaatatgtagatcaatttggaatggagggagtatatagctaactgttctacctaggaaaaccacatatatatagtagaaaactgaaaactaccgttggatcaaaaaataaatgtctgagatttgtccacgtcattatgagtaaatctgcaagtaaaatttttactcgcgatgacttggacaaatctaatatgtctattttttaccaatggtactacatatgtggtttccaccgtatattttcccgttctaccgtatgaaatccattggttccatcttatctgaaaaacttccatgactaaaatgacactaaacctaataatgtcgcatgagctaattacttcctctgtctaagaatataatagcaacctagcaaataattagacacaacctagtacaattaatctggaccggagagggttagtacattattctcctaagttactatatatattttaagacaaaggagtaggttgttatattttaggacggataaagcaggacaccaggtgataggctagtgaggtcatttggcatctaggctaaggttgttccccatcctagtgatgccattcggcatttaggctaatgctgttcgcagttcgcctgtgattcggttggcgtcacgccgtcaagctgttgaccgtatttccggttggtgccgggcatcgtaataatggcgtgttcgtcggactcggtggttgccaggggcaaagacgatgagaggacatgcttcaaatcctattcttgtgtcgttgcaagcctggttgaccggaatcatgttcttgttggatgagctgtgcgatgcatctactcctatatcttgccatatgttttgttgaacagcaacagcgaatgttttttcccctttgaagcttggttcgtttaatcctaagagaaaaggattgagagaaaataatttcacactacaatacatatgaaataaattatttccaaatccccttcaattctcttgaggaagggattaattgaacaaggcttgaatggggtaattcttttgttgaatcctacattcctattatatctattattctctttgctaaagtattggggaaaaaggttacatttttaaattggttgcaacatattaaaaaaaacgtcacgctatgcttgccaagttatgatccagtggacgaatggtgatgcccaccatcagatcgtacgttcctgacccaaatcacgcttaaaagcaagagttgctaaaacgagccgtaggtgtaacacaggtgtcattggagtaaatgatgcattgataccttgtccgtttgctaagctaagctagagctggccacaggccactgccgtgccaatgctactcgcctgctgtgatgggcccacaattcagcgtctcaccatcgacgtagaggaccgaactcggcggtgcacgtatcaatacaagaaatcgtcctttctctctgcaatgttttttttttcgataaaatggagagagagtacccttccatcctataaaataccgacataatatttggatacacatctatctagatttattatactagaatgcatcacatctagttgatttattgtttatgagacggaaggaaaactacggtgtactgcaatgcgctatgcagggcataatgtgctgctctaattccaagcaacaaatgccaatggaggagaaggtacaaggggatagtccgacgaggcagccggagaaggctggccgacgtcgtgggccgcaccactacgcgatgaaagtatctgtcatcacgccatcatccactgagagcctggcacgcgggccccatgccccgtcccccacccccc

SEQ ID NO: 58053 - DNA, 2041 bp, Oryza sativa
  unsure (1)..(2041): unsure at all n locations
ccccccccccccccccccaaccatccatgcggacgcagctagcagtcgtcgttgcgttgcttctgctgcacttctctctctctcctcgtcctacaggctacagctgctgcctattgatgacacacctctactgcaatggcggagccgtagaaggctcgatgccatgtggaccccctcgtctccgggaccccacttgcagcgagacgagtggccgctttgtaagcaagccgctgcgtgcgcgtaggctaagccgcacggggacaccactaatggcagtaataattgcgtatttttgttaatgagcgctgcacctcgcggggcccatcggtctcactgacccgctctctcctttttcctttccgtcgcggcaaaagtgaggcggcgtcgacgcgagttgagacttgagacgcccaaaaaatcctcaaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctccgtatgtcccctcctcctccctgatcgcgcgcatatatgctttttcttttttctttcgcttcctacctgttcttttgttctggaggtgaaaaaaaaaagcagaagagggaaaaagacgtttttatggccgggggaaaagtaaagatggatctgtaggatagtgcaatctgtaatgtcgcaagcagtagtagtagatctgtggattgatgtcgtgaatggatctggtgcttgggttttcctgctcgaatttcgtgtttgagagatcatggttttgtccgtttcacatctgctgacttggtaaaagaggatcatgagaaaagtcggcttttgattaatcagttaggagtagtcgtgcttgttcaggcaaagatttgcgtcagtctgacaatcgttctggttatctcgctttgcgattttacagcttggcaactactcctcgattgaaggagtgccatactgcaagccccatttcgagcaactgttcaaggagaccgggagctacaacaagagcttccaatcacgtaggctactattgaattccaaaattgcgaacattgacaacctgtttattttgttgataaaatgtgttatgaattctgatgctctggccctgcttatttgttcaattttatgcagccgcgaaacccgcatcggagaagttgactcctgagctggtgagtgccattggctgcatgcattgcttgtctgttttcattccaaagtacttctatgtttctatgtgatgctacctcgcttttcaactaattttgtctgaaacattcatttcagacaagatcacctagcaaagccgcacgcatgttttcagggacacaggagaagtgtgccacttgcagtaaaacagcgtatcctctagagaaggtaatgccccataatttctgctcttttcatcttagtttcatactgtagtgttgttaggtcatttcttccaaaattgcattgttagatgttgaaatagggatgaatgatcagagggatcttttaggtacattattccgcctaattgtattgttctactgtaacaagttgtaaggttctgccttgattgtacttatttaccaagaatttatttcaattatgctcctcaagtctttggaacatgcagtggttgtgatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58054 - DNA, 3571 bp, Oryza sativa
  unsure (1)..(3571): unsure at all n locations
nnnnnnnnnnnnnnnnnnnnnnnnnnnnnnnnnnnnnnnnnnncaagaccaaaacaatttagtaccaaaagcaggcacagaaaagtatcagcaatgaaatggcacacatcacagttgtcaaagaatcgctccatcactcttcatcctcagaatctgcattatgatagcatccgataattttagtgataagatgcagtaagaaaaaccttagctattagaattcctggttcaatgaatgttcgattttgtatgttcttgtaacggaagggagctcctaacatttgcaccacaacgacttgccacagggtgatctaatcaacatgtgatttgtttatcacatattgcccatgctcatgtgaaaaaattgaaggccagtgtttattatttcaatatgtaagccattgggatctcccctattgaggcagattctcttattttttatttatggatgaaaaaaggtaaaacataaaataacgaatatagatcaccaacgagtgattaaaccaaaggttttcttacctgatcgaacatcctctccaacctgtcctttattgttcaattgtttcattatcattaagcatatgagtttccaccagtaaatatggaacacaagtaaagtgaggagcattgtgttgaaaatgtaatacaatgttgttgggaatttctccagcttcctcaaagatatgatggactgatagctgcacattgcaagaaaagacacaaaactgtaagtttgaaccttagttggtaaaaggaacagaagatattatgtcgagaagtacaaacagaccttgatgttttgattatccaaaatgggaagtaaatcagtcgtaacagaagccaggagagagcaaaaaggccaaaaaacaagctagccccgagctccttttctgtgtatttgcacagtttggcggtctcaagaaacacatcactcgcatcatgcaaagccagaataattgtcccaatccgaaaaaatctacaatataaaaaggatttaattgtcttagagccatgcttatactgcccttatgttttatagtgcaaaaggtaataaatatgttgcttaatagctcagaatcaacagaaacatggtgaacaggactaaaaaagaacatgtctaataaagcaaagtggtttcaaaacatctatgtattgttagatgacatagctatgctgcaagcaagaagggtagctgatatgtcaacactacaaatttcgtttttatatctatgtgttttcagataatcttactgttcttcaatttatccaaggaatcaaactactagattgcttttatgtctatgtgtttttttcagagataattttttactgtttttcgaaccactaggacttaactcagtcacagaaagatttggataatcgctgtagtccagtttacatccgaacataagagaaaggaagttttgaagtgcaaaactagcaaatatatcatcaaaggggcttgaaagaaattacccagtcagatatgcatatccgatcagaatagatgttacaacatgatgagacatcatcacagcaaaatcttttctgcgggtctcccaggcaacgagagcaaaaatgctgtagatataaaatccacactggcacatgtagaaaagcatcaatgaggacctgcaagaaaaggacagcatatatataaggaaaatggaggtaaatcacttactccctccgtcccaaataaaccaacctcgtactgggatgtgtcacatcctaatacgaggttggcttattttgtgatggagggagtaaccccaaataacaggtttatgagaactctaatcctgggacattttggtcagcatagcgatgaaaacaggggtttggtattactacaagtgcatgattataagtaattaaaatggctcggaatatgagtttcatgtataaaacagaaagagcaaaactaaagggtgctgacaacaacagttttatgtttttttccctagctaccttccttctgcagtatactagcaatgtatcaggcatagagcgcatgccatacaggtatgctcatagatatgcagaacgtacgtaagagtagtttacactcacgtcatgtattgatttggccagccctcgaagtattgcattgtatctaacgaccagggttcctgctttattatcaagaggacccatgcttgaacagaaccatagtatgtcagcttccaaatcgactcagagaacttgacaatctttgcttgcctgacctcatcattcatcagcttagaagccttgctactgaaacagtaagctgccagtggctgaaatgaaacatacatagggactatatgtaaggcgtaaattctcaagtgcaactgatagttattctgaaatttcaaaagcataattttatacaggcaattcggaaaattgtggacagaaatgaaataaaaaacatacaggaaccaaagctgtggttatctaagggcttagctatatagctaccactttatttgcaactgtacatatttttagctaaaacatgttataaggcttttccgaagttcaaacaaaagagaagccaataggtagccaaacaacatatggacatatggaatttacacttggatccaaaattgaaggtaaaaattaatgtacaagcctaatgtgagtatcaactcccttgatccgaaagattgtgagagagtacttcaaccaccataagacaccataagagttcaaccaccataaaacaccataagaggacataggaaccaagggtggcagacaagctcatgtctttaaagtagagtactagcaaatgacaaccacattgatcataaatagccgccatagccaatataatgcaattaatgacatttctattttggaaaaaaaaagcagggcacagacagcacttcacatgcgcatcgtcgatacatcgaattgtccggatcaaactgatcgggtacgagtacggccataaaggctcgcagtgccagcgagatggacgagcaccgctgccacccagcaccttgcgtcacccccccgggggagagcattggggaaaccgagtggagaaagagatctcgcggaacccggcacgaatctggcagggggtccgagagctgattcggttttaccttgtagacgaggcggtcgaggaagaagcgggcgcagaagaagccgacggagaagacgagcgtgagggggaagaaagacgacgcctccgggccccggatcgccatcgccgacaacccaacagagccccctcgccgtccgcaccaccacggcgaactcccgcggcagggcgccccccctctcgcgcgcgcgcgcaccgataatgtgaagggttcggcggttggggagggggagcgggaggaggcccangcggcacgcgctgctcctgtttcccttcctatttctacctctcgcgcagggcgaggcgaggcgaggcgagacgagacggggtttggctttggtttggacacgatggaggaggaggagatcgagccgagggagagggagagagatggaggtggttggggtgcgtgctactgttcctctcctctctctcccttgtgtttgtggacgcgtgtggaatatgtga

SEQ ID NO: 58055 - DNA, 3537 bp, Oryza sativa
gcatcctacctcggcacaccaaaagcgtgatgtctcctgtaggttgcttaattggagagaaaaaaataaaatcaatgaatttgccaactgtcatccgacagaaagaataaaatactttaactgagcttagtttatccaatctttcttgtatttgagtaatcttacaaagcttaaagcatgttcagatactgcttcaaacatagaaattgaattgattcatgtaaaattactacgttggaacttggaagcgactgacttagccaaattgagttaggccctatttattttgggagcatatcaggtggaaaccagggagcctgtgcaaccttggaaactctcaatcacatccacaggatgagcatccgatggctagggatagaggtgggctaaatttgcaaataaccgcccgccagcccctctgtctgttttgcaaaacaccccctgcgccatccgcctcccatcacttttacacccgagcccctacgccagtatcgtctccccacgactcgcgatccagccaccgcctctgatccgctgcgccgtctcagatccagccgcgccgtctcatgagtcccgcattgggcttcgccagccacgcagtggtggtcggaggtggccttgctggcggccgccagggagatgtcctcgacggtggtggtccggttcaggatgtcctcgacagtggcacctctgtccagttctgtagggcacgaattggagccacgggcagcagcgtggcgcatcatcggcagcaacgcttcaccggcacctgcgcatcaccggcaaaaaatgagaaggggcttcactgccagcaattactaggactccatcagcagtgagaggcagcatgacaacttcctacaggtcaggctcgatgtgtggcaggatgagtacctcaaggttcatggtcagtggtttgctattgtcacacatgtgcagcaggcacccaagggcagtcctgccactgcttcagtcagtaccggatcagaaactgagtaatggcaattgtgcctgaacaaaaggcgtcctcgtctgggactgtaatgcctgaacaaaaggctctgcaatggcaattgtgcctcctgtgtaatgaacttgtgtgtggagcattgtgtgtaaaatttattgaaaaattgtatctcagttgtttgtaccagaagactcatatcattgaaaattcatgctaattttttagtgattcagcaatggtgcctcctatgtaatgaacttgtgtgttttaatgattcaacaattgtgtgtgaaattgaaacactgaaacattgaaaaattgtatctcagttgcttctactagaatttttacaaggtgtttacaatcactaaaatactgaaacattcatgctgttttttccgagcactgatcagcactgaaactgagaaacattgaaaaacgtctcgctggcgtcgcgggcgaggactccatgccgactcgctagcgtgcggctgtgacttgagggccaggtcggcggcgactcgcgtaccacggcggcagccactcacgggtgacacgcggacgatggcggcagcgactcacgggcaactcgtggacgggacgggagaaacgaacaggcggcgtgcgcgctggggattagggggagggggtgatttgaaaaaagcaagattagtatggctaatggtgggcgcttaagtgcaaaattagcctacctctatccctacccatcagatggtgattatgtggtcttgattgagagtttgcaagtttgcacaccttccctggttttcacatgatacgttcccatttattttagcttaagattattataatctagattattgagctagattactgtaaactgaattataataagccgacataaaataaattgttagctgtttgtttatctggattattagctgtttgctagttgttatccacccaataattaaaaaaagcacatttaggccctctttttttaggcttataagccaacttataagtcgaaaagtctaagccaaaacaaacaagcagccttttcatttggcttttttgaagctataagccactctaacactattaagccaaaagctagattggagaagcttttttggcttatatgagatagatatatgactccaccactaaacttaggacattaaatccactggcttataaatcatataagccaataagctgacttaaaagtctaggccaataagcctaagcctaaacaaagagtgccttagagtggattaccatattatagtaatctggctttatagattgtaataatctatcgtaataagctatttgtttatttcagcttactcctaataatccagattataataatcttaagctgaatcaaacagagctatactcccaagtttcattatactgaacatgtttagacactgctacaaacatataaattgaatgaactggttatgtaaaattattttgcattccaagcaattttccgtcgcaaattgagttaatactctcattttgtaatattcattaatatagggcaccttcattacgttcattaggccgtgttcgacaccccttgttaccacccctctccctcgttttccacgcgcacactttttaaactgctaaacggtgcattttttttgcaaaaaaaaagtttctatacgaaagttgcttaaaaaatcaaattaatccatgttttgaaaaatagctaatacttaattaatcatgcactaatggatcgcttcattttccgtgcatactgtttcgattgggaagaaaggatgccgaacacagccttagtgtggttttggaactggcaccaagtctataaagggttgtatcattgttggtttttatatgagccaacactcatgtttgccatttgtgttgccttttatgtttaactagtaatgttgtgactgtctagtatatataataaaggaaaaagtacgaattactccccgaactatcgcggtcatccgaattacccccatgaaccataaaaccagatattctccacccccaactatgcaaaccggacgaattacccccccgacccaatccacggtggtttggtctatgtggcgtcaaaaagtaagaattaccccccccccgaactatcgcggtcatccaaattacccccatgaaccataaaaccagatattctccaaccccaactatacaaaccggacgaattacccccctccccgacccaatccgcggtggtttggtctatgtggcgtacatgtggcatcccagtcagcattttttaatacacaaaaatggtgggacccacctgtcatactctcccacctctctctcttccccactttcctctcaatctctctctctctcttcccctcttcctctcaatctctctctgtctcagatgtggccggtgctaggcgcggcggggcacggcaggcgtggtggagaggcgggcgacgtttggcggccggcggccggaaatccactgcgagcggcgggcgccgtcgccctcgcgcaccaccgggagcagctctagctccacgcgcaccacgggcaccacggacacggcggggtgc

SEQ ID NO: 58056 - DNA, 748 bp, Oryza sativa
cccgtgagagcatcaaatcttcgcccgttcaaacagtatacaccctagctctacatttcaatacatagccaagcaaaaattcttgtacatagaacgcagtattttgtttttcttgttttgtttttgttttcaggtgggcagggtggcttccagattgccatgcagttccagctgcgattggtccggaggcaaaatcaaacaggtgacacattgttggctgcgtgcatgcatgtacacgcgctggattcagcctgcctgaataacacgcatatccaactcttatccatatattgtattatgcttgcgtgcatataccattcgaccaaaaaaatattatacacgaatttatataatagagactatatatctaaaagttcacaaatggtattcaataagtttgtgctttatttgtttctattggtgttagtgccggcgtgcgtatctgccggttcggaacttttcttatatattgttttagtgcctgttcgctctgacgaaaaaaaattatcaaaactttagcatagttgccaaaattttagtaaaatttcttatagttaccacaatttgatagtaaactaaatgtagctacttttttaacaactttaccaaaatttggtaaggttgaaaatgacatcaaagtgaacaggcccttaagctatgattgtgtttggatttttttttaataattggctgtagcctatgagcaaaggctggattctattccgttataaaaaagggctgcaggaat

SEQ ID NO: 58057 - DNA, 1626 bp, Oryza sativa
tggaaaagttgaaaatttaaagaaaaagttgagaactaaaccagaccttggttgaaccggactgaaccaagcaatctctcctcaatctcctccaagacccctaatgtgttggctacaagtacatttgcaacttttccaaaattttaatttttcctcaaatttttaaactgcacgttgtgcaacattctagctatcatcaccctaagtgcattgccatttgctaccatacatcatactctttcggtcgtaaaataaatatacctattacaggatgtgacatattctagtatcgtgaatttggacagtgtacgagatgcaaacattttggagtttgaaaatgtgaaaaatcattatattagtcttttcggtgatatgcgtgagataagtaaaaattgatatctttcagatgaagatagtagctgagatgacacatgagtcttcaagtctgcgttcgacggtccctctttctatcttccactcattcatttttttaagtacgcttttcgaagtactatattatatttttaataattttttattaaaaaattactttaaaaataaaattaatttattatttacaatatttacgactaattaatcatgtatctttactcccccgtcttataaaaaataaatctagtaggaggtgtgacacatcttgatactacaaatctttatagaagtctattcaggccttgtttaggtccaaagtttttttttccaaacttacaactttccatcacatcaaacctttcgtatacacataacttttcagtcacatcgtctccaatttcaaccaaatttcaaactttgggccgaactaaacatagcctcagattcatagcgatagaatgtgtcgtatcccgagctagttttgttcgaacatacagcctcatcttttcgcatatgttttgcttaccagccaaaatttgaattttcgaccttacatttggagtggattttgggttttttttatccgagtttattttcagcctatactcggtagaacacgtatataaaagttttattcaccgattaattttcgttggcaaactgaataaaacaaacaatgggcatagtctcaggactcaggagtggtcctggactcgtggtacgagtagtataaatgtgcctgtgaagcctgtagtacactagtacctctgtactagaccattaccccctcctttaattctctcgaactacgactagcttcgagctttcatcactcgtcagcttgagcgcccagcagctatcgtcagcttaaaattagcgccccagcttagcttctgagctgactcgagcttgaagacagattttggtcgcatttcagctaacacaaagcttaacacacgagctcttgtcagctgatcgatccggggttgaagagatattggttggtttctgtgagcttgaaagaaatcacttgctgttccaagcaatctcgttttctttattgtaatccaggatgactgatttttcctttttcagcagaaaaagaagaagaagaagaagaatcaagcttggtgcacggcgtcgccgccatggcggcattgcgcgtgggcacgagggcggtggaagggaggttccaagcgagcaacggcggcggcggcggtggcggcggcgccg

SEQ ID NO: 58058 - DNA, 3170 bp, Oryza sativa
ctcctcctccaccattatgccacctctcctcctccccaccaccaccaccacgacgccggactcgccactcgcagcagcgacgccgccgtccaccggcgagccaggacggcgtcgtcgatggcgccgtcgaccggcaagccggcggtgacgacggattccgttatcaaccttgaccagtgagttcctcctcctcctttccctcctcttttattcctttcttagctgttctacccatcaaggcatcaatcaactagaaaaagaaaagaaaaggagaagcaaagaaaaaaaatctgcaagttgccatgggtggatgtgtgggcgcgcgcgaggtgttcgtcccaataaagcatgtcattgtcaaggaggaatgaaccaacgaacgccgatctatggcggattttctccagatttacgcgcgattgattcgatgcatgcaccttgttcaaatttcgtctctaaactcgattgaatatcaaatatagatagaaaatggagttctgacattcttgggtgctgcgcagcggcgacccgaccatgttcgaggagttctggagggagaccggcgacgcggcggaggtcgtcatcccggggtggcagacgatgagctacttctccgacgtgaccaacgtctgctggttcctcgagccggagctcgaccgccaggtgcgccgcctccaccgagtcgtcggcaacgccgccgtcgacggctaccacgtcctcgtcggcaccggctccacccagctcttcatggccgcgctctacgccctcgcccccgacgccgccgccgctgccgccggcgagcccatcagcgtcgtctccactgcgccctactactcggtaattaagcgcataaagtattactccctccgtccaaaaatataaaaacccagtaccggtattattaactacgaatctatacagaaaatagacatattgcttagtatcttgaggtaccggtacctaacgatacaaaatcgttttttatcgttggatataataatgtctatcctgtccagttagatctatcaatcagaaacgatttagtaacctgagttaccagtactttaagatactttttatttgattagaacaaatctttaggagtatgaccagactcgtagtactataaaatgtctgatccgttattaggtttatatgttttgggacggagggagtatacaatactaagggtgtgtttgagaaggagaggattgaggagattaggaagatacgcaaaacgaggtgagccattagcacatgattaattgagtattaattattttaaacttcaaaaatggattaatatgacttttaaagcaactttcctataaatttttttgtaaaaaacacaccgtttaatagttccgggaaggacaaaactatctttctctctttgtcctgcgcggtaacgcagcttaattcaaccagacagcaacaaacagaggtgacagatgagatgcatcgttgtcgagtgtatcaaaatttttgcatcaaactgcatgaaaaagaaaaatgtttttggcgacaaggatatatagcaaaagcggatttgcctaatgtcacaatcatatcattccccactaaaatgatgtgatagagctgaaattaagagagtggggcagcacattgatgctgccccctaattccccctaattctttgcattggtcacctctctctctctctccatctttatcatatgatggttggtgatgattgatgaagcatatgatgtgtcgctaaatgctactagtaaacatctctgaataatctcatagtatcaagcttgggggatcgaatcaaatcatgtttctttgtagggtcggaagctttgatcatagatggtttgctgcgatttgtagggtagccgacatgtttctttaacaaagggcctgttaattaggcttaaccaagtctgaatcttacttctgcttatttagtaccataaaaaatatactgaagctctgcatgtgcagatgtgctgatcactgatgagaatatctgatcataaggtcacacatggccggccggcacgccgccttatgcgatttctgtttgttcaaatcttgttttagtttatattttttgtggtttggttgatcgatctgtagttgattaacctgagaaaacatagaagtagcgtgtcatgaactcatgattccattgtcatgtgccccgcgacatatctagtgatagatcatgtgtgttcagttatggccctcatgggaggtcggtgtgctaacttcttagtttattattcccttttgcattatagttccaaatatatttttttaactgtaccaatgattggtagaaaagaaaaaaaaaacagagcacactctgactttcttcttttgattttctgaagaatttcactctctgacagtgattaagttcagtttcagtttcactgacctgatccgatctgatcttggatgcagtcataccccgccgtgacggacttcctccggtcggggctcttccggtgggccggcgacgccgacgccttcaaaggcgactcctacattgagctggtctgctccccgaacaatcctgacggcgccatccgtgaagctgttcttgatccaaagaccggcaatggcaggacggtccatgacctggcctactactggcctcagtacacccccatcaccaagcgtgcttcccatgacatcatgctcttcaccgtctccaagagcaccggccatgccgggaccaggatcgggtatgtagatagagcttttcggtcgaactggttggtgcatgaaacacggtcgttttgagtagtgtaaactgagttgaatgtttttgtgtgtgtgtgaaggtgggcgttggtgaaggaccgggcgatcgcgaggaagatgacgaagtttgtggagctgaacacgatcggggtgtccaaggactcgcagatgcgggcggcaaggtgctcgccgccgtctccgacggctacgagcggcggccggagcagacgaaagagacgatgaccactcctcttcgcctgttcgactttggtcgacgcaagatggtggagcggtggagcatgctccgcgctgctgccgccgcctccggcatcttcagcctcccggaggagacctccggcttctgcaacttcaccaaggagaccgccgcgaccaaccctggtatgatttgatggataagatttttattc

SEQ ID NO: 58059 - DNA, 5585 bp, Oryza sativa
gtgcgctagcaagcaaagcatgcccatgactcatgagagcatgagtagaaccgttaactgtgtatctgtatcagtatttggagagcctttttggtagagcttcagagcataaccaaacggtttcagctttactcgaaatgggagtgaggttgattgaagtgctatcacagaatgatctagagatgtagagttggatttagactattttacagctacactttagaaccaactcttgaagttaaatttgtaagttgaagtcctgccaaataggttctcagtagtagtagtaggtagaagaagaggagcttgcttttctctagcttttctttttctcttaaatatttgtttctcgatgttgtgttttatggttaagaatggcctgcaatgtagatcagtgcctgcgtgatttcacatacggaaaataaataaataaatgttcttgttcttccttttttggaagatctaatgtttcaacgagtacttcctttgtccaaaaaaagacaaaccctgagttttcatgtccaacgtttgaccgtccgtcttatttgaaaaaaatatgaaaaaaaaataaaaagacaagtcacgcataaagtattaatcatgttttatcatctaacaacaatgaaaatactaattataaaaaaatttcatataagacgacagtcaaacgttggatacgaaaacccagggtatgtctttttttggacggagggagtagttgttttctctgttagatggaaataaattgcgttgatgggtgtaaataaatataacaatttgcaaatcgctaattcatatacaacttgtcgagtccatgcgaacttgggccaaaatgatgaacacaagcaaaattgatctaacatgagtgcactgatatgtaatattattacacaacaaattttagcctggcaaaatgtgtatttttaagttttatatatgacaaaaatgcaaaacgatcaaaaagcccaaccttgaaaataaacttttgatgaaaatggagtatttgaacatgaaaattaaaatgaactatttcaggagttgagttacttgtacaaaggtatgacaaaaaaattgtcttagtgctgatcataaaatgaacattggacattgttttttccaagacataaaatgaatctcctttgtcctgaacatgaaaaatgaacttttgtacaactgatttgtctttttttagattccaaataagatattcaaacattgtcattacgataaaactgccagataagattctcgaaacatggttcgtaagataaaaactgccacatcatcagggtaggccatgtcagaccaattttgcttatgtggattattttgtcatgggttcgtgcggactaaccaattaatttttaccgaaatgaataatttgtaagttgctatacctatttacatcaatcacgtaagttcacgtccagtcttcgatatctttcagtagcacatgaaggaaaatggaaaaaaagaagatgagtgactcgaactcgaagagaaaataaagcccagttttgctagaggccacctcaagagatttggcccatagcctgcggcaaccctaggctctctgaggaataagatcactttgactccctcaactgaccaccgaatctaaatcgtatccctcaactgcaataccagaaatcttgaccccttgaacttgcaaaaccggtgcaatttaacttccttggtggttttggatggtggtttcgctgacgtggcgcacacgtggcagtgttgacctggtttttgttccacgtggcattgacgtggcgcttacgtgcattaaaataaaaaaaatatgtgggcccatttatcattcacacaaaaaaaaattgtgggacccactgacatgtgggtcccacatgtcatcttctctctcactacccttcttcctcctctctcccttatttctctctctctctccccttgacatgagccggcggcaggggctcggtggcggcatcggcgagtgggtgtcggagtggtggctgcgatgggcggtggacctcgggcgacaagcacgggagcagctcctccttgaaatgggcggtggacctcgggcgacgtgcaacgaaatgcgtcgggggagatgggagcacgctcccagctgccgctcctcgtccccactctgtgtcgtgggcagtgaggtgggcggcggccgcagcgtcgacggcaaggtgggcggtgcccgcggtggaaagggagcaatagcttgcgcgccccaacgcgcggcggcggactggccgagcgctccgcgtcgaccaggccatgatgcggagcagcgactggagctcctcctcctcctccgacacgggccccctccccgaccacgtccgccgcgagaccgcccccttttcctcttggacttgccgccggccgcgctcgcggcgacctcgcatagactcgggaagttggctgcaggatcaggaggctcggtggccgccggggcggtaacgttctcgcctgggcgccaccatccctatctccccgtggcactagcaccgctccagtcccggacccgctgaagccaaatccttgctactgcggcggcggcggcggaggggacgcgaagaccatcggctgctgctgcatggcaaagcgcggccctagcctcgccgccatcatcccccgcggcgagcgcaccaccgatgccacgaacgcctcggcctccacgaatgccacgccgccgccggcctccacgacgatggacagcgacccctcctcctcctcctcctcctcctccggcgagtagaccagcgcaccggcgaagcggtagaacgccgggagcaacgcctcgagggagtccctgagtgcgtggacaacgtctccgaatggtggtgggggcggacgagcaggagcgcgacccagtacgcgtcgaatggggagagcagcacgcggcagcagccgccgccatctccatgcgtcgggagcgcgacggaggtgacgctcctcgtgcacaccgacggcggcggctgcggcatctcagcgacggcgaactcctccgccgtgttccgaatctcgccaaagcttgtggggtggtttgacccccactatacgccgtcgccgcattgtccgccgtcgccgctccgtccatcgcccgccgtcaccgccgccgttccggacgccgctctcgcatgaagagaaagagggacagatagagaagggaggagagggaggaggaagaagggataagggatgatgatacgtgggaccaataggtcccacgattttttttttgtgaatgacaaatgggcccgcatatatttttttatgttaattccacatcagcgctacgtcaatgccacgtggtacaaagactagttcaacactgccacgtgtgcgctacgtcagcgaaaccaccctccaaaaccaccgagagagtcaaattgcaccggttttgtaagttcgggggtcaagatttctggtattgcggttgagggatacgatttagattcggcggtcagttgagggagtcaaagtgatcttattccgctctctgatgcgtccgaagagaggcccacctgagttgggcctagtgggcttagttgcttgcgagacttagaagtgggccctaaaaggccacgcggaattgaacgctacagaaaccaattccggccacgttctcttcttctccccgcagcccacagtgtccgcgagagagagagagagagagagagagagagtagactagagacgcctccgcctccgcctccggccaccgcatcgccatggcctcctcctcctccgccgccgcggcggcggcgggggcgggggcgggggcggtggcgttggggcgactcgtcgaccgcacccgcgtccccgaccccaccctgcagcggcacgccgtcgcggccctcttccgccacctcctcacctccgtgcccccgccactcccctccgcggcgcacgacgcgctctcctcgctcctcgcgtcgccgcacccggccgtcgcggcgcacgccgcggcgtccgtcgcccgactcgccgcatcccgcgccgacctcctctccccggagctcgccctcccgctcctcatcgcgcccctctccgcctccccgtccccgcgcctcgcctcctgcttcgtcaaggccgtcgccgcgctcgtctcctgcgcgcttcgctccggctccgccgcgtcgcgcttcccgccccacgatcacccgttcgtccaggcgctcgcctcgggggccgatggcgcgcgcgcggagctgcagcggcaggcggccaggttggtcgccgagggggtacacggggttgtagggtttttgaggccattcgttatgtttgctgcggtgaggaagggggacactgcgttcgtgaaggatttgattggcgcactggccgcagcggctgttgcagcggcaaggccggattctgcagtcccggtgctgaaattgcttgcggagtgcttgctgcattttggccgtggggatggtgaggtatgttgtccttgtctgatgtctcagtgcttatgcttaaacagtcctgaactcctggatgttttagtattgtttaatatgagattagtagatagatcatattgtaggaatgttgctgcatcctgtagtgcctaaattgaatttgtgtgtgtttgttagagtattactttactttgttgtcaaagggatcaacagagtttgagcttatttgtgcttacttttcttcaggaagtgcggctctggcttagctccgtggagtgcttggtggatgcttatgtggtattattgaggaagtttgctcatgctcaaatggtacctctctctcccatttgcttgatttctcgaacggaattcttcctggtttatcccatttgcttgatttctcgaacggaattcttcctggtttattgatattctaagatttactcacattggttatttcattatgaattagagtatcgattaatccatgtacttgtccgtgtttcctgaattagcaacaaacattatatctgtgctcttaatagagctttcatctgctaggatttaggagttatgtaatagattaggaactaattttttggacatgattttttactcagtaattcttaccttgcaaagtttatcaccctccaaaaacacaagttattggggattatgtagttgccttatgtacccacccattttgccaggttttgtttgtggatgttatactgcctatatactgatcactattttttatactggagattgtacttgttctatattggcaatacggctagaaggatctgggcgcattggatgcttactttgttatatttacttgatttcaaatgctattatagtatgagtcatagatatgctataacttgcttcttttaacacttaacaggcaacttatgatgcccaagcaaatagtgtggagttgatagaaatgcttctatcacaatgctcacttcatcaccaatttatgggaaatacttctgttgtacttggattatcaaaacatttgtttttggctcaaaaggaccttggtttatgctatcttccagagatttctgttgttctcagctcccttgctttcattctcagtgggctggagtttgaacatgagcaactgtctggattgaaactact

SEQ ID NO: 58060 - DNA, 5320 bp, Oryza sativa
ttagttcctggaaaaatagttagaagtttgaaaaaagttgaaagtttgggaaaaaaattgaaaacttatgtgtgtaaaaaagttttggatgtgatgtgatgtgataaaaagttgaaagtttaaggcagttaggttgaactaaggccccatttgaatcaaagaaaaaaccataggaattctagagaattttatcctatgggaaataattctatagagtcatttgaaaaaaggattgtttcctatcaatttctttgaaattcctatggaatgaaccttactagagcaattttggaggaaaataagcatgaggtcttacctcatgttatcctcttcatgtgtctgaggttcctgtgtttttcctgtgcgctaattaaacgacagtttgaagactttcctgtgttttaaaatcccatacgaatccaataagtgtgatatttaatttctatgttttttctattactcttttttctcaatcctgcgtggtctatgttgcattgacaaaccgcgttctcgcgtcgggccacgagccggccacgtactcctaccgagtacgcgtaccgaccgccacgctatgggccccacactttatccagtctgcaaccgtgtcatgcatgtttatatatgggatttatagtctgttgattgttttacagagaaattggattaatcggcgatcagcagcgctctcgtacgatctttgactggggcaccggggataacgacggttttaaattatctgcaccgtatccggccgggtcggcgtcaagtggtcggtgtgcattatcaagtgctatcttgccgcggtgttttggtgtcagtattcagcaaggtttacgttagcgtatatacctgacaattaacctgattgatctcctggagcaagcagcgcaggatagatggccacgtaagacaggcgccgttgaaaagttcctccatcttccactgttggtttcagttgggcttcttcggctgtgtttagttgttgaaaaaagttaaaagtttgggaaaagttagaagtttgaaaaaaaagttgaaagtttatgtgtgtaggaaagttttagatgtgatggaaagttgaaagtttagggtagttaggggtgaactaaacacggccttcgtttcccaactgccaataaccaactcaggttagagcaagtatagccaactactaactccaaattatttatagtcaatctaatagcttattcatatagtagttacatataaacatttagtactccctccgtccctaaatatttagcgccgttgacttttttaaatatgtttgatcattcatcttattaaaaaaattaagtaattattaattgttttcatataatttgattcattgttaaatatactactactcaagtttttaataatatttataaaagtttttgaataaggcgaagatcaaacacgtttaaaaaagtcaacgacgggatggagagagtacatcatataatatatggtttcatctcttataggcatataacgtattgaaatccgtactgtagctggttatgggccctactgtagctgactatgggcctgttcggctacatgtgctatggctgcggcctgcggcgcagccagcaccaacagtgctgcacacacatggtgcagccgcaaccagcttgccgagcaagccctataaatatgtagcctaattttcttttctctcttcccttctctgattcacatatgcttacaattgatttgtactcgttattaaaaaactaaaaaaaaaagaaaaaaaaatctcggtggtgggcccacgtggcccacgggctggggttccagaatcgtggaggacgaggagggctcttctggaaatccctggacagctttgctgccgcggccggtggagttggtcgctcctgcccaaaaccaggaggattaggaggggtttacaggttaatttaatcgattcacacgcgattagaggatgggttaccgaggcacgccgactattgtggagccacaccgcgcgccctcgcgccgccacgtgctcctcccgggttgacgtggcacaagaggctcgtccgagtaggcacctcccaaaattttggtatgatcagtacagtttgaagtttgacttggccagtttagtcaattctagtatcctcttacggcaaaatactaggaaaccagacaattttctgaacgaccgtttgcaatttacagcaatccaacgacgacaggagagaaggcgatctgatgttttcgcaggggaaattatcaggaatattaattaccatgataagtacaatatgatcatgatagtgtccactgtagaatccatcggcgacactacaaaatctctgtcattaattacgagaatgctacggtatcgtcggctagtaatttgctgaaaacaatccattgatgcatgtataatcaccaaatggaaatggacccctggattactgatgctgtactttttcgtcagggaaagaaggaatctgatctgaagaagataattagcggataaaactttacttgcaggattaactcatgaaaggacgcgaattttactgtgtaattataaaaaaaaaattaccaccggaaggttcgccatagcccatacagcatcgaaaaggaaacggaaagatacaggggcattccatggctatcaaaggacagtaagagaaataaactgacaaaaaatataatttaatttataaaaggaatgagttgttgtggctcccacacaaaaacctctataaattgggcgcaaattagcctcccatctcttcagcaaagccccaggcttagcaaaacacaagcaaaccaaagcttccatctcttcttccagttcaaagatctccaagcctccaggaaactcaaggccagcctcgccatggcgcccaacctcagcaaggccaaggacgacctgatcggcgacgtggtcgccgtcgacgggctgatcaagccgccgcggttcacgctcaagggcaaggacctcgccgtggacggccacccgttcctcctcgacgtgccggccaacatccgcctcaccccggcgtccaccctcgtgcccaactccgacgtccccgccgccgccgccggcagcttcctcggcttcgacgcgccggcggccaaggaccgccacgtggtgcccatcggtaagctccgcgacacgaggttcatgagcatcttccgtttcaaggtgtggtggacgacccactgggtgggtacaaacggcagggacgtggagaacgagacccagatgatgatcctagaccagtcggggacgaagtcctcgccgaccggccctcggccctacgtcctcctcctcccgatcgtcgaggggcccttccgggcctgcctcgagtccgggaaggcggaggactacgtgcacatggtcctcgagagcgggtcgtccacagtcaggggctccgtgttccggagcgctgtgtacctgcacgcgggggacgacccgtttgacctggtcaaggacgccatgagggtggtccgtgcccacctcggcacgttccgcctcatggaggagaagacgccgccgccgatcgtcgacaagttcgggtggtgcacgtgggacgcgttctacctcaaggtgcacccggagggggtgtgggagggcgtgcggcggctcgccgacggcgggtgcccgccggggctggtgctgatcgacgacggctggcagtcgatctgccacgacgacgacgacctgggcagcggcgccgaggggatgaaccgcacgtcggccggcgagcagatgccgtgcaggctgatcaagttccaggagaactacaagttcagggagtacaagggcggcatgggcggcttcgtgagggagatgaaggcggcgttcccgacggtggagcaggtgtacgtgtggcacgcgctgtgcgggtactggggcggcctccgccccggcgcgccgggcttgccgccggcgaaggtcgtcgcgccgaggctctcgccgggcttgcagcgcaccatggaggacctcgccgtcgacaagatcgtcaacaacggcgtcgggctcgtcgacccgcgccgcgcgcgggagctctacgaggggctccactcccacctccaggcctccggcatcgacggtgtcaaggtcgacgtcatccatgtaagtctcccaactacttttgtgcactccgtttactactagatcgtgtagaggagctcaaagcggcggtgcacgtggcgaggcagagcaaagcttgttcgtgttctcgaggtttcctgattaaccggatgaaacgggaagctgctagtttgtgatattcttgttctacctaagatggattttgttagtaaaatttggtcttgattgtattaagtaatatgcataatagtcatcacatgattgatatctcgtcactgctcgtaacttcagccttttagcatgtcaggtaaagatcgctttttatgcctgaaattgcatcatttttcagtcttcgattcctgaaaatgattggattgcaaatttagtacggtcatgaattcttatttcagctattaaaatctgcacgtcaattcattaggtagcccttttctactgtcgatagtcagcgacctgaagagcagggaaatccacatacatttgacatctcgacaccacgttttccatctcgcagcaccacacatcaatccacttggaaccagaaaaaaacattttttttcgtcattatttattttattgatctttaattagtacatgaaagacacgtagattttgacagaattggacgggaggggaacagtaagaaacatcaattaaggtggttaggaattaatcattaggcacgacaaagcggaacgattacgatcaattaattatttagtttaaaaatcttaaaaataattaggctgtgtttagttcagcgcaaagtttggattttggttaaaatcaaagataatgcgactgaaagattttggttaaaatcggagataatgcgactgaaagattgtgtgttgttgcagctgctggagatggtgtgcgaggagtacggcggtcgggtggagctcgcgaaggcctacttcgctgggctgacggagtcggtgcggcgccacttcaacggcaacggcgtgatcgcgagcatggagcactgcaacgacttcatgctgctgggcacggaggcggtggcgctgggccgcgtcggcgacgacttctggtgcaccgacccctccggcgaccccgacggcaccttctggctgcagggctgccacatggtgcactgcgcctacaactctctgtggatgggcgccttcatccacccggactgggacatgttccagtccacccacccctgcgccgccttccacgccgcctcccgcgccg

SEQ ID NO: 58061 - DNA, 3570 bp, Oryza sativa
tcgagctcacgctcgagccgttcacctacgagctcctcgtggtggcgcccgtgcgggccatcgtctcgccggagctggggatcggcttcgcgcccatcgggctcgccaacatgctgaacgccggcggcgccgtgcagggcttcgaggcggcgaggaaggacggcgacgtggcggcggaggtggcggtgaagggcgccggggagatggtggcgtactcgtcggcgaggcctaggctgtgcaaggtgaacggccaggatgcggagttcaagtacgaggacggcatcgtcaccgtcgatgtgccgtggaccgggtcgtcgaagaagctgtcgcgtgtcgagtacttttactagtgtggttcaatgctggaaagagactaagacaaaattttcggtctttttattttttattttacttaggtcggaaaataatttgagtgtgtgagagctttgtaagttgcttagctctggttggtttcggttggattatcattgttacgggttttaaacgctggttaatgtgaattaatgcaactatgcaagtgttactttatcaatctcctcgtttgcgcggatgggcttgttttgctttctctgaattcatattgtctttggctttttgcactatacagactacagaacctttgcaaaattgtttcccccttgaaattagaaaaaaaaatggttcgatacaagtcctgtttggtctgtggtcaaatgcaatctttaccaaagcttttgcattggcaagatataggtgttgccaacattttggtgaagttgagtatttggtttgttgctatctttttgaattgttggtgctttacttggttctggttgccaaaatttttgcaatgccaattttttcgagaataaaccaaatggaaacatgaagtatcattcaccaaagaattccacaatagtgttgtagtaattcgaaacttcatcccctttacgtgttaaaacaagcaagaaaaatctctcccggataataggggaaatgagaagcttcttacgatgaaacatgctgctcattcacattcagacttgatatagatacttgtatttatctatttattttttttggtgggcttcatcgatcgtctatttattttttgtggtgggcttcatcgataacgtctacagtgattttgttaatattaagatttgtaaacacccgcgccgtgtgtctaaaaataaaggaataagttcacttcgtgaccctcaaaagtgatcgaaatctaatccgtgaccctaaaccacaaaaccggatatctcgacccccaactcttaaaaccagtgcaatttaactccctcggcggttttggagggtggtttcgctgacgtggcgcctacgtgacattattgactcggtcttctgtccacgtggcgttgacgtggcacttacgtgtcattagaaataaaaaatatgggtgggacccactgacatgtggggcccacataaatcatatcatccccctctctttctcttcgcgagcgttggacgggagccagcggcagtggctaacgcctcctccaaccccatccacagcctcctccccccttcccgcggcggcggtgcggcggcccgcaagcggtggagacccgggagtggcactggagcggcgacagcgacgtgcgcgcaaaggccagagcggcagcggtggcggagatcgaggccgccgtggaaggttggccgtcggaaggaagaaaacaggccacgagaacgaccgcgttctcgccatcctcggcaccgccaccgcactatccaccgctgcgctccacgccctctctgccggccacgatgcacctgcctccgcagttctcccgctgcgcccacgaacacgtaagggccacctgcatctcgccaccgcgactcacgtcggcatcctctcgaagatggcggcatccggcggtggcttcttctgcacctacggcggcggcgttgaaggagggaggagcagcacgggcggggaaggcggtggtaccaccgatgggcgtggttagcatgccgagccagccgacaacggcatgaccacataggagttaggaggcatctgcgtcaagcattctcctgctggttgccgagacaatcggcaaggggcgagatatgagggctacggctagcaagcggtagcaacaagcagtgcatgtgtgtactaacatcaagcgacaagccaacaagcaaagggatgaccgaccgagcaaagctgcagataggcaagcagagcagcagattcgcttggacgatggcgcggccatggaggagggggacgcgagggacgggagcctcgcgcgagcctccagtgctccccaccgccggccctcgagcgctcccctccaccggcgctccagctcccatccctgcagatgtgcgaagggaagggaagagagagaagggagagaaagggaggaggatgaagaggagagaggataatatgtgggccccacatgtcagtgggtcccacccgtacttttggtgaatgacaaataggtcccacccatattttttatttctaatgacacgtaagtgccacgtcaacgctacctggacagaagaccgagtcaatactgccacgtagcgcgccacgtcagcgaaaccgccctccaaacccgccgagggagtcaaattgtaccggttttaagagttagggggtcgagatatccggttttgtggtttagggtcacggattagatttcgatcacttttgagaatcacgaaatgaacttattccaaataaaaataaattcaggtataggatgggccttgaattgagcccgctaattccgggcccatcaaggcccactcagatcaggcccaattaagaggaggcaggcaaacccaaccgactcgcactcgtcgtcgtcgtccccatctggatccctccctcttctcctccaacctcgccatcatttcccagctcgcttcccttcccaagctccaccaaccaaccgccgccccacctcgccgcccgccgccgaggcggagctgcgccgatgaacacgtcgcagttcatggacaagcagatcctcggcctcgcggcctccgcctccacctcctccggcgtcggcgtcggtggcgggggaccggagctcctcgatctgatgagccccaacccgcaggaggagggcgaggaccgcctccgccgccgccacagctcctccaacggcagcgccgacgacgtgctgcccagctacgacttccagcccatccgcaccaccgccccctccgccgccgcctccgcctccgccgcgccggcctcgtgggggtccctcgactccggctccaaggccgcctccgcgtcctacaacttgaaggtatacttaattattgtttcgatcgtggtatggtctccccaccgctagatctgtcgatctatctgcgtttcatgattttgcatcagtaaatctatcgcgaaaacctttttcgtgtagatgagcatctacaactcaaccctacattagtaagaagaagaattttgtttgcgaactgggcttgtgcaccgtgctgagacgcataatcacttggtaataataagctacaagagaattttgtcgatggggctgcaggaat

SEQ ID NO: 58062 - DNA, 1166 bp, Oryza sativa
tgaggatgatggcattgcctacacattgcaccagagagttcttgagcttgaggatgagctcaacaccgtgaaccagaaactgcacgacgcaaatgaaaaacttgaggttctggaagagaagagcttgaggtgccattgtgattctaaagaaaatggaaacggtgctgatcaaagtgcaataaatgagaagctacagtcttcacaagaggagattaacaatatcaaaaacagccttgaagttttgtcggaagagcactctaggctgttgggacagaacaagaaactggaggctgaaattgtcaatctgaaggaagaaattgcttcagatagacagcaatatgaagagaagctctctcgtagtgatgctgaaattgacaagtgcaggcaagaacttgctgatgcttctgagaagttgctgcaagagaagttgagcaacagttcggtgacagctgagctgcaagaaacgattgaaagcatcaggatcaaacttgaagaagtttctgaggagaaattacttgttgagaacaagtttaagcagctggaggaagcaaactctgaagctgaaaagtacaaccaagaactgtcacatgctaccgagaagctttcagaggagaagttcagacacgaggctgagattcttgcattgaatcaggccattgaaaatctgaaatccaaactggagagcattgctaaagagaaatcgttgcttaaatcatggtttgctgacctagagcaagtcgtggagcgaggaatgagaattttccccgaatagccggaattccgtcagaaaaaatcatagcttgcatttagcgaattagaacttttttttcttcttctaatacaccatgatacacacttgagaagtcctaccatgcatcagcattgtacttttcctgtctgattcttttccttgctgaggcgatgcatggtggtgatgtgctgattgcctgcgagtcttttgcgcggaacgtatttccctcggcaataaaatggttctaaatccatgtaacttgtatatgagcaagcaaaagcgatcatggttgctagaatagtgctttagcacagaccaaagtacaaggatacagtcttatactaatatgctttatccagtgacatgtcagattataatccgctcaagccaataccctgttctgtttagctcatca

SEQ ID NO: 58063 - DNA, 3951 bp, Oryza sativa
gatgacattaggaaatttatgcttgcatgctatacagtaattatttcagccattttgctgtcgatggtaatgcaaagccactcccagacatggtcaaattctgaactatggtcactcccagacatgggtgatgtttgttcctggtgtaaatgagctttgttcagatggcatttgagctttgttcagcgagcagcctttggtttaatatacacgattcagcatttcagctaaggtgattgtcagttttagctgaatcatcatgtatggttaaaactatcatcattcattcattcctgatccattcagttaccaatggagagcaggagtggaaacggagttttgttctgttattctgtcagtgaaagcattgaactaccagttgcgtcaggaaatgtattcagagtttcaaacaaaccttagctttaggtaaaccgaagactactcataagtcataatcggtctaaatttaggagtaaagtttatgcatcataaacgaattgaactgcccataatcatttataaatttaaacttcttgaagtgtccacaaattaattctgaaccatctgtgtttgttcttcttttgcatgagacgctctgatgcctaaaagtctaaaacccctccttgacaaggtcagtgtccacgtccctcgccgccgccacgctctctcgtctgcctgaacacgctcgccggcgatgtcccgcccgcccccctccgccgcccgcgtggccctctacctccgccgcgcccgcctcatcgactcgctccgcctccgcctccgctccccttcctccccgccgccgccaccgccacccgacgaccccgtcgtcgcgctccacgccatccgcgccgccccgacgccggcgtcggcgatctccgtcttccgcgccctcccgccgccccagccgctcccactcttccaggccctcgcgtcccgcctcgccgccttcgccgcgctccccgacctccgctcccacctcgcctcattcctcttgcccccgccgcctctcgcgcgcctccgcctcctcgccgccgcgggcgaccacgcctccgcgctcgacgccttcgcctccgtcccggccaagccgcaccgccccgccgaggcgcacaacctcctcatggggctccacgtccgcgcggccgaccatgccgccgccgtgggggccttccgcgccatggtccgcgagggcgcgctcccgaacgcccgcacctacaccgtcgtcatcgagcacctcgcctccgcggggttcgtggaccaggcggtcgaggtgttccgcctcctcccgtcgctgcgcgcgcggcggaccacccggcagtacaacgtgctcgccgaggcgctcgcgtcggcggggaagttcgaccagctccggtggctcgtccgcgagatggtcgccgtcgacggcgtcatgcccggtccgcaaatgcgcgccgccatcgccgccatgagggaagcgggacacgcggagggcacggaggatttcgtcgaggagctttcacccaacgaaagaatcggttacgccgtggacgacgtcgacggcgagggagatagcgacgacgaggaggaggagggcgacgacgacgatggcgtggacggtcgtgacaagggcagaggcagagcgacactgaagccatggctggacccgcgcgagctcgcgagggcgctggaagggtgggagccgagggaggtggccgagctggaggccgccgggatcgtgtggacgccgcggctggtgtgcaagctgctgcgcgcgttcaagaaggcggagacggcgtgggagttcttctgctgggtggcgtgccgccccggcggctacgcgcacgaccggcacacggtggcgaggatggtcgccatcctcgcccgcgccggccacgtcgagctggtggaacgcctgctgggcaaggtgcgggccgacggcatcgtcctcccgttcgccaccgtgcggctggtcgtcgacttctacggcctctccaagaaggccgacgcggcgatcagggtgttccgggaagccgactccatctgcggcgccgtgtcgaggcccaacctggcgctcttgtgctcgtcgctgctgcggacgctggctaaatgccggagagcggcggacgccatggagctcctcgaggagatgatgtcgcgcggcgtcctccccgacctgcagacgttctccggcctgatggagcacctcgccggcgccggcgagctcaagggcgtgcaccggctgctcgggctggtgcggcagtgcgagctgcagcccgacgggtacatgtacagcgtgctgatcaaggtctactgcaagaaggagcgcgccgcgctcgcgctgaagctgttcgacgaaatgcgtggcgccggggtcgcccccgacgcgcccaccaaggcgctgctggtgaagagcctgtggagggaggggaagctccgggaggcggcgcaggtggaggagaggtgcgaggaggcggccggcgacggcctcccggaggcgtcgccggggcacgtgtggacggcgagcgccgccgacctgaagaaggtctccgacatctactacggctgcttcactcagcctgcagcacagacagtcagtactccatagatgattccctttggtatcaagatagcaaaatggccatgtcaatctgattgttcatgacaaacgggaattaaactgattttgattttgcgagaatccaaactgctttctacaaaattgttgcaaactgacaaagcagcagagtatcaggcaaatcggaggaatgtatggcctggtttagttccccagcttttttccctaaaaacgtcatattaaatctttgaacacatgtgtgaagcattaaatatagataaaaataaaaactaattacacagtttgtagagaaatcgtgagacgaaatcttttaagcctaattagtccattattagccataagtgctacagtaacccacatgtgctaatgacggcttaattaggctcaaaagattcgtctcacggttttcagtcgagttatgaaattagttttttcatttgtgtccgaaaatctcttccaatatcgagttaaacatccaacgtgatacccaaaagttttctttgcgcaaccaaattactataaacacaccctatatatggtagtataatataggcttcgcagatggatggtttggggcccagtacaggaggaggcccaaatactccacggcccagcagcccagcgtctcctcttctgtgatttgctcatttcgttccccaaacagggcgccccagtgtagcgcgtcaccgtcgtttggagaaaaaaaatttgcgaatccaatttcgaatttcaatttgcgcgtcgccgtcgtctccgcttctcctaatttcgaattccaatttccaagcaatccatcgcctccacctcctccaccgcctccgcctccgcctccaccgatcgaggccgccgtagcttctcgatccgcggggagctcgagctccagcacctcggcgggcggcggccaccggaattgccgcggaatccgcgcgcgtcgccagtcgccgcggcctccccgtcacctctaacccctcccgccgccgccgtccccttctccgcagcttcgggagccgccgcggcgctctctcatctcgtcggtgcgtggaccgcggcccgcggcttcacccacctcttcctgaaacttcacgcgcttacactcatcgtgcccatttcgcagccgcgaggttagattgctcgtcgtttgttcactatgctgcaatggatgggtggttcgcggaggaaggtgtatgccgtgagtaccccagatctccctccctccatctctctctgttgtgcttcctcgcaattagtttgggcttggtttccatcattttttactgaaacagtgaaacggttggcgtgtaaatcatcagagcaatcgctgcatttagcactatttgtcgtgacaaactaacattcggtcatgtttggggctgcaggaa

SEQ ID NO: 58064 - DNA, 1604 bp, Oryza sativa
gcaccttatatttcctgttcttccggggcactttctggatatgtttttatcaggtaggttgaccaatggcactcttgttcaagtgtaacggaaggttaagagctttggaaaatctggggcagacaaataatgattgtgatttttctgcaagattacaatttgaaacatagttgtctgaagaagaaaaaacttagaacacattgctgttgtactaacttatgacaattggtgatggtttcctggaaacccaagacataaaaccatcatcggaatttatttgacagatggactgtatcgtgcactttctgtgcattttgttttggttagagtgggcttttgtggagtagtctcttttcattagtgttgcatggttttatcctaaaactgaatgcatgtccttttatcctccagttgtatgttacattaattgttgttactgttatctcagctgtagataatgttgttccaccactggattgcactcttttaagtgcttctcctatagagggactaaagaagatcacttctgcgtgcagcaatctgaaggaaccatgtaagggttcaaccttctttatatgattcaaaggaattcatcacaacgttcttgttttgttttatgacatggtatttcaatatactaacattgacatggtcatatccatccacaaagttcagaaattcagtagttctatttttttaatgtttctctcttgaatgcgcagctacctaaagaagaatgagatatgatattatttctgaagcatgtaatgtgcattttagataaaattcagtaattcatgtactgatttgttgctactgtgcaggttctcagccaaggtcagtatctccatgcagtatgataagtgcacacctggttaatcgatctagttttgtacttttgtgagatgtcatcttgtgcattggcagattgtcatcatcctctgaccatcacgatggtgcagcttctgctaacccatacaaggaaccgcttggttgcaaaatacccccaccaaaaagcaacagtgtcaagaaacaaaatccaaatgtggaactcaataatggtattttccttccctactatcaaccggttatttataatagagctacttgttcaagtatatgaattgcaaatatgctttaaaaaaatgggaagtactccctccgtttcataatgtaagttcttctagcattgcccatatccatatagatgttaatgaatataaatatatatgtgtgtctagattcattaacatctatatgaatttgggcaatgctagaaagtcttacattatgaaacggaagaagtatgtgcattgtaaatatggcataaaaggggaacaatcatcgatggcatgtattggccttaacgagaacgcttagtctgttcaggaaatatttcttgcaaccaaaggtaaaattatttgcatgaaacattgatgtaaaagtaaaatttatcaacacgtaacttgtataaatgagattgatgcgcttgttatatattattcgaagtttgatttaatgaactattgcatttccttgcagaaatttcactttttgatttggtcagtgatgagggaccaaataataaatctactgcacgacct

SEQ ID NO: 58065 - DNA, 1241 bp, Oryza sativa
ttcaagagaagcattggcttctttcagtttttggatctcggcaccaagtgaggatttctcctgcgagaattcttccaaattacaggcgattgtgtgttccagatcattgatacggctctccagctgtgatttctcttccagagctcttcctaggtcagctttcagattgttgattgtagcttgtagttgtgcgacctcagtccttgaaccctccagctccttacgaacttgttcaaattcgatagcacgttcttcgagcatcttcttctcatttgaatcattgtccagccttctttgcagatccttgattatttcttggagcttcataatctgtgctgatgaatcatctaggctgcgagatgcttgttcaagttccttaacctgggccttgagctgcaatttctcttgtgacatttttgctagatcaccttcgaaattcttgacgatgtcttggagctttattatttctgtttcaagagtagatttatcgtgggaatacttctcatgaacgtgttcaagctccttcttgcacttctcaatttcatggtcatgatgagctagttggccttcaagttccttctgaaggctgctgatttctgagtgcgaatccttcaacttctcctcaagtttttcacattggcagcgtgtattcttttcctcaagtgcctcaagtttttcccttgcttcctgaagctcatcttctagctcggcaattcgttcgttcaatgcaaaaggacttccatcaccattgtcttctctcaattcgtcaacctcagaatcagattctgaagaagatgatgatgatccatcgctccccttcttggaaatgtctgaacttccaccagaaccaaggaagacatcaaagccagctgctcttggtttacgcttctgttttggtgttgtctcttccgagtcaggcttaggagttgggggagcagactgtgtctcagaatcagattcagatatgctaagagagccttgtgactggagtgacgatgggatattcttgcgtaattccccagtcacattgtcataacgctcggcaagagcacgatacatgcggtagaagttctcaacatgagttacaagcaaaggccgccgttcgaaatacatctcggccttctttgcaaaagaatcaccttcatcctcgatgagcttcagcatatctttaacttgcttatccatctctgtttgttgagaaaaatgttatagtaagaatcagttgtgctatgcatagttgt

SEQ ID NO: 58066 - DNA, 1675 bp, Oryza sativa
  unsure (1)..(1675): unsure at all n locations
ccatgccgtgtcattgcacctgtatatgctgagatgtcacagacatacccccagttcatgttcttgactatagatgtcgacgagttaatggtaaaaccaatgtttttttttcctcctctcccccctctgttatatccataagaacaggtgatagtctctaatgctcttctcagtctcatctgttctgttcttcaaccgattttctttaggacttcagctcatcatgggacatccgagcgacaccgacgttcttcttcctaaagaacggggagcaggtggacaagctcgtcggcgccaacaagccggagctggagaagaaagtggccgcgcttgctgacagcgcctgaggcaaattaagccagtgacaatcagacattattgtcaggaaccccaaagttcagttcagagttcagacgttgccagcaaatatcaattatcatcagaggctgtatgttctgctgaggtgtttcttcagacttggttctgtatatccgtcatgagactgtacagtccccgggtataaagtatctttttttctcctgttaaaatcacacttttgacatgccattttggcactattattgcctgattttaccctggtgattagtgatccgatgtatgttgagtgtgaactgatacagaacaatagggaaatatttttactgtaatattgacaaatgccaggaatggctaccaatctgccatgaatccatgatttatggagttcatgattctagtatctgatgggcctttttagcgagtgggccgaatgtatcaccgcacagctgctctttggatatgatgtgggcttggtcggccagtaaccatttgtgacgaacctcatgggtccatgacactgaatttcaggaaatcacaaggaccggccgcagccaaactttgatttttcaaacttaactttgaattactctaggtgtttttttcaaccttagcttttanaccattagtagtagaaatataaaagtccttcaatagaatcattttttgttgacttacagtttttcttctaatgttttgtgagcttttagccaaccaatgaaattcttcaagacgtcagaattctaatgccatcaatgatatacagagacacataaaacagtacatgttgagatgcagagcgtcgtcattcttgtagccaaccttgccggcacggccagccgctaattaaccactccaatgaatgcatcacagcatcggactatacagtacgtgtggctctgtgctcctgacatgtagttgtacgtgccctacttgtcaccagccaggaccagcttgcacagtgcaagtgtcatggatgattaagatatgatggctaatcctgaattactcgaggatttcacacgcaccattagacaggattgagtttgttttttggtttggagtatgtcgtttgggctctgttataaagccggatcgatcatttgattgatatatgtggtgttaagaatgaaaataaacgaatggattctgattggcgttgggaattgagaaagattaatagcgaaacagacggagaacaacttatatattggtggcggatctagaaagagatagaggagatctgaataaactagataaagctaaacctcttcccatctacatatagcaaaaaaaaatttagcgggggctctgtggggactcccatagtacttgcgcc

SEQ ID NO: 58067 - DNA, 2791 bp, Oryza sativa
aagacgaatgttcaatcgttataaaaaaactcaaagcgacgagtattttgggagttgggacggagatagtgctgtgtgtcttatctttaataaaaattaaagcacaaagaccacactaccgttattaatacagagtactacagtagtaattatagtttgcctgccttgtcaaccgtggcgatccagcggcgcgcggcatgggcgacgctctctggcgtggcgtcgcgccgcgcccgcgctctctcgacgcgcacgcggcgtggcgtggcgcgacgtcgcggcgtctcccgccacgggtttcgactttcgaacaaaaaaaggaatccctcctctcccgcgcgcgcgcgcgctctctcgcaaacgcggctgtctcgtggggccccactcgctggcgatggattcctggacgtgggccccgcggaccagtgagagataacgaggcttcgtgaaacacaccagtacaccagtacaccacgactagtccaacagaggacgacctgggcccgcgtgcccggcccaacaggagtctcatttgttcccagtgtccagcccaaggtgaatttcccaaactgccctcggcttgctgctggtggtgttaattgattgattgcttctccagctataagctcgcgaagcaaatggacacgctcttctttttgtcatctactgcatggcgcgcgcatgtctccttccttcgtttgaacgccacaagcttcgcgtgcgctttctaatactgataattaatactccctccttcatctcaaattatagaacatactttctccgtctcaaaatataaatctaaaattgaactgaatgagacgtttctataacgtgtctggacatatagtccatctatctggtccgaaagagtatatttttcacacggtttttaatgacatatttgaattgttaatttattttatattgcgtttacaatttatataaaattaacatcacatgaaactattttaaaatatgaatctagtgatagaacatacataatacttacttagtatagatatagttagtatatatattagtcaaaatttaccaagtttaatttttctttaaaaaataccctataatttagaacgggagcactatgtttcttaatatataatgtcattgatttttaacataatgtttgtttgagtatctctcttgtaaaagaattatataaatgttattattttgttgtgactttttgtctaaaaaactctaccttaacttatatatttatatatttatattaaaatttattaataagacaaattatcaaacgttacacgaaaagtcaacagtgtcttatataaaaatatatatatatgaggtggtatatagttattctcaataggaaaatcatttctttgtcattacctttcaagactgttattttttaatggcaggaccgtgttattggttgcaccgtgacaaataagaaatggtggagcctgatctgcccaagaactgcctaatgttttctttttccgaacacgcaaaaggattgcacgtcaatatattagaaggaaaaaagtttttgttatacaaagcaatcagccagactggcttatgcctaagggggaggggagaaaaggcaaaataaaaaaaacttgaagataggaactactacgacgttaaaaacgcaactccaaacagcaggagggggcagaaccacgctacactcccaataaatccccaaaaaagcaacgccggctaaagaccacaactggccctccaagcggatggactccagaaccattgcgactgaagcgagcgcagagtcgaaaaccctaaagtttcgttccttctatagctgccaggaaactaggagtaccaaggagtcgaagccgctacggaggtgcttaggtaaacaaaccctggaggatgatcaccaatcctggagccagctgccacgagggagagagagggcagcccaggaggggtcatcacacggagccagacctgccgtcctgaactgcctaatgcaaaaaataaggaatactttgtaaaagaaaaatagtgtattaataagcgatttaggacactaaaaacgcccatgtgtacgctcgagccgtatcttgttatcttgttggaattcaataataatctgtcaattttttggtaggccaccctcctatcacgcacttaaacagttgaaataaaaacgtgatgagttgtgaagcatcagggtggtggttgatgtgagctgtttgctccgcgtgctgcatgcagatggcttcaattttgctcagtcaaacactagtattatacactaactaatacttcatccgtcccaaaataaatacagttttagtactattcatatccaatgtttgaccgttcgtcttatttgaaaaaatattatgatcagtacttttattttattgttattaaatgataaaacatgaatggcactctatgtgtgactaatttttttaaatatttttttataaattttttaaataagacggatggtcaaaacgctgagcacgtatatctatggctatacttattttgggacggaggtgtactacacatcatgtggagccaatgaaaaataatatcggagcataaaaaaaaattagcatactatgaaatacacagtactgcaggtttgagcatacaaatgcatgggatgatgggaatatcgggtgaacccaactgaggggttgttcggtttttaggaattacaatcataaaaaagaaaaggtgaaggcatagaaatacctatacaattcaaatcatataggatttttacaacagatttaattaatgaactacaaaattt

SEQ ID NO: 58068 - DNA, 6267 bp, Oryza sativa
agcccctccggcaaggatctgatcaccaaactcttgccgacggtcaggagctagctagtatatggatccagtccggcacccccggtggcagtaatgtccctgaaacagcatataactattacaagacacatacaaacaagtcattgtatgaggttgagatatgattaacatattgaaggaaagaatgattctctcaatagtttttaagtttgtggatatactactatataacaagtgtacataatttttctctctttcttttttcaccaaggttttgtcctagtacgtacttcggtatcgcaatttaatgccactacaaaatgattatactctctgtagacacacacaacaaacctcaacaaaaacatatgctgcaatgaatatagacattaataaaacgttcttcatttatatagagacaaacataatgcactatacttagagaacaatggtggaatgtggattgatataaacatgtacatatatatatatatatatgaagtaacggacaatatatatatggagctgattgaaattaagttattcactacaggttggtgtcccggccggaatacaagtggatgatagcatcaggagtcaagagtgtcggctgctggttcacatcaatctacaggcatatgtttatgtacgcaattttaaagatcttacgtacgatatatatatattggctggggttaggtaataacggccctacattagaagagccctaggttaacatatggatgtataatatattccagcacattatttgtagtacgtactctgaaaattcaagatctcggtgacgccaatgtgtttgcacaatggacaagattttcctgtatttcatacttcagaatgcatatatatgcatgcacatagcctggcggattgcaagactgactagctagctatatttcttagtctcctttaaattttgaatatatatatccagttatccttcaactcttaaaactggcgagatttaatctgaattccacattaatttggttgtggtagcaaaaaagaacgaagataggggcgaaacttcacctatcagatagagaaaataagtgtatgctccagcgcttcactgagcaacatctatgacacccaccaccaccttgaatcccagtacttgtacaccatgtggatgccttgcatggtcaaatatattggtggaaggacctgtcctatccaattttgagagttgatgaatgagttttattgagtgttgaaatggatatacggaaattaaactgcaccagaattgagagatggaaagtagatttcttgtaataaattgttatagctttctactatctccattctcaaaaggatgacgtctagatagtgttccttttagattatcgatggatgaaaactcatgaattctgattatagagataaattaaatattatatataaattataaaggtccaaataatgcggtagacgaaagcttttcattttggagaaaatacattttttaaattgtggagtaaataatccgcagcaatagatgaataatctaaaaacaataagtggctttaaataggatgcatgcagttgaacctcaaaatcttgaattattaatagatgcaaaactaccatgatttgaaatgtgaaaaaaaatcatatcagtagatttaccatgaaaaactctttcatagaatattattaatcatttttatgaatatatggtttgagaaattaaattaaagataaacacgcgcattggtcgccgtgtcaatatataaccaggggacatttaattatttgcattatgtgtctatgacatgtgggttcagtgacaaatcgtttagaaccactcataagagtggcaaatagttaattattccatatcctaaacgtcatcctgttgagaacataggtggtagctagctaacaaggaacaagtaatgcgaaaagtcattcgcaaaaaaggtaaccccaataattaaaccaagtatgattgatggtccaggataaaaactattcgttagacttgatagtttacctggccatgcatcgaacgatcgagatcaagcaaatataatacatatgcatgcatatatatactacatgtaattcaaacatatggtcaattggatcaccgtcccagcaaacacattggcttgcaaatcgaaaaaaaaaacgaagatatttagacaagaactcacaccaatgaatctgtttctcgcattgcatgcatccatgaataaagatgagctcgtcatctccgatgattagaatggacgcagctagagacagagctagtggttgttgaggccaaaaaagcttctgctgtgacagcagcaatcacacattcacacttactaatcatgattcattgggcacctttacagccaataatgccagttttaaacctcccaattacaccattaactatatggcacaatcagagatcctctcgagacagctatcaatcaatggcgatcgaattaaacttaattgttggcactccatatatccagcagcagctgtagcagcagccagcagcatgtgatgtgagctactactgatactgatactgagctattgcgatcgcatgcgaagaagattcagtagaagttaattgcaagcttaatcagattcagtagcatttgagctgagctgagctgagatgatcatggggagagcagtggagcagcagcagggtggatgctgctcggagaagaagaagaagctgaggaaagggctatggtcgccggaggaggacgagcggctggcgacgcacatcgcgcggttcggcgtcagctgctggagctcggtgcccgacctcgccgggctgcagcgctgcggcaagagctgccgcctccggtggatgaactacctccgccccgacctcaagcgcggccgcttctcccaccacgaggaggagctcatcttggctctccatgacaagctcggcaacaggtagctagattattgctcgattaattgtttgctggattaatcatgaaacgattgatttgatcaatggagttcgtgttcatcgtccgtgcgtgttgccgtgttgtgcagctggtcacagatcgcggcgaggctgccggggaggtcggacaacgagatcaagaacttctggaacgcgcggctgcgcaagaagctccggcagacggagtcgtcgtcgtcggcgacgacggcggcgggggcggcggcgaccggacaccgccgcggcgaggctgaccggagtcgaccgccgccgcctgcatcgttcaacaccttctctcacgacgaccggacgactcctgctcctgccgcccacattgccgccgccgccgccgtcgaagcacccgcagcgatgacgacgacgggcggcgccgtcggcggcggtgttctcgtggacaacagtggtggtcaccgtgatgcggtggcggaggcggcgcggggacacgtcggcagcggcgacgacgatggcttcttggccgtgctgcttggggagtactacctcgacgccggcggccacggcgacggattcagcttcttgggcggcggcggcggcggccacgtgttcagctaatttgtaattagtttgcttgctttaatttgatcgtgtaatgatccatttcattggtttggggctgacaataattagcacacaagctcttgtttagttgtgtttgtcaaatcaaatgtgcaaaattaatctgaataaaattgttgatgatcgatcgatctctacttattcatttctcgtctctctcttgaaaatctagggagctccctatttcaggctaaatcactccgagagaaattcaaattccaaagagaagttttgaatgttaagctgtttggacacaattaattcaaccaaatttgaagagatgattgacaaaaaaaaaaagccctcgggagtgtcgagatggcgacatctcacaacatatcgcccaagaaactgatcctatatgtaccactttaagaatttaataacacgatttagacgaactaattatgcaataaaagtgtatatcagtatatgatatgctacgtgctaattaagtcattaacaatttgattaacaaattggtattgctactgagaaaggcaataactaaaatttaatttcctgcgcaaccagtttgatggagataccggggaagatactaataattcgagtaatccatggagtacaaaagataaactaattaagcaagcatgtcgagtggttggctactactaatactaatttatattcatgaatctatttacattttgtatatatactcaaataccaaccggacacctaatttcttgaattagtactacttgataccctttttaaaactatcatctagaagcttcttttcttaaactagaaagttcacgtgctaaattagccaaccctctatacacttgtatttgggccgacagcacagctagcttttatctgtagttgggctccacttctattagggccgaatgctagtctgggccttctatctctagcgctcttgggccgaatctgacgggagaatgcttccggcccatttcgaagtttgcactgaggtggtgagttggatatcaagattcgtgcaggtgcagctggttgagctgggtggcgacaaatcgaatcccagtcaaattgcacagatcttggagtggatctccctgcactgcattcgaaatttctagcggctcagggtgcagatctcgaggaaatttaacgtcggtaacagtgctgtcaaatgcatgggatcactctacctgcgacaagcgacgacgacgacagatagaaaacgatttacctgactacataaatttgttcttttttttaaaggatgggggagtattctgctaaacaaactaattaaccaaggaaaccaaggtgaaatccatctcataatattaatcataaggaatttcgatgtacttgtcacctccatcaactttaattcaattttctacctattttaaccccaattatcgactcactagttagaaccaaatctcatttaatatcggtattgtaatcttttcttactatccttaattttacccaaaagaaaataataatttatattatgacacagagagagtataccttcattcatagttttatgatgtgtctcatctagatctacattactatattttaaaacggagtatcatatactgctgcagtaactacaagctactataacaacttattgagaattctttcaagatataatattgtttatagaagttcagaatgagacttctgtggtcaacgtttatagtaagcttggaataatattgcaagatacagatagtcagctgacacttgtgagatctaactctattataattggtgcactaatacccaagacttctgataactactagttaaactgtgaaatgtgtcagctagctataggttagcagatcgtcaatcaaaagaaaggtaatgattgtgatagtaaatctgccacccttttctagttccattgtaaattttacaaattagcctttgaatttcttattcatataaaaacaatcaataattaaatggcagccacatatttcctatagcaaaaagatatataacacgtttcatgagaaataaacttttatttattttagatattactataattttttttatctgtaacaaaatacaggcatttagctagtttatagagaagacaataatacctaggtatagtttcctagtactttcttggtgctgggctgctggcctccaggcttccaggaatccagttccttcacttgtataaataccctccctttggctacctcccttgatcgccaggcctacacattttcttcatctaattaagcctacacaatcaagtagagtactaacaagtagctccttgatcaattttccatttttttttcagtggcaacaatgtgtggctcatttgctccaaggtcatcgtctctgctgctgctgctaatcactctgctgcttgtcgttgtctcacgcccacaatattccttggatgctagcgcattatcaggtaaatgcacatattgttgtttacaacattgttcttgacattctgaaaatctctgaatatacatacatatgctgatctgttcatgcatatatgtatacgtacatagatcacctcgccgtcggcgatgcgccgccgccgccgccgcagcacggtgctggccggaggctactcagcacgcagaaccaggtgacgccgccaccgccggcgccggtgtcctcgccgccgataggccctgcgcctaccctgctgccgccgccgccgccggcaaaataaacggcgg

SEQ ID NO: 58069 - DNA, 1163 bp, Oryza sativa
aatgtccccgtttcaaaggtagcgaaaattcaactaagggcatgtataaaggtagagtctaatatgagctctctatattaattaatatcactagagactattctcctacaatagtagagacaataagatttctaaacaattaatgcactaaataatttttttattatacttatttccttttctctatcctcatgcaacaaattttccgttaataaatactaagagttgactctgagccgttgtcatgcgtagcaacaatgtttatccttattccctctctttcttccacgttattaaatttacttgcatgacaataaagagagtccgttattagacactattgtacatgcactaattccattgagaatgaggagttactatatacttgtgtgattttaattatggaaaaatcggtccgatttaaactaagagtatcaatacaaaattacatttaaaaattctcttaaataaaactttcaaatgtagttgtattatagtaattgaaatgtaactatattatagtttatttatttctaattcgcaaataactaagtaaaaacatgtccatacagcgatggctagcattattgccagcttgctgctagaaggtcgggctatatatatacggagaattttccacaccagggaaggaattgaacatgcccaacaatgaaatacaccagcgatcgctaatttcgtgattatttgtctgatttttgtgacgaaccggcgacaagtggaatctatagccgtgcccccaagctcgagcgagcgcgaatctcgaggcaattagcccgaccacctaggccggactactgcgccgatcacatggcgaaacctcggctggaacaaacacgtacgtacaacaatctggctggctgtccgatgcagcgtctccatcatcgttcgttcagtctatgctcccttatgagtatttccgcctttctaatataggttaatttttttatccatctcacacgtatcaattgaaaaaacttaaaaaaaacttcatttcttaaaccacaatacaattattctctattttatctactcctgatgcatttatccatttttttaaataatggaatgagtaacatcccggctacagccattattacaatctagcactttagaagagtatagttcaaaataaagcgaatcac

SEQ ID NO: 58070 - DNA, 7138 bp, Oryza sativa
caagacttgcatggtggaaattctagtagtgctgatgaagtaggttattgacctagcttaattagacatgatggccggcctatgcatgaacctcatcttctgaatgtgccaaagaattttggctctcagggtgtatgctttctgtctcttcctacagggatcaccaacttacagtagatgggaatagttgggtcctagctaatatatccaactgtccagcccatttgtgaccttaaaattgacagcattttgatcaggggtagtagctgacaaacagatggccagctagtgtggtcttttggtactatagggtctgtatctatatgatcatccattggataatttctcatattttttgactaggagggtacctatgtatagtcaagagtcctttcggggtggttagttgcacaaattcaataacgcactgtagttagatagaccatttagtttacttaattatatgggatggagttgtacttcttctaatcattcattgttgtttgcattgaacttactagataaaaactaccaactctgtaagctatatagtacatgactttacgggtgcagatccccgtggagttaattggcttccaactccaaccggtgaatttggtccaatctgaccccttactttgtttctacgggctagatgtagccatatcacctctttccaattacacatttataacagaaacaattcaatctatttttttcgtaatccgtccattcagatcaatagtctcagaagagcatcatggtgtaaaaaataattatctttaaaccttttaattgagttgttatgaaattaacggtattgagacctgtatcaaactcattcatcctaataattgacagaacatgaagcttctactggtgcaatgtttttgttttgtttgttcttatctaattattatcagaaagtttgaaggtaacatgttctctactatatactagataatgtttttttatattttttatagactctacattatatttcttttgaaagaaaataggctagtagtaaccatgggagaagggattggtttaatctaatccatcaaattaaagggacggcttggattaagtaaatccacctggtggatttgaaggcaactacaggggatccactcatccacacccttgccgtccttgatgtgatctcctaccaagctgtgtatcatgtcctgcaagcctgcaccagatagatggctcatggctgcataatttcctgcactatgcacacaaaaacaaagagataaagcataaatcgatgctgatgacttgcatgttccattaaaaaaattggcatgcagaaatattaaaatctcttaattgccatgctattggattagtacactaaaataattgaaatttgtctaatcttttttctaaaataatatatcccgtccttttcagaaactaaaaccatgtgccctctcgatcttaagctattttcagtgtcaccttaattaattatgttttcgagggccatccctgcagctaatcaattaatgccaagcatgcatgcatctagatgctgtataccaagttgtaatttggtagtaatggcgccgtaacagtagagatgagcagttgcgatgttggattcagcgataccttgaccaatcatcttgcaagaacaagtacttaatgagaggtttagtaccaaattaggctaattggagccaccacaatcttgtcctgcctacacatgcacacagtataagtcctatattcagaattcagagcagctaatcgcatgtgtacatatctatatatacatgataaaagaaatactcgatcagatacaaacaatttatcacatgctagctcaaagacctagaatgcctttacacaagccaagtactagtacttgcgtgcagtcttgctcatgcacagggtgttcatgatggatatgttcagaatatcatcacaatacatatacctagaactacacacacatggtccatatgtattaatgtaggagtacaacaaattcatgggataccttgaccatacttgggtacaaacacatagaatataataagactatcaggttaacacaatgccaacacaggatttgttttgtctgttcatacatgcatgcaagtacagatactcctgccccccttccctagcttctcctacaggtagggcaatgtgcagtagcctatagctacacatatatttgtatatacaattaattaattatattatttatacacatatatgcatctactatatatatgtgtgtgtgcataggctcacttaagtaagcagtctattcttcagcagatccaatcatcacatactaagtaagctccagctgctaatctttctctctgaattctccatcacacagtagacatcagcaggagtagtactagctagctaagctcaagaatggtgcggaagccgacgagtagtagaaacggcgaggcggccgccgccgccgccgccggcggcgcggcggaggagaaggagaggaaggggctgtggtcgccggaggaggacgagcggctctacacccacatcacccaccgcggcgtctccacctggagctcagtcgctcagctcgcaggcaagaattcatttgacacctaacttaattaatcatgcttcgatagtctgtctagcttgtaatttgattgatttctctgcagctgattgctagacaggtgatttggtttcttgatctgacaaggttggcattgcattccttccattgtgcaggattgaggcggagtggcaagagctgcaggctgaggtggatgaactacctgaggcctgacctgaagaaggagcccatctccgatcgagaggcggagaccatcctctccctgcagaaactcctcggcaacaggtagcaattcagttggaggacttttacaccgttagattgtatatactgctagtatatatttgcagtatagtgtaccgtaaaagtaaaagttctcttcagtttcagtaccgaaatccgtgttcattttcatggttaatccgattctctagctgaactttcgatttagttatcagtgttgatttgatcatggatgatatgtgtgggctgcaggtggtcggtgatcgcggcgaagatgccgggcaggacggacaacgagatcaagaactactggaattcccgcatcaggaagcgtcagtccgccgccgccggagctaaaggcgagccggcgccggccacggtcatggagaaagaaccgacggccaatgcggccaccgtggcggcggcgccggaggcggcatctcctcctcctcctcctatcccggcgcggctcccgatgttctcctgccaactgctcgacggaggcggcagcggcggcgccaccgccaccacacagtcgccgccgaacgccggttcatcggatatcagcgaggtgagcgcctgcggcggcaacggcggcggcgaggactcctcccgtgactactgcttctccggcggcgacgtcgacggcgacggcgacatggtccacctcctcgcgctcgatgacctcgacttgctcgtcgatgtccccggattgctcgacgttgatgcgtgggattgcgagctgtaccgtgcagattattcgacgagtagagctcgatgagtaattgatgatcatcttgagtgtgattactgattagctagttgattactagctcagctcgcagccagccagcctgaatcagaagctacctagccagccatcctaagtgatgatgttcaaattaagttgattttgtaattcggttgaattctgctgtacttatatatttgttcaaatatgtatgaaattgctagatttttgggatatacagaatcctcctctcctgtagaattgaggtcaaattcattattcagagttctaattcagcctctacaccttgatttgattaattagtgttgtcttcatcatcatacacaattactcctttgaaacattgaaacaattctttttccgccactaattaactcgcacacatccatggattagcaaatcttaagatcatttgctaatttaaccccctagctagtgcaatcgacaagcatgcatggtgtgcatgcatcacacaacactgcatagatgggtagctgatagattcttcagaaagggcatgtatgcatatgcagcacaagataattataccaacatgctacagaaaatttagtaactttttagccaatatataattaaataattaatctccaaatcatcgttttgctttacagctttatttggtccaacgtaagatcgatcgatttgatcgattgatctagctagccgcccaggtgcagctgagaatgacactagttaaatcaaagtagctgcccatgtggtcattaacaattgaacttaacctgcagagacctgcatgccccaggtgcatatatatgctaattacaccacctaatttgttgtatctacatgccatgtattctgcttagtggcttaattaactgtgcttaattaaccctactgtttacatccgtgcatgcgtgaaatgtgactaatatgtctactaattgtcatcagctagttaatccggatttatatatgtactgctgggatcagcatgcttacgcatgttgtatcactgtatcagtgtatcacacctactgcagaattatacttgactgcgactacgtggctaattaattccacatttcaactaccgctaatattagtaccttaacttttgtaaatatttaagcatctttaattcaacatgctgttgatcaacggagatgctggaaaatgattcgaatcatttttttgggtgatcgattaagctgttgcagagcttcctggtccgggcctagagacgacagcatttgggcccaacccaccactccaattgggccatcctacataatgggccgggcctaacaccagaagatccaaatctaactgatttctggtgggcttccgctttcaccggcccaactcactaaccttctagaagctttagctagctaatctaatcatcgcactagctagctaaagcacccactctaactactactgttagacagtctcgctctctgacaggtggggcctgttaggtagtgagagcttatcagagcaccgtacttgtagtagtagcaatgcatgaactctccttttctttgaagtggttgcagcaagccagcaaagagaatatactgcaattttcaaactccttttgagaaaaaaggggagaaaaatattgtgtagaatttgaatttattattctccactaagtcatttacagctagcaggtgattataaatccaattttaaatccatttcgacgattcgatattcatggagccaaactgatcgttcagtcacagacacagctcagagctctcgagagagagcggcggccatggggttcgccgtgtctctcatcagcgccatgttccggcggatgttcgcctccgccggcctccggccaggctccgccgtcgtcgacgacgacggcacgacgctccacttctgggcgcactcctctctcctgatcctcccttccaagaatggcgccgccgccgccgccgcggcggcggggcggcggccggtggtggtgctcgtccatggcttcgggccggacccgacgtggcagtggggcgcgcaggtgggcccgctctcccgccacttcgacctggtggtcccgaccctcctcttcttcggcgcctccaccaccagcgccgcgccgcgctccgacgcgttccaggcagccgccatcgccgcgctcctcaccagcggcggcgcgcacctcccaggcctcggcggcgaacgccgggaactgcacatcgtgggcaccagctacggcgggctggtggcgcggcacctggcgcgggcgctgtcgacgtcggccggcgacggccaggtggaggtggggaaggtggtgctgtgcgacgccgacctggcgaagggggcggaggacgacgcggcgctggcggcgaagggcggcgtggcggaggtgacggagctgatggcgccggcggacgggaaggcgttccggcggctgatggcgctctgcgtccaccgcccgcccaagtacatccccgacttcctcgtccgcgacctcctccgggtacctacgtacatacatacgtatacgtacctcaccgtatacgtatacgaaaactcttttaataacccgggtgaatgttcacccgttcattgcatgtcgactaaatatatttataaaaattttaaaagataatgagataaattaatatgagatatatcatctcacaggcatgaaggtttatatttgttttctgtatataactacaacttaataacaaatttattattttctattataatttatagaagttgaatttaaatttgagagtggtgtatctatcttatcattctttttaatttttttcataattatttagttgaatgggtagacgtccaccgaatgattaaaccgttctcattacgtattctgcagtggatgccatgatagtgtagtggactcttagctaagctaggaatttttggatttgttggcgagttgtcccaaaagctagtagactagtagtagatgactaatcatacaaacatcgtccaattaaaatcttttctaccgacaaatttggtggcaaatcatatcacccaccggcatatcgcacttttcccgccaaatataaatagttgcatttacacacgaaaaaggttaggactcgtctccatggcgtgagcgtgacgtcagcatcttgcattcatgccctgactctttcaattcgatcggatttgcagaaattgtgtttcaactgtatgatatcaccgagaagattggatgcagatagaaattaagaaacgagagataactttttcgttaaattttgatttgcaaatttgcaaactgcgtgtggtgcagaaatatttcgcggacaaaagagaggagaagatccggctgatcaaagagatcgtcaccgaggaacaagactcgcagcttaattctcctctccctcaagtgcgtaaaattttcagttcagagaagaagaaaacaccaactgataacacactgcattgactgaacattcagatgtaatgatcgtaatctgaatttgcaggaaattttgatcatctggggggagttcgaccagattttccctgtggagaaagcacacaaagtg

SEQ ID NO: 58071 - DNA, 7030 bp, Oryza sativa
ttgactgtttttccatatctttttttttaaagttttgcgcttctgatgattgatgaaatgatgtgatgaatcttcaagttagcttttgctggaaaggcatctgaaaatgtaaacttttttaacttaataacttaattgacgatttcttaaaaaaaataaaaatggtgtgaaatgtttaaggaatgcatgaccagataaaatcaggcaagttattaccgtgaagcagtgtggtaaaagtcagctgatacgcctgtataattggccatttattcatgtgtgaaaaggaaagcgtcatgtacttgtaattcagtgcaggattttgctcagtgaacgccaaagtggccaactggaccaattaattggtcaattaatggttaatcgtcttattaatccgctcaatcaacgcattaagacaagtaatcttctctagtgtgtatgggcctgtagcttgcagctggcccaattaattctaagttagggcaagttagcagacacgttgcttccttggctagcttccacttgttttgcagcataattattatggtgctgctttccactttgttctagtattccaatgtacgatcatagcatgatgtgcagcaaaaaatagtttatgcatttcatagtcaacaagaaggttgaaaacattgtgtatgtatgacccatatcttgttactgagtatcatcattagttacagattattgatgatatttccctatttgatttgttacagtacaaatggctagtacaagaaaatgtatttaaatatctccaataacaaacaactagcaaatactacctccgtcccaaaataagtgcagccatagatatccgtgtccaacgttttaaccgtctgtcttatttgaaaattttatgaaaaaaaattaaaaatattagtcacacataaagtactattcatgtattatcatctaataacaataaaaatactaatcataattgtttttcaaataagatgaacggtcaaacgttgagcatgaatagtgttaaaactgcacttattttgggacggagggagtatatattaatttatatgaacgttaaatatccgtagaattctgaataatcaaccatattatgactatttgcttgatgccttgacggtacattgtctgttcgatacccattttcggacttttgcaacactgctgcaaagaattactgtacaaagctacgtagtcagcagctcagcatgacagcaagaacacgtgttatttatcaactctctattgttctctttaaaacttgtactgcattagtttctcaatatgttgattgttcaggctattgttttctctatctgtatatatgttgaaaaatttgtgttcatttcttgaagaattaagttactaaccgtgctaaatttctctagggattctgccgaagtatttcagttcagagtggtcatttgctcagttccatttaccagaagtcacacgttacatagtagcgtttggtgctcaaaacactgtcatgatggttggcctggatggcaggtacttgcctctacactgaattttatatcagcaacgtaacacatgaatggaatatacatccccagtgcatgctatagcaggctaagcagctgtacagtcaacctttgctgttctcagtcattgcacaagtatactgtacatgacgtattaacttcataataccacatacttagaaattcataagcaaacaaatatactcgtagaaagaggacaatacgtggtgcaggatagtacagtataaaaagttgttcttagctaatttatttgatttattagatattttcctatagcagatagctatctctgcattttcctgctgcatttggttgaaattttcgccaactaattgagtcgaaccttggctttttcagcttctacaggtgcagctttgaccaggttaatggcgggcagatgctgcagagggaatatttccggtttatcaaggctgacctcacccccctgaggacctcggccccctgaactgcgtgacgaaatcatatcaccttgataacttgtatatataaaggttgtgctcagtccattgtatataaatgccgtcctctcgccggcaaagttctaggtagccggaataaggagagctgggtgttcgatcgcaacctacttccaccctcattctgaagcatttgtccccccgtcgaaattgcagctagttgattttagttttctttcctttcgatgaacacaacttttcactgatatatatatatgacataaaagctcaagaatgaaatacaaatctgagcttatattgtagttctacttctgcaaggccatatagcaagtctcagatctgcatgttgtgtgatactgcttcatctcaaaattgtcaatacatgaacgtgtccatccatgtattcatggtacgttgctttcttgacattgatacccctcttgattattttctttgtactgtttacctctgcgtgttctgaagtcaaagaagctgcttattttcaatggaatgaaatcaaatctgcgtacataactcgcagagaacaactcgatcaatgtcgatcagatggatgtgcacgacactgttgtggagtccactacaaaatttccggtgaaaagaacatctgaccagttgctacttgtctctctgatgatacgtataatcaaatccttcacgtcggtcacgagcagggctgtccgtgtccatcatcggtttgcctcattatccgtcgctaccacaccacgccgcccttgcaacttatcatcagctacaaaaaccacacattatcttatcctgaaattaaacgatcagagaagaaaccgatgatttttcattagattaaggcccaaatcaagccagcaagatccaaaaagcaacatttcatcacacacacgctctcgagagatggcacgtccctctagagtctagactaaacctgcagatcgccgtcggttagtgttaaaacgacgagatcagccacgacactgacttgcagatgcagcttcttcatcactgaaaactgggagaaacaaagaaaaaaaataatcagagggaagaagattcagaaccaagcaaaagcaacgaaagtacgatacaataccgttattctatcacgcaactgttctttcattctcaagcttctgagtttaaaagagaggttgggattgagttactttttaataaaaaagatgagttattagtacgtactctttattcccaaaataattcaacctaaaataatatgtgtcttatattaggatggacaaatctatgtacattcgttattttagaagaagccgtataattttctaatcttctagattgagttattttgggacggatagaataattaattaagttttagctattataaattcgaaaatattttttttttaaaaaatactaatcaagaagcttgtgctcacggaaaacacgatggaatagctcaccccaacttccgtttcgaactcagtctcagctcacatgatgcatcatcagccatggctcagaaagctaccttaatcaagccactaaatacgtttctaatccgttcctaatacccgacacgccaatgatgaaaacaactacggtttttaagcccgtttctaatacgagacactgacaaaatgataaaaactgtcaaattgtgcgcactgcaaaccgggggctagtcagctagtgctacctgtcattagagactaattggattagtttaatcacctaattaattttaatccggcgtgtttaagggctactattacttactacccacctcctctccaaatgctaacgtcgtgcctacctctcctccatctctcctcctcctccctccatttctccaatccttttcatggcggatttcccactaaactaatcgaaagaggaggctagttaatctcgctgagtcgctgctgcggcggctagtggcgaggcggagggggagcttcgttggtgggtaggtggtggagatggtggtggcggcggggcacggcgggcggcggaggcgggcgtggaggtgggcgatgagggcggcggcgagcgccgtggtgtggacggcggtggtgcagctggcgtcgatcgccgggctgtggaggccgcgggtgctcgccgactgcggcggcgggggcggcgccgccacggggctcgccgcgctcgccggcgaggaccgcgtcgcggcgaggctgtcgccgccggcgctcgtgcccaggagtgagtgcccctcctcctcctcttcgtgctcctctctgcttctcctcccctcgcgctcctagcaaataggagtagtactcgagcttgcgcgatctgtgtgggagaggggaggtcgtggcttctctgattcgggcggttggggcgagtcaaatgcggttgcttggtggtcaaaggaggcgcgtttcgtgctggttcggttcgatctcgggctcgaattggcggttttgaccaggttttgtgccattttggggatctcggggggttgaattgggcgagaactttctaaatttgcgatgatttgttgggatatatcatggattatttagcggaggtcatcctttggtagctcgaatgagattcttctcagaacctcgacccaaatgtgggttcatatcttcaacctctgttgctcgtatgctataattagtagttgtttatttaatttaatttacttatagaaaactcccatatagcccagcgctttgggcatgaaatgggctctggaataggtgatgtgaattggtaaatgaacttatttgctttgaagttaaaagggattattatatatttattattagacgtgtgtgttccatgagaaatgggaatcatatagtaatatagcgcagtaggagcctctcctactgttttctgtcaaataaaaagaaaagaagtgggaatcataaattcatgatgtaagcttttcaacaacgatgtgtcaaacaagctccgattgatgcaaacttctactcctttattattgccaaattgatttttttgcttgtagcttgctagcagcttcattgtagaaacacataactagaagacaattcacatatcttgttgtctcagtccttttgttggtactagagctgattggcatcttgttgctttttgcaggaatttataagagcaatggctatttactggtgacttgcaatggaggactcaatcaaatgcgagctggggtttgtaccttagctattgtagcttgagctagctcatccactcattttaaattcgaatataaatttcttataatgttgttttacagatatgtgatatggtgaccatagctcgctatttgaatctaacattagtggtgcctgaactggataagaggtctttttgggctgactcaaggtataatttcccacataaccttcatttctgtaatatcaacagcatgtctgtttgatgaacaattttatcctagtttgctgttgtgaacatgagttatcatcccttgctattgtaaacagcattcatctccatatttgagaatgaactatgatttttgcaagtgaaaatgtagccgaaccacagtaatttctgttgtgtttctatttcaaaagtatcttttaattttttttcagtgaatttggagatatctttgacgtcagtcacttcattaattcgttaagagatgagctgatgattgttaaggaacttcctatgaaactcaagttaaaaactaagagaagactttactcaatgccacctgtgagctggtccaacgagacatactatctaaagcgggtaataaaagtttgtttgttctggctgtgtttaacagcacttaaaaaaactgtcatctgacagattccctatgcaggtattacgtcttgcaaggaagcacaaagtgatccatttcaataaaacagatgcccgccttgcaaacaacggtcttcctgtcaagctccaaaggctgcgttgccgtgtcaactttgaggctttgagattcaccccacagattgaggcccttggacgaaaacttatctccacccttcaaaaaagtgggcaatttgttgttctacacttacgatatgaaatggatatgctttccttttcgggctgcacacacggttgttctgatgaagaaaccgaagagctcactagaatgaggtttgtctgtaatgatttgcattactagttaacgctgacttgctgtactgatttgctactttaatagatatgaacgaatcgtctttgaactgtagatatgcatatccatggtggaaagaaaaggagatagactctgaggttaagaggtttcagggactttgtccccttacacccgaggaaattactctggtgcttaaagctctaggatttaaaaaggatacactgatttatatagcctctggtgaaatctatggaggtgaaaggcggttggcagctttgaaggctgcatatcctagattggtgagcaggttctcccatttaaggtgtcccctttaaatttatcatggatgctttatagtagctcactctgatcttatgttaggaacggaagaagaaacttttatctcgtgaggaattgcagccattccagaaccactcaacccagatggcagcactggactacatggtttcaatagcaagcgatgttttcatccccagttatgatggaaatatggcaagggttgttgaaggccatcgcaggtttgcttctccggaatctaatccaactagagttcactcatggtttgtttttgacattagtaaagaactgcttgggctcctgtgcattctgaattcttacaaataactacaaaaaagaaaaaaaaatcagtgactttaaaactacttaggtccccatcggttggtctagtcatattataagccataacgtcttattagcgattaaaaaatgatatgtgagtaaaacttttgtatatatgttcttagtgattgaaaagccaaagttgaaaaaaaactatgttgaaaaagaatcaaattcaaattcaagttttaaaattcaaattttggctttggcttataagccatagggcaaacgatgaggcccttaactcaatgttctgtatgctgagg

SEQ ID NO: 58072 - DNA, 1269 bp, Oryza sativa
ataatgttggatcttctcagacagattcgcaccagcatgcagtagctccacagcaggcagccattcaaccacagcatcaagccctcacctcttcacaaccactagcacttcctgcccttcctgctccaaatgcgcctcctccacctccaacgcttcaaagccaacctccatcacagtatccaggccatctgccacattcacaagtaccaccggttcctccttctgctccagttccttcggtgccagctttaccacgggatccctactatgctccacctgctcagccgactgaaaccatgcaccagcagtatcaggcccctccagttccacagccacaggcacccccagcgccgcctcagcagtaccaaaccccaccccaatttcctcaatattcacaaccgcctcagtctggaatggttaacccttcgaccccactcccacccgctgcaccccagcagccagaagaagccatgtcgtatgcacctccacagagctatccaccaaatgtccgccctccttcaccttatatgccaccgcctagtggacctgcccctcctttctatgggcaaaaccaaagcatgtatgaacctcctgtgggcaggccaaactctggcccaccaccgtcctatggtgctggcgggtacgggccacagggaggaagtggtttctctgaatcatatggttacagcggatccccttcacaccgtggcaatgcagggatgaagtcgtcaccctcaccttttgctccctcagggccatcatctgggggaagtggcaactatggcaggctccccacagcccaaatactaccacaagcagtgcctatcaattccagcccaagtggttcctctggcaacagggtgccggttgatgatgtagttgagaaggttgcaacaatgggattctcaagagagcaagtgagggcaactgtgcggaggctgaccgagaatgggcagaatgtggatctgaacgtggtgctcgacaagctgatgaacgacagcgatgtacagcagccccagaaaggatggttcggtcgataagttgtgatgcgcatcattggtgctcgatgttctcatttctcagtctgtgtataatactattgaatatgcttgcttgcgcacaacctcggaattcttcagatttttatatggcctggaactggaagaactgaacaggcaattataggttggtttgctgcctgccctcagttgcttacccttggtgaaaacatgcaactacagtcaacaggtgttgttaatgagtttggta

SEQ ID NO: 58073 - DNA, 1051 bp, Oryza sativa
gtttgtatacttaccaatattatgaattgccatataccaataacataaaattcaaattccagtcataataacattgtgaaaaatttccagttgtttaaaatttcatcgagggagaaaaaaagaacgcttccgcggtccgcactcccgacaagcacacctggaagcaacatatggcctctaggtacgtacaaacacggcaatcatccaaatagttatgttcccctcattcctggcacaacaattccacaaagtcacaaacacatggatcatcagctccatcttctggtcatcaatggctgcaattagctagccaatttggcacagtacagtgcactagcatcttgcttttttttttctctctctctctctctcagagaaacctttatgcacgcggtgaagaagtagtgggcccacatacagtgacaggtatcgggcttgttcactttgctactattatcaaccttaccaagttttggcattgtcaaattttggtaaggttgtcaaaattttgataagattgccaaattttggcaagatttcatatgtacttactaaaatttagcaataaactaaatgtagctagtttttttaaaaaaattgctaaataaaataagattgaaaatggtagcaaaatgaacaatcccatcgtaccttcaatccagcaatctcaaacaaccccggcaactttgccaagaggattatcacaattccagggaattgaggacaaaaagaaagtgagaaaacctcggccccgacaagattctatcagggcagtggacagtaagaatgcacttgatgaaccttttcttcctcttctgatcaagccttttcttctttttctcttctgatccgaaatgtaaagatgtccttttgtaaaatcgttgcaatccttttgtaaagtcattgcaatctgtcgtttctggctcacatatcagtgacattagacaagtactactacttttaaagatacggtgtcaagtagtagtaacgacaatagagtatatatggagattgcaataagccaaatagcatgatcccattatcaggctag

SEQ ID NO: 58074 - DNA, 2030 bp, Oryza sativa
tataaatctattatatacatgtaatgacggtatattaaatcataaccatggctttcctgtgttctgtcaataaaaccatcttgagcatattgctgagccccatttgtgtccttcaaatccgtactgtcaaccaactgttatcaatcaagttgatcagcacgatgtgatttctgttcaccttcaagatgtcgcctgaacatatgaatatatgatctccaaatttgaaggtggcaaaactgtgccaaggtgtcatactagggtgacatgcactaatacacaagttgcaatccatcaaagcctccccacaatgtaggcacaggcccaactaggtccacaatgtaggcacaggcccgtctcccagttgggccgcgaggactggtggcccaactttaccaccatccaagctggccgtccttgtcgtttctggtttctgaccctactgttctgatcaagaaaaagaaaatggtttataagcatttctgccgactcgagctcaaaagcttaaaaaaccccggctttgtgtctgcctgacccaccacctgtctgcacgctgcaagccggatcgatgcggatgtgtgtactttgcgcagacacagtgcgccacgcgacgcaaacaggcaggcagcgtgccagccatgtgctgcgttgcctgcctctgcgtgcgagcagccgacgggggggacggggacacagccgcgtgccgtgatggcgacgacacgctgctgccgatcgatacgcgcggatccggtgcgtgtgcgctgtgggtcgtcggggtttaccaaatcggtattggtaggattatcgctacctacgctttaacgttatcatgaacatcatgttattatcatgagatattcttcgagtttaaaaactgataaagctattgtatatgatacccgtgatagatatgcacttgatagtacagtagtgtatagtttcaactctaagatttcgtgtttaatcctaatacacttataattttcttttaaagaaaagttgttggagaatcgtttcatcctctaaatattatttttttaatgataaacacgataatagtgcggttttataaatcctcgctgcagctctcgctccgatcgatggtccctccctcccgtccgggtccggccagccagccatgggcgcagacgccgggtacagtgaaagcacacgcgcccgcacgactgtcatgtgtgaccttgggccagcgtcgtggtggtggtggtgatgaggcgtgtggaatggcgtgcgcatcattgctttttccctgtagagaattaacaaagggcatatatgttaccacaaacctcaaaggatgtgtgtgttcgcgcttggtgctttcttcgaaacgatacacgtcaacaagggactgttgtttatacagtcgtggttgtagccgaatagccgattctagttttaaactactccaaactcaagatttttcctttttaatttaaaaattacacggtacaacgcagacactcacaatacacgcacactcacccctatgaacacacacacataaatcctacccatatgagtatcttcgaaaactgaaccggcaaattctggagagattgacgaagtcaccataggcgcttcgctgtcgacgggcacgtcaactaccactaaaagcataacgccgttaaatcctaaaaaattcgcttccatggggagtcgaacccagaacctcatgtgctactgaggctctttatcctttttaatttagttccattcgcgtaaagcttttgaatcactataagattaaatatataaattattataatttctatttatatttaaggctctattcgactgcgctggctgttgcatccagccagccatttttaaacacggccacattcagacgtgttatatgtattggtttatatataaaaaaaaaacctttaaaagcaccttcgttagcaaatttagctatctcaatatactaaaatggctctctctctctctctaaatattttagttaacatatttgatatctactgtatgagtccttttatctagactctcta

SEQ ID NO: 58075 - DNA, 1821 bp, Oryza sativa
tttgtgataatttcgtcaattatatataggtctaattttccagagatgctcgtagggataagatttcgttgcgagtgcctacatctctgtactgtgtttcttgggaaaaaaaaatctgtggagctagtctaacactcaaactttggtactaccagtgtaccatctctactataagcaccagtatcccttgatcacatcgacaaatgacaactgactactccagtatactccgtacggaagcatgtacatgaagattccctcaagcattgaaagattccgatgcaattagctgtcatataatttcgagtactattaaatttctacgctactttgaaccctaggcactgtacatgggaggaagaaaaattggatacaaggacaccctcctgtttgctccataaaatcattgcaccgacaaaaaacgcaaggtttcacaaggcgacagattgtgttgactagatgcagtaaaaagtaatttttttcgtaggcattagctatagtttaacctagagatttgggtcagtaattttatttcaccattagtcaaactgataagggatttgtcctataagatggcagtatagaactgtgcagttatggcatatggtcaattgctttccattggttatgacttactgactcacactgccaaacccttaattgtggggctgactgctattttctatatcatgtgggggccttattaaaaaatatacaagctgtcaaccaacaactaaagcaaaaccacaaaaaaaataattctgaacaattgaatcgttaaatgagcaaattttcagaggttctcaaaaaaaaaaactcagatgtagacacttgggttacccaaaaccataaaatatatggactaagttacaaagatcttaagaagagtaatcaattgagtccaacaaacagcaatgatcaagcatctctcatctcaccaaacgaatcaacaaatgcagaggataccatcacaaatctcattaaacacgtggtcacaattagcatagatgaacttgcaataataaatcaattaaatgcatcccccaaattatcactaatcacccccttcaaaagtcactaatttacaaatttacaaatcagtccattctcacatcaccactcaccaacccgaagcgaccaaccaagaaaaggaggaaaaaaaaagatcccatttttatataaaagcccctgtctccgtctccgatcagctgcaggagaggcgaggaggcgaagcagcagcagctgaagcgagccgagccgatccctcctgcccctgctcgcctcccagatctccccgccattgccagttccccgccaagattcgcgcgcccttctcccagatccagcttcgcctattccgaattccgcgcaaggtgaggtttggtggtggctttgacccgggagagacccgtttcttggcgtcttctttggtgttctttgcttcgattgctcgatcagaatgtgttctttgtgattcgcaggctctgtcggtggtctgattcggcgggttttggttggggaattttggtgttcctgctcggttttgtgcttgctgctggttgtggtggttcttgggagcggtggagatgggggtgacaggggagaagttccagctggggacggtgggggcgctcagcctctcggtggtgtcctcggtctccattgtcatctgcaacaaggccctcatgagctccctcggcttcaacttcggtatgagatccaatcttgtctcaagatgctttagcttcactagtacttggcagtggctgttttgttggatgcttgtgctagatgtatagcttgtgtattgcgtgtagagac

SEQ ID NO: 58076 - DNA, 7615 bp, Oryza sativa
tttgcttattggaatggatacgtcaagttgaacaagctgtcctgagcttgaatgatatacaacattatagtacttttatgattcaattattgtaagaccgtggttctaaagtgtgtgacaatactaggtaacgtaaaaagttagtacataaatagacgtgtttcctgtccaaattactcaacttcggtctgtgttttgcagccactactttgacaagctggcatctcctcgttacattttgctctcttcacgtggcattatgtatgaagctctttgagcacaaaccttttgatgcaaggactgtcatgggatttggtgtgctcaatggcatttcaattggtcttctcaacttgagtctaggtttcaattctgttggtttctaccaggtaggcattgtttttgctctgtcctgatcaaaacttaacaggctatcatctggtagtgttgtacttaatgtccttctaattgttggtacccctgctgctattttttcactcacaaacaacggcttaacaaagagggtttcagttaaacttattgcatgttgtgagatgcagttatcactccaccttgcacactaaccactgcaccaaggtcatgctaaaatgctgaatgctctttgttttcagatgacaaagctggcaattatcccctgcactgttatacttgagactcttttcttcaggaagaagtttaggtttgtatttaatacttcatgtcctttattcagtttgataattatgaagtttgtatttaatacgtcttgtcctttatgcagcttgagaaattatcttctgattttttttttatttttggctttactgtgcagtcggaatatccagctctcccttagtgttctcctttttggtgttggagttgcaactgtgactgacctgcagcttaatgctgtgggatctgtcctgtctttgctcgcaatcattacaacctgcattgctcaaatcgtatccttttgacagcaagtgatattttcgtttatgaaacgttatatgtttgccaaataatctgcacatcaccatctaaagaaaacagtccacatgtattgcacatgtagctggtttattactaggatagatgttatagtgtatatttattcatatatacttcttgtgcacaatgctgaaatcctgaagcaccatttcatttgagtatagtattgttctatggtgtctgatttgaatccttaattagctatcagatgacaaacacaattcagaagaaattcaaggtatcttcaacacagctgctgtaccaatcatgcccataccaagcattgaccttgttcatcgtcggccctttccttgatgggtttttgactaaccaaaatgtctttgcttttgattacacatctcaagttgtggtaagcagtaaactgagttttggagacttatgttgaacgtagctgtgcttcatctgactcggttctttacggtatctgcagtttttcattgtgctgtcatgcttgatatcagtctcagtgaacttcagcacttttcttgtgatcgggaaaacctctcctgtaacttaccaagtgcttggccatctcaagacatgcttggttcttgcctttggttatgttttgcttcacgatccatttagctggagaaatatacttggaatcctcattgctgtgattgggatggtatcgtactcatacttctgcacaaaagaggctccaccaaaacccactgaagcctccccacaactcaaccaggtacctagtttaatagttttgtcttgtgtcttaacactggatattcttgtcatgttttgagcagaaaacattctctatagttcgaatatcaaaatctgatgaatgttgtggattgtgatttaggtaaaagaaagcgaatcggaccccttgatctcggactctttgagcactgctgaaaatgggggcaacgcaggcgacgacgaggctctgaaggtacctatgtggagctccaagtactcaaaggcatgaagaaactgctctgatgatactagtgtatggttctatacagagttcagcttagtaggcagatagtactagggttggaaggaagccaaccctgagtgtaatgaacgatgtctgttccatttttggtcttttttttttctttttgcttaccatgtggtgctgtcagtaaatgaaatctcactttgaagaggaaattatttacctctacactccagatggcagattggccttaaagctagacacaaaagggctagatctctttgtaatatttttcatgtgttcaacttcagcatctgcttcagcattgtaacaacttgccagcaggacataatatcaacacgtagtttacattcttttttgtacccgagtgccaggtggattcaagtttgtggtgaaagatgatttattttgttaaactttaattatctctagtagcatgagatgaaaagaacagcgcgggccgcaacgtttcgcttcggcaaatttgcaaacgaaaaataatttgtgaataaaacttttatatacgtgttcttagcgatctaaaagcaaaggctgaaaaataaacttcgataaagaaaactccaaatcaattttaaatttaaggttgaaaattcaaattttaactgatacgcataagcataagcgaatagacaagaaattcaagaatcacatgcacttcaactagagaaattcttctctcttttcaattggatgttcatatccagaaatatgtgtcctgtgtatacatagttatctgaatgcaaaatatctctgagaaaagattgtgaaagttgttatgaacaaattttcagtatgaacaagtataatctctatctggttgcatcagtcagagtaggatatgttattgttcttactagtactcacatgaattaaaatagctatagataaaactatggtgctgaatttattccgaatacacacaaaatctaacatttctactcaaatcaaatagcaaaaccatcacaaatctaacattttattggctcaaacaaggagaaaaaaatccagctgcatcaaaatctagttcccatggtggaacagctggagcgccctcgccgccgtcatcccgccggggacctcgacgaacagcaggatccccaccgtcgccgccgcctcctccaccgtgtccacgcccatgtccctcagcggcgcgaacctcgccggcggccgcgcgtccgtgccgagcatggccgccgagaggacctgccacccgttcacctgcttcctcatcgcggtggtgatggcgccgctcttgctcgccgccttggggtgcatgagcccggcgaccagcctcgacacggtctggaaccgcgtcgcctcgtgcaccatcaggagcagcgccgccaccgcgtccatggcgcgccgctgcgccgcgccgttggcgaggtcggccggcctgcgcgcggcgagcgcgttcaccgcctgcgccatctgctgcgggccgagcgtgacgacggtgagcctgtccgtgtcgccgaggaggtcgcggtacgagccgccgaagccgacgtaggtggcggcggcgccgccgggggcggcgccgaggatgcccggggtgagctcccaccacctcccgtcgctgctccggaatccctccaggtagaggttgtcggcgcgcgtggcgagcgtgagcgcggcggtcggcgacgcccggagcacgacgtggaaccagcggcgcggcggcggcggcggctccaccggcggcaggacggggcggttgcgggagaagtgcctcgggttggccaccctgctgcggatgccggcgatgaagtcgccgtagttgtcgccgctgctcacgtcgaacgtcacggtgaagagcgggttcaacgccatggccggaagcgaaactgacaacaaaagtagagtgatttctgaactttcggacaagatgatgaattgatgatattgcaatctcaatgagttgggatgggagatttataggggaaatttgcttgcgtagtcaaaaagaaacaattctttgtgcttactagtcaaaacaaaatggaatttttgctttgcaaatgcatgtacactgagatacagatgaactcatgaacagatcagaatatcatatcatgcctgagatttttgttccgtcaaacaaagaagaagaaaaaagaagactgagcttagactgagtcgcgagactgcctcaaactagaaataaagatgagcaagataaggtgctggtttattaatgcaggggtcagcggctgctaatgtatgacacagtccacactgacaggcgtcacagtcacacaactaatatactgctttcgctataatggcaatggataattggatatgctgtagaaagatcagttcaagaaaatggtcataaagttctgttcagtagtatggttacctggttcagacattcaggctgtccaaaattcagataaagaaccctaatggagtacaagttatcctttatatcaacattgtcagatcggctcagtagcaaaagacaatgcaaaactagcaacaatcaacatctggttgcttcaaatagagtaggatggcttgcagaaatagtactaactgaaatagcaagggcaatttcagatgaacaatcttgattgcttgcttcaagagatcgcgacgccatgggaaggggagaaggtccaggaggaggacgcaggccacaagggtcagggatcttgcctgctcctgctgaatagcaatgccagtagcgttagacctgaaccttccattacattacagtcaccactcaccacgcatcgcaagagcgactccggccaccgctcttcgacggctcaaccatcggtggccacgtatgtgcccaaccttaccaaatggataataatgtggccctcaaaccaaaggccgcaaaataggcccattagcaacccccaaaacaaacctcgctacagacagatgggctggtttgtataatgggccgacacgggattaccacgcacgtgctgaatgtatataaatgagccggcccactaagcccaatagactcacccagtagccattatagccagtaacaagctttttggcgggagaagcgtctccgcctttgctcgttcccaatttacccaacgagagagattggtggaggatggtgtgacaggagcacagtatttctctcttcgttttcatcctaatcgtacactcgtcttccacattttacatcacttttttttcttcgcatgaaatatccggctttataagggcctccatgtaaactattggctgaaatgtactattcgggagggacctacactgaattaaacacaaaatggaagggtttttttttttgcaaaatttccacgccgcgcactgttcctatccgacgtggcacgcgcaagcagccgcgccatctgccaccctttatgttttttaatataaataccaatgtttgtgtattagaaaagaattatttatgggtaaaacttttacatatgtgctcttagcgacttaaatgccaatgttgaaaaataaacttcgacgaaaaaaacttcaaaatcaactagccacatagtcgtgctttgtgcgacttttgatcccgtttaaaaacttttgtattagtttaacttatctttcaagaagacaaaagtgaatttatttaagcctcctgttttttttcttcattgtctttgccccctctctctatttgtatcatgtgtgtaagagaagacactagaaacctccaatatgcttgtccgtttgtgttttttcattaatgcattatgcatgtacccttttgatctaatggcatttgtttatctaaacctctttatctgacaatcaatatgttttgatgatgtagcacatcattgagcaagaaagcttgctgcttagcttgtactatataagatttcaaaattaagttttacaatttaaattttggcagcagctgatattgtatagagaaaatgacggggcctaaagaaaccgctgtaccaaacaaaacggatcaactgagggagaagtacgagggaatagaaaagattaagtcaagaaatatgggagaagataaaagattaagccacgtatatctcatcatgttgtaatacgtgggtaaaaaataaagaaaatgatatccctttctcgtggatggcagagaaagaaagggaaactccatacgaaggcgtgacacgagccacacaactgttagccgtcggccgaagtcatgcgtgctatgccaaattaacgcagagacctgtctcctactctcctacacacgttacttaatctctcgaggaaggctgaattatgagtgacgtgacgcagcatggttcatgatgaacatctattttctctatcctaaaatataaatttttttagctagacataacatataccaatacatatgaaacatacatgtctctccatccaaccaaaattttattttgggacgaagagagtagctactatacttgggattgataaattgggatatggctctaagcatctggctctttcaattccttattattctctccgtttcaaattatttcacttactaggttaggtttgttcaaagtaaaatattcaaatatttaaccatcattttttataaacttatacagtttaacactataacatttatatttttagattcaacattcactataaaaaaataattttttatggtgttaccctataatttttgctggcgaccatacgcgaaaactgccaacaaaaacataacaaggggtgaggggctacggaccgccagcgaaaaccgattatcgttggtggccacgctaagttgtcctccataaaaaaacaactatatttttcgaggcagacctcttaaatattcaccagcatttttttgctggtggttggtaaagaggaccgctgcaaaaaaaaaattgaggcgaatatataaaatccaccgcccctaccgcccaccaaactcgcctctctcactcatctatctctcaatctctcttcctctctcccttctccctcagtctctcctccccccttcttcggcctcccgtctccactgctgccggctaccgtcgccaccaccgccattggctaccgtcacctctcccgcccaatatctctgctgtattggccaacagggagggcctcggtagcggcggcagggtgcggcctactcctcttcgccgctggccgccgtgagctcggggctagatccggccgccgcgacgatgggggaggccggatccgccaccgcgacgacgagggtggctggatccgccactacgataacgggttaggccggatctgtcgctgcaacgacgtgggggaccagatctgccgccgcgatgacgatgcgaccgccacagggtcgcgggaggggcgcaagcgctggatcgggccgcctgagggccgcggtgaccctaccctcgctcccctcccctccttcctctccctgatctggccgtagagagacggcagcttaggagtaaaaacggagcggatattatccgatccgatccgctccgaatccgtccgatgtgaggatatggtaagggtttttagatattcggccagatgcggatgtagatgtggattttgtcatgcggatgcggatgtggtatgaacgatatccgacggatgcggattatccgatattttaatcggattatccgatgtactgtttgg

SEQ ID NO: 58077 - DNA, 3752 bp, Oryza sativa
  unsure (1)..(3752): unsure at all n locations
ttcaggcccacctagctagcccaatagcccaacccggcctaacntaatcctctcctcatcccccagatccgtctctggctctctctctctgtgccgtccctcagccgtcagttgaggagtcggagagagtagcacggcggcacagcgcgacggcgaccctacgcggtggccactcctccccaacacgcgccaggccgatcctcctccccaacacgcgccagccgctcctcctcgtctagcaccgccgctcactgctgtgtgttttgtgctgtacgcctgtactactactgatgtatgcctgtatgcagtatgctgcgtgtagcactacataggggtgctctactgctctatgcttgctgttgctgtatgcctgtatggcttgcctcatgccgatgacttttatttttacattttaagcaacgtagtgaccggtgaactattgaattgaacacttatatatatattatgtttttggtggatcatggatgtatcttggattattttgactagtgaactattgaaatactattactattgaactgaacgcagtaaactaatgatgttttgccatcgtattggggctaattatattgccgccctcttgttgaatggattgaatacaaacttgacatccgataactttttgtccgtttccgaaccgagtctgcaccgaatccgacgtccgaaataatccgctccgcatccgcatccacacgtcatccgcacccactccacatccgcttaaaaaatatggtttaggctatggtatagctattatccgtccgaatctgctccgttttcacccctagacagcggcagtagccaagggggtggcttcggtgacaatgacaataacctccaaggtcgtcggggatgacgaagaccaatgtgtatgtgttgatgtttgtatgttgaaaatgctgtgagaaattaatctagatgtttggacttttggatgctgtgagaaattgatgtttgcatgttgatgtgaatcaggattggatttgaatctgatctcttgatgtggatttaaaaattgaaaatgcagcaatgtttttgaatgtggatttttttttgctagcggttagaaggcaactgcatgtggttattttcaatcttttttgcctcaaaatcaattatcgctggcagctagcttaccacagctgccagcaaaattctcttattgttggcggctgtcgatcaagagcgtatttccgctatggacctagctggtgagattcttcggaagagaatgggagacaagacattatacaggttcgggccgctatggagcgtaacaccctactcctgtgtgtcgaattaaacttgtgctgttacaagggagttggctcaagcttctcaagtggcgttttttttctcggtgggtaaggtcctccttttatagttcaaggggataccacatgcaccgccttacacaatccatcattgggtgggggcccacatgtcttgggtcaagccgttgtccttgccttcaaccagaaccaaggtggttgctcatcctcaggtgggcccagcgccgtcccccgccttacaggggggacacgcctgtcattcgcccttaattcgttggcgactttggtggactccatacaggagcagcacgctcaccgacgtgccgatgggacaggtcttatctgcccccactccgcctgacaccgggcgggacgtgggtacgctgctatccgtcccgtccgcctgttggccggtcacagaccgatcaagcccgattgacgcacatcaatcggacggcgcctcacgtccgcccacgccacattaaatgcggcgggggacggttggggcgatgcttatttaaggcgcttgagagcacccctctctccgcccactcggccaccatgtggcagccgagcgggggccttggggcagcttgcccgagggccccgaggggtgcggcagggcatcccgaggccccttggccgcttcatgaccgcttgttttcccccccgaggggggggggggaaggccgtgcggctacgtggccggacggaagggctctttctctccatcttgcgtacccccgggcccatatcaccaacagcggtcctcgtatggctgccgccagcaaagataattttctctgacggcagccttaagccgtctgccagtgaaaacatctcttctctggcggttggtcaccgccagtgaagatgctttatcttcactagccagcaaaaatgtgttttggccgccaaaaaaaaaaccatttgtgtagtagtgattataaatatttttataatatataattcacatgttgttaaactatactccctcctttctcgtaaaggaagtcgttttggacagcgacacggtctctaaaacacaactttgacttcttgtttttataaaagtatttattgaaaagtgatatatgtatacttttatgaatgtatttttcaagacaaatctattcatatattttttacatttttaaactcaataacttaagagttattcatgatttatattactaaggtttgacttaaatattgtcataaacgacttcttttacgagtacggagggagtatatattttttaagaattcatggtaaagatatatatgttttactcaatacaataaaaagaaaaataatttgaaacgaatacgacatcctccctgttatactcgttactactccatctgcagagaattagcattgtacccatgcatgccgtgcatagaacgttgcgcatgtctgtatgtagcgatggaccgaatctatctatatctacgacaaacaggcacaataatttcaaccattggattgacaaatctttacagaattaggcgaaagtcccctccgattccccccagtccccacccattaaacaacatcattaatctctcctccaccattaggaccctttgaatcgcaggaatggaaaaacagaggaatagaaaaaaacgcaggattctgacaggaatatatattttaaaacagaggattggaaaatacaggaaaaacacaggaatgaccgtttgattggaccacaggaaaaacgcaggaatcggataagagagatagactcaaaggaatttttccaagaggttggacctcttgctaactttcctccaaaatctctataggattacccattccatagaaattttaaaggatagtataggattcagtcctttgttttaaagggtttcatagaaaatttttccataggattaaaatccttcaaattttctacactttttttacaaatcaaaggagccctaagtatcagatcatttttagcttaaccatcttccaatcaatgcatgtagactactggtagtacttttccatctgccgctttgcaagatttaagaaacaccaagacatatactccctctatactaataaaagaagtcgtttagaacaatgtttaaatcaaaccttgagaatataaatcatgaataactctcaagttattgagtttgaaaatataaaaattatatgaatagatttgtcttgaaaatactttcataaaaatatacatatattactttttaataaatatttttatagaaataaaagttaaagttctgttttggagaccgtgtcgctgtccaaaacgacttcctttacgagtatggagggagtataaaccgtcgaagtttttttctaagaacttaatatattagaagcacaaaacgtgaacggatacatcttcctctgcccagggggcagcaagcagaagttgtttcatatgtagcctcggcata

SEQ ID NO: 58078 - DNA, 1621 bp, Oryza sativa
aagtatatttaacaataaatcaaatgataggaaaagaatcaataaaacgaatgatcaaacatatttagaaaaatcaatagcgtcaaatatttagagacggatggagtagcatatagaggtgcaatcgcctttgactacttggcgctaccgcaagagctgggcgcgtggagctacaacgcgaagaaacgatagaagcagcaccatcaacgataaattcaacgattacttaaaaaatataaaaaataaaattacagccctatataactaaaattacatatgtaaattaagttgatatgatatgtaagtggattgtaattttgataaaaaagatgtgtaagtaaatatgtatttgttattttttaaatataaaattacagtcctatataactaaaattacatttgcaaattcagtcgatatgacatataagtgtactgtaattttgataaaaatgttgtgtaaataaatatgtatttgtttttttgtccgttggatgtaaatctaaagttggaaaaaatttggatgatttttttttctagaaatcacccaataaatggatagtcagatccataaataaacatcaaaattatccctaatcatataagtagcaaagtactgatatagccttataaatcaacggcttagactattctactaatagtagagaacaccgaagcaacgactggctggccgagttgatcttctgtaatccagctagcaacgtacgaatccgagttggcgagttatcgtgtataagaatgtgcgagggtatgcggtagaatcctccgtccatacaccgatcgatacaccctcttacgtatagcagactagcagtaaacccaatcaaactgctgtacttgctagttgctactccacaatgacccgttacaagccattggtgttgccgttgatgctgatcctcttacacacccagctcattattgtcccttcttcatcagcagctacgtacgccaaccacaccggagccctgccgccggcggttgttccatgcttgccggaccaggcatcggcgctgctccggttgaaacgttctttctccatcaccaaaaactccagttccacctttgggtcatggaaggccggcacagactgttgccattgggagggcatccactgcaggaatggggatgggcgtgtgacgtctctggacctgggagggcgtagattggagagcggcggtcttgatcctgcgatcttccatctaacctccctcaacctcgcttgcaacagcttcaatggatcctaactcccgcagacagggtttgagcggctcaccatgctcacctatctcaacctctccagctccgatttcgtgggccaggtacctaccgctagcatcagtcgcctaacaaatctagtatctctcgacctatctactcgatttgaagtagaagaattcacacaaggtcattctgtgttgtcctttgattcagttgaatctagcgtgctcaaagagccaaactttgaaactttaatcgcaaatcataaaaaattgagggagctctacctcggcgctgtggacttgtccgacaacgggatgacatggtgcgatgctctatcctcgtccactcctaaccttcgggttcttagcttaccaaactg

SEQ ID NO: 58079 - DNA, 2673 bp, Oryza sativa
ttgtctgcacagagttgaggcatcagcatcggctgcctagaatagctggaaaaagaggctcgttgagccatcaccgaacgaccggaggtctgctggtttcaccaacgctctgcatagcgggcatgtccgctccctctcggtccggccattgttgttcaaggttggtatgaggttgatagcattaagcataagatcggtaaaagatgcgcgaggaaattaaaaaattttcagtggctagaagaagagggtgcaagatacgatgtacttaccattcagagacacaatccttgcaaaagatatgcttacagcgcaaaagaatgggagtatgcatcttttcctggcatatagcacacatatctccagtagcactaacctgaacagacacacaagagtcaagtcaagaaaaatagaaaatagagtgtgccaaaagtccactatgcaatgtccatgcaatcttatttcacaggtcatcattactctagacattcagtgacagtgatagccaacaactacttagtgcttcaagcatataatagattacctgttcactagttgcgtatgaaccgtaatggaagtctttatgagataacgctctcaatgctgtcaaaaatgattgaacctgacaaggaaacagctggagttttaggaggcactaagtatcccttacgaaactaaataagggaagttacagtaccttttccacaactgatgtcaacttgaaagtaaggtataatccagtggttagagacgaaaataggcttccatactccttgttcaggaaaaatcggtaccatacaggagcaggcaataatgctcggtacagaagtagaaaatattccacaactgttaacatttggccctgagcaaaaaggaatgattgattactggttgtcagaaacaaataacactgcacctgaagctatcaggaaacggcacacaatgatagatcacagaaaatatagtattcaaatgcataaacagcatacctgcctacgatagctacgccctttgctgttcttgtagtacataagtaacatgcacttgatgatcatagcagtttggcgcaccattgtatctgcataaaattggaaggaaccacatgatcaaaaaccttatgaagttaagtatcatttctaaattctaaatacaacatgactgatttgacttaaggcatcctgtaaatacaaataaccatgcttcaggtataaggacatgatagccacttacaacataaaaaaaatataatttatttgtatgagagtggacatttgagcccagttcacaaaatgaaagggctcacgtgccaaaaacttaaaggccttcagggtttacaaacctttctagctctaaaacataaatgtgttcaagcatcatatgaggagaaaacatgcgatctaaaacataaatgtgttcaagcatcatatgaggagaaaacataccattcaccaaaatgatgaatattgcatgccaaaacggtggaatttcttttggagcaagagccaccagaggtcgtacgaggtcaccattcttgtaacaccagtaaactccaaatacatgaacaacgaataatattgtgatcccaacaaggactgacatttttctctccccctgaaccaaaaagacaaatatcaatgtatcatatgtaagtaccacattgtttatataaacaaattgaaagcaattaaatccacataataatgtaacttctgatcatgatgggaaagccaggaatataaagatacttgcaattctctatataaatagcattgtcaacaaatctcaaaaatcgattagatggtgcagtaaacactcaaaaacaaggaatatctgatttgtatatgtaaataaccattgtgatttcttgacagtataacagaggttacaaaccagtaaacaagtcaacgtcatatccttggacagcagcacaaatataagtacaagcacagcatgacattagtgacagattgatgattggtaatacacaaacgtgaaatgagaacgtgttcggatatagaaaatccatgaaaatgccaaataaaacttagtggccaaaaagctgtaagccatattaccatgaaaatgccaataaaactatgagcggccaaaaaacgtcatattaccatcactgcatcacattatttagagatgatctgcaccccggatattttcattaaaacgaactaaatctaagggagtgctttagacatccaagtgtcacaattaatctatttgtcacttaatattccagcagaaatctacaggtaaattgatccaaatgttcaacaaacatgatggtaagtttaccttcaaagcagtttgcttgcgcaggatatcattagacttgaacatcacggcggcaatccaaatcgtcacgaagaaacctgcacgacacaatccaaagcaaaattagcccaacatttcacaaatagattaatgcaaccctacattcagcaaacacatggtgacgtatatttcacagatagacgaatgcaaatcatacatgcagcaaaacacatgatggcatatcaatttgtgcttgtggatgaggtaaattaaagggggggggggggggaatgaccttgcaagtgctgcctgatgaagacgacagcagcagaagggagaaggggagtatctgctccacccacctcgccacctgctgtatgtcgtacctct

SEQ ID NO: 58080 - DNA, 1345 bp, Oryza sativa
gggctggggcggccgctggacgcggccaagaacgcggcggcgaggtaccgggaggccgtggggctgcaggtggaggcgttctggaggcgcaactacatgctgctcgtcggcgccggggcggtcgtcgtctgcatcgcgctgtggagggtcatgttcggcatcgccagcaccttcgtcgggctctccgagggcatggccaagtacggcttcctcgccctcgccaccgccatggtggcgttcgccgtgagtgcgctcctccctttctcgctttagctgctatgaactataacaagctatgatagaatgcgcatgcggtgattggtgaatatattctacatcattgtggtatgaatgtttttgtaccttatgactgtctaatgcttaattgtatgcaccgcttctcgaattctggaacttcatcttgatgtttatatcaagcaatacattttttgctgatcatatgaaccgccagcatacctcaatgtagcacttaccatgctaaatatgtcgacactttattatcctgaaatatgccactttgtctgaactaccacccgccttgagcttaaacctcgggttaccaacttaccattagtctattagttttattataaacttaactttggttcacctgagaaccagattcactatttatgatcatagttttgattgaagaattgttacgcggaaatgctttaatcatacaggaaacacaagtacaacctaaaaccttgaaagatgatactctaataaaaaaaatcaaatgatttctagttgatcatgcaccaaagtactaggtaggtgtgctttcaatattacccttgtcttaatgttcttttccgatccgtgtaacatgaacaatattgacttgtggtagactggtatattattttatctaccgaggtgtagcaacaatatggattgcagagaagtatgaagtgaactgtagagatcttgctaacttggaaattatcagaagtctagtttatggtgaacattagagctttatgccactttccatgatcaactttctgtagaggaaacaatgactaactttttttgtttgcctttaagttgtcttatcattttaaatgctcataacacggtgctaccgtcaatctaatatttttagtgcaactttgcttgacagatgcctaagttttgggaggagcaactgatttgtattgtctatttttgttatagggcatgtacacacgctcaagattcaccataaatcctgataaggtttatagaatagcaatgacaaagctcaacacatctgctgcaatccttgaagtcatgggtgcacccttagccggtactgatgtcagagcatatgtcatgt

SEQ ID NO: 58081 - DNA, 1122 bp, Oryza sativa
  unsure (1)..(1122): unsure at all n locations
nnnnnnnnnnnnnnnnnnnnnnnnnnnnnnnnnnnnnnnccagctgcttcagcccaccaagttgagatggaattggcccagtaaggaagttatgtgacatatttatcccatgagttaaaacaagttccccaacaatttctgggatgctaccattgaatgcattattggagaaatcaatgaatacaagggttcttagtatttgagcaagtgtggtgtcatgacctttgtatgtgagtgaggctttatatctatatactagtcctacacttggcacagcatgatccatgaccaatgatgtatttgtgtctatatgtagcatcgactccaacttcttaaaccacttgtctttgggcaacggaccagagaagttatttgaggatatgtcaataattattgcatttggaaatgcacatgtgctttcttcatcggtgagagattgaacgacatgtccaaatagcttattggatttcagtacaagcacttggagtctacgaagtttactcatccagcatgggaaaatgtcatttatttgattgttcccagcatcaaggatctccaaattttgacaagcaagtagggatctgggtagctgtccttcaatcctattgccactaaaatatagtgcatgaaatgagcagccttcctttatagtatctgggatctccccatcgagttgatttgcatttagatttaatatttgtattccattaacgttctcgatcaaacaagatggtattgagccactaaagttgttgttagagagatcaaggtattgtaattcagttgcagtacagaaagatggtgggatttctccggagaagttgtttccaggggcattgaaaagtgtgacatgactaagatgggcagtgaaattaaaaggaatcgatgagaacatgttgtttgagtaatctagcaatcttgcagaaccttgaggtataggtatagtcccctcaaacatgttgttgctaagatcaagccaatcaatttgtaaaggaataaaagggttagatccaacactagtaaatttattatgtgtaaaatcaaactagcaacgccagaatcattccaagactcccatgcccacgatggtatagccccatggatttggttttttgaaaggtc

SEQ ID NO: 58082 - DNA, 3242 bp, Oryza sativa
tagatgttaataaatttagacacatatatatgtttagattcattaatatctatgtgtatgtgggtaatactagaaagttttacattgtgaaacggagggagtactgcattactatataaccttcgaattctcattaacttcccgttgtaggaagtacctttttctttggttctaatcgaggctaaaacaatgcaaacgttgcattatttaatacttgtataattttaaaatctttggctatgaataacttctaaaatatgtatattagaaatatgtagattgttttattaatgtatagattagttttaaaaagtacattaataagatcatatatttcttaatattttatatatatatatatatagaaaataatggttaaaattttttagattgtgtcattgttcaaaacgacaaatattaggaacctggatggtagtaaagtacgtacgtacatgatgattaaatccgtgagtatatactacgtacgttggtcaatatgcagttagttaggtgtatgttggttgcatagagcgatgtttttttaatatagtttataccttgtatttgtatacatgaactctatgagcacgcgtacgctcgcaggcagctggaactatttgcgaatgatgatgagatgaggaaggcactgtggtagatattcttacgagtagtggcaatgtcaccctcacactttttcttgtactgccattaatcccgatttgtccttatttatctgtttactttctccctcgctctctctctctctccccccatgtcttttttgcaacaccataatattcttcaactctcactccatcattcaatactgggccttgctttttcatattttgttgcctctacatctcacctttcccttgtgctgcagttgtgtatagtaggagaagctgatttctatatctctcttcccctctctcctaaagatcactaccagaaagaagtcatgctctcctgcttgatcgtatgctagctcatcctacagacaattctttgattcgtatccaaacagacaagattattgatcttgtttcattttccgtttctactgtttctcctctattttccattctgcagcttggatatcagtggatcttggaagaaacaagcagcaactaagaaaatctccacatattgctgttgtctttcttcgtcagatcatcagatctatcctcttcgaccacaaataggtaaggatgagcaggttttgactagctggctagatccacctgagggaaatttgagaaaaaaaagagcatgattcagtctctgtctctcttcccttaggtactaatatatatattaatatctattcgagctctttgagatttgagcaaacatcaggttgttttcgcttcgaaatttgtgcttttcttgttgagagtcgcacacatgtgctcatacagtggatcattgtccaagcatttgtttcaatcggaccattaattctcatcggtacctatttcaaataattctacagcataaaatctacagtttcaatgtccccttgtttttctatagtttttctgtaagaaaagcaaagctaatttccccatttcttgcctccaaagtttttaaaagatcagatcaaaacaccttatgctctgaaaccctatcctccgcccatcttttcagtacaatccttgctgccatgaaaaccctaaccctagaagaagttgcacaaatactcatgcatttgtttgagaaataactgacaatttcagtaccattcttcaatttgcaggtgtagctagctagctcgccggaaatggcatcctcgtcgagcaccagcaactccgccatctcctcggtggtcgcgtcggcggtggccacgacgacgccgggcgccggatcgccgtgcgcggcgtgcaagttcctgcggcggaagtgcctgccgggctgcgtgttcgctccttacttcccgccggaggagccgcagaagttcgccaacgtccacaaggtgttcggcgccagtaacgtcaccaagctcctcaacgagctgctgccgcaccagcgggaggacgccgtgagctcgctcgcgtacgaggccgaggcccgcgtcaaggaccccgtctacggctgcgtcggcgccatctccgtcctccagcgccaggtccaccgcctccagaaggagctcgacaccgcgcacgccgagctcctccgctacgcctgcggcgaggtcggcatccccaccgcgctccccgtcaccgccgccccgaggctcgccgcggcaatgccggcaccaggccagctcgccgccgccgtcagtgccgggatgtacggcggcggccggaggctcggggtcatcgacggcggcgggatagcgccgccttccccccacacggccgggtgctactacgcccgcaacaacaacgccgggagcatcggcgctgacgtggcgcccgtcctaccttacgcttccgtggctaattggacagtgaacgccattagcaccaccaccaccaactcaggatcagagagcattgggatggatcacaaggaaggaggagacagcagcatgtgaattgaagcgcggcaaatagtaagtaacatttgagtgaatttgttgcattgcaatcatgcacgtatatgcatctgttcgctgtatgtatgtgttatcagtgtgctactactacttcttcttcagatgtggagatctgcgctttggccttgatgagagaggatcggagaggcttcaggaagatggcagcccattcatcccaggttaattaagagttaagaagcaacctatctatctatctatatatagccagcatgaattatatatatcatctccccgtccctttttgcatgttgtgcaaaaccatactttggagttctatatgtaatcgaatcgagatcttgatctctcgtcttttcatgattaattcgcgtttttcgcaggatccatcagtcattagtacgtagcatgctttgtgatcagaaaataaccacctttaggccgattaaacaatgcaccgaacacatctatcgataggtgaaaagatcctgcggcttgcatgcatgcatgagtaccaagctagctaacttggttgggctaattaaaggctacatgatctgcatcttatatcatatgtcataggcaccagtggcctatatgtttgcatatatgctccagatatacaccatcttgagatgcttaatagtcttgggggaaagattaaaacagttgtttattgagagcatcacatcgtttggtttgaaga

SEQ ID NO: 58083 - DNA, 725 bp, Oryza sativa
  unsure (1)..(725): unsure at all n locations
agaggagtgaacctatgattcctgcaccctgccccttagctcttcttgttgctgcggctcatcccgatcgagaggtaacccacttgcctacacccccataaaaacgttcgttagccggttggtcaaatggaaacttttgcacgactgtcatatgaagcttagaggtaggagaagacatggcgatggcgaaggaacttactgttgcgtatggccggtgagacgtgcagatgatggtgattggagacgatgaaaggggaggagctccgagcgggtagaattgctcggggtcttcttgctgggtggtgtggttggacggagaagagatggcaagtatttatagggggatgagatgggtgagggtgagggggaggtcaattggttttctttaatgcagcattaagagtatagcagtactactactacttcatgtactagaggctaaggaaggacgcattttattaccaaggtattcatggctggagagtggcatggtaggggttgaataatctgtgttgggtgggagagaagtgcgaggtgagaggctttatggttggtcatatacacaaggcaaagaaatgtttttttttcatttatctgaaagaagaaaatttccagtgatgaatcttctctttttttttcttacttcngcggtagttttctttagccacatgctagatgactgtggcaatctcccaacaatgagcctggttgaaaattgtaaccca

SEQ ID NO: 58084 - DNA, 2130 bp, Oryza sativa
ctgcagccccagctaactgcatgtcctgatcattgtctgaactaaacaagatttgccacaaaactgcagctgcacataactgcatctcctaatcatatctgaaattctgaactaaaaacgagatttaatctaatttgcaacactgagtccagcaacaaatctgcagctgcacaaaaagtgcatctcctgaccacgtctgaattaaataagattttgctttgtcactctgaaccagggaactgacatcgtgtacgacaccttcctgcggccgctggtgatgcagtaccagcccaacatcgaggagcggctgcgctacctgcgtgccaatgccggcgacattctcatcttctacctcaagaacttcaccgataggggctacgatctcttcctccgggggatggagtacatccggtcccagacgtcacgaggctcaagaacgagggtatgttaccagttactctctgtcccatatcgtaaggtgttttagttttgttctaagttaaaattctctaactttgatcaaatctataagaaaatatattaacatctactctaccaaagaacactatcaagacatatttcatagtgtattttaatgaaactaatatgatattgtagatgttagcactttttcttttacaatcttggtaaagttagaaaagtttacctagcacaaaagtaaaacaccttacaatatgaaaacagaggaagtagtagtacacatgttgggaaccatggtcatcacaggattccggaaatgtaacagtgcagtcaaagaattcaagatatgtaacagtgcagtgtgtaactatgttggcaatggtttgtttctgctgtgcagcggtggttctcgttcggaggcgaccgggcagagaggtcgagctacgttgatgattatgtcgccggcggtggcgatcggaggagcacggcgaggcaccggcgaccccgcgacgattactaacgggctggaccggcgccatagggattcagtagagagaggtgcacaggattggaaactagttgattaggagtgacaaaatttaaaaggcccaaagcaaaacttctcaaaaacatgatgtgtatatatatatagacaggtgatcactgatccatactctggtatatatagctcctcacaatttggcgttgcaggttggctagtttgttggttttcctgttgtgatttgtgcacccgtcttcgatagactacatgattcattttttgaaacctaaggcgaaactttgttccacttttatatttagaagaagagaattaacccagtttataaggaaaaccgggcccaaaaaccacacaattgcacggttaattataggaaaaccggctgaaacccaccgctacacaactgacaacgacggcggagcccaaaagcaggatgtcaccgccaagctaaacacaaaagcgatataacagctcccacatcgcagaagaggtgttatcgttgccgagctagccgcccaagcgacccaacagcgccgacttcacaactgcagcgacactgaagacacgaaagtcgccaaagcgaaaagcagctccgacatccaacaatatacatcagccaagccatcgagaagccacttccttcacgcggccagcaccccaccagaaggaacgaagtggacccaagaagacaaaggcctcaccgagcacaaggtatgaaagcttttgaaccgaaaaagaccatcaacggtcgtcgatgcattggaacttctccgaagcgacgcccccaaggaggacacgacgtgtaacgccgccgtcgctcgtctgaaagccggaacaaggttttcatctggagattgtgggggatatgaaagaatgccatgacaatgcctccaagaagggaaatgacgcccacgagcgccgccgtcgtcgaaccggccaaaggcacggcaaggctttcgccagcatcttcacatcacccacacaagcacccccacattgacggccacagaatagtccatgacgtctcacaagcacccatacctcaaccgtaaccaacggcaaagacggacccttggccaccaactcctacagcaagccgaagcctccgccctccccctagcgttccccacgaccagaacaaggtccggccaaagaagggagggaaaccg

SEQ ID NO: 58085 - DNA, 732 bp, Oryza sativa
agagtaagctgatcccaatttgatacctgcagcccgtggagtctcatgaaaaaaacctcccctttttttatccatcgtcaagtatggtattgatttttttatccatcatcaacagtataatattctttggtttgtttccattatgtattcatcacaatgatcaaaaggtttgttagtgggggttgcatcgcatgaatcatgtagtctagtttgttagtggggtcctccgcgtcgctctcgcgcgtgcggctcgggggcaaaaccctagccgcccgcgccgccacccccgcccaccctaaccacctcgccgccaccggagctcgccgccggaaagccgtgcggccagtcgggaaggcggcggcggggccaagagaactggcaaagctcttcctcagcgcgggaggacggatcggcgcgcgacggtggggggctccggcggccggcgacggcaagggcgcggcggatccgacgcccctggaagcggatcctgcgaggggacgcggcgatgcatatgcggcggtggaggatggccgcgggagggaggtggtggcgacggtggcgatggggcggcgcgtcgtcttcggctaggacgcggcggcggcgactcatcccggcgtggaggcggcggatccggcgctgcccccgccggatccggcccgagacggcagtcggaggggagaggagcggatgctgcgcgcgcaatgagcgcggatgggcggtcggcggcttgtg

SEQ ID NO: 58086 - DNA, 734 bp, Oryza sativa
agagtgaagctgattctacaattgaattcctgcagcccagaataaggcggggtgaaactgggcaaggcatagcaggtgaattagcctggactgatcaccagttgcgtcagatcttattgccatagcagcacatcgcgaccgcatgggttggaaagtaagaccgactgttgtttttgcacacgggacctagcaacgcaccgtcctaagaattctgacgtaacagagcattatattaaacgaacttgatatgcatgcatacgcgatcagacattgacctcttgctatctccatccacgttctggatgatatgatccatccatgtcttcatgctgtgtagccacatattcccctgccatggatcgatctgtttcctgctccgaaatccatccttctgtgtttgcatgttttgctacttggaatatgagtgaatgctatatatcggacaaacacatatgcaattgatcagcaactacaaataatggagtgtgatgaataggcctgaaccatccgtgtggagagtggatttgcgtttttatcagtacatcgacaagctggtcagcacttagacacactgttcttgttacgatcccgatgccaaacataccctgcctcctgtaaaagttgcttgccaacagctgccgatggctgtctgtatttatgtgtgccatgaataccttcacagctgtactctgagacttgaacgaactcactggtggttatatatcccaatacat

SEQ ID NO: 58087 - DNA, 1166 bp, Oryza sativa
ttcatgcttggatctatcgccaaatgctgcaggttcatgcttggatctatcattttatatataaaaagagtttttatctatttaaacaagatttggaattggagattaaacacgagacattggggttgacaccatatacctcttgccaccgcaacatcaagtgcatctcaaaagcttttatctatggtatgttccttaaaaatgttttaaaaatacagtcaattgcaagatgtagtgatggcttattttgtgatggaggcggagagattacacaccaaagcggcacaaaatattgaaaaaaaggtatatattgaaaaaaatccaaatagtttgagcttggagcctaaaatatgaggttcactgcttcagttttgtttaccacgattttgaataagaaatggatgaaaatgatcaaaaacttcttctataaaaaactgaactctggattatgaattttggtgtagcatcagcctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggaattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgt

SEQ ID NO: 58088 - DNA, 709 bp, Oryza sativa
  unsure (1)..(709): unsure at all n locations
attcctgcagcccggttcttcctaggaacttccgggcagttgtaaattgctatttcaaacacctcacaacaagtaaattaaatcacaaggaagcctaaactatagagaggtacaacatgtctcaaacaagagtaatacacatgaagatacacaagatagcacaagtgatcatacaatgggagacatgatagaacaactaggcaaataaagagataagcatcacaatcacaaagataaagagagtgagaggagacaaacgatttgtttcccgaagttcggattctccaccgagaatcctattcttttgtgtttccacgaaggaatggcaagtgagggaattattgtacagttgctaaaaactaattgatgctgatcattagtgtagattaattaattaattaatgctgagatggctaattgatcactttgctctgctgtgatctctcttcctagcgtagtgtgggtcaagatgtcaaattttcaatggctgacaatttttatcacaattttgtgaagattttgatgacaagattcagaggaatgatgggtcaaaccctgttccttggtctgcaggtccatgaaggcaatgcaggttatctgggatatattaatgagtcaccaacagctcataaatatgtggccttcatgccattggtttctttggagtaatgcggtaccagatgattntaatccaagagattgcaatgtt

SEQ ID NO: 58089 - DNA, 1141 bp, Oryza sativa
attcctgcagcccgtgtccgcggtgtacgaggaggacgagatctacaacgtcgaggaccagccgccggctatgaacgagtcgagcgtgcatgagtgggggaggagagccgcgacgccgaggcgacccgcatggccgagccgagcagttggagaagcaggtgctgaccttcaacaccgccgcccgcgcggaggggagcgcctcgtgctcgcgcacggcttgcggctgcggtccgacctcaccctcgccccacgcgcggcgcgcctcgatctgccgcgtccctttcgacctcgccgacttccgcaaccgctcgtcgtcgccggccaggacaagacgtcgggatcggattctccgccttcgtgcgcgcctactcgcacttcctgggcatccgcttcctcttcgccgcacaggacatggaggccgtcgcgatctagcaatggcagcggcggaggtcacgaaccgagcaaggagcaacgacatcgacaggacttcgccacgacgcgtagacacggagggcgcggggttctccagtatcttcagcgatgggtgaatccgtggatcccaggtagatgacgatgagcagcgcatccagggccaaatcgttcagcggccaaactcggcgcgcgacgcgagtcctaaacagaaccgaaccgaacctaagctacttccgatgctgactcccgtttcttcgattaatctactataagtatcgcacctgagaaccacctcctgcaatcagcaaccagtgaaaaatatcatacaatcgcttatttgtttatttttttgaaaagaatacaatcgtttataattattcgcttatccctttcacagcattgagagatttcaggaaaaataactcatggagcactccaagcaatccatccatgagctccaggaggacggtggtgcagattccggctccggctccaaggctgaagcgaagacagatttggtggcaggcgggaataagattcaagaagaaaacaatgatagcactgcgttttgccgggggtgtcgtcgccgcctcatccggttcgccatcttgaccatccggttcgttctcctagcggggttgcaccgcgaatatttagggatggtggccaagtatcgtggaactggttagcgcctgttgggctgcaggaa

SEQ ID NO: 58090 - DNA, 713 bp, Oryza sativa
ttcctgcagcccctcgccagctttgattttgatgttttgggggatctccaagcatcctagcccactcctaagcaacctgggactaatacaccactaggaacatcttcttgcttcaccttgagggttgtctatgtcaacaccatttcactattgggactattctcacctacactcattaagcatattagtcccaaatcaattatacctttgccttgatcaatgcccactttggattttgacttgatgttcatcgaagaaccacatcctcttgatcctcggcattccatcttgcggtcttcttataattgatacggattactcatagcttcaaatggcctcatacggtccatcatgaccatcatgacaaagccttcactcgcccttcaccaccggattcagtccatcggcgccaagcctcttgcttgcccttcaccccccacatggtccattgtagccgagccttgcttgcccttcaccgttttgccataaatagccacttcataccccgcatcatcaatgtcttcacttgctcctcatcaaggtataatgtccatcttctagccgagccttgctttctcttcaccggtttgccatagatagccatttcataccccgcatcatcaatgccttcacttgctcctcatcaaggtataatgtccatcttctagcttcaatcttttaacttgatgctgaaacttaacctaatctcacca

SEQ ID NO: 58091 - DNA, 2526 bp, Oryza sativa
ttcctgcagcccttgaacgaacatgtctcagcgagcagtctagaagctgcaaacttgcagtgttgcagggtaaaagaacaacttggaatgcttgaacctttaagcatcataaattaagtttcacaaggtggttagggacaaagcttaagctagccttaggagctactactacgagtgttgtctaagctaagataagatatggcactcagttccactatgtttctgcttgatctaacctacaaatggcacaaatggcttctgaattctgcaaggttcataacccagttactactccattttacataaactttaccgaccaaatttgcagtctctactccaggcagtgaaaaactcttgtcccttgattagactgtcctggtaactcctgaagactgctgaacatgaggcttgattagagtaagtagtcatttagtagtagatttaaaaggactctgccggggcctagctgatattactagtctgtcctgttccgtaagagttaagcttcatgataagcactgataaattcatggacccactgtgttattactcgacgcattcaagtcgaaaacactgaaagggacttatgatcgtggaggactgtgggtaaggcttattcatggacaaaacttaaacagtcctagtagtgtttgtactgactatgctcgcgaaaatggaagtatcatgcttgcaatatgtgcgtggattaatgtgtggatatcctagataagaatccaaggccaaacatttctcatgaaacagacattttcttgtagaatttcgaggcaaatttcaacatgtttttactcaaactgaacagaaatccaactttcatcaactggtatttggaaggaacttccaactaaacaccaataatttcagccaaaataccagaatctttgaagcggtttctactatagcattttactaccagtataatcaccaataaaattatctcagtcgttgatatatgagttctagtagcagtaaaaaaaatctacatagagatggtagtataaatatatatgatctgttgaattagaaaaaaaataaacggtctaacttaattctactttcattaaaaaccattgtaaaacatctcgaaaattaaatgtggtttaacagctttttaggtttgaccatagtatataaaccgtgtctagcttggctgcacgacaatagcattcctacattcgttataaaattatgtagtgtgcgttttttaaaatctgatatttatcaacatattatgttattatgtagaaaatgggaattagtggtcaaatagtgccttcttgaccctagccgtgtttagttccctgtccaaatttttttaaaatatatagacacacatttgaagtattaaacgtagactaataacaaaataaattacagattccgtctgtaaactgcgagacaaatttattaagcctaattaattcgtcattagcaaatatttactgtaacatcacattgtcaaattatggcgtaattagactcaaaagattcgtctcgcaatttacatataaactgtgtaattggtttttttcgtttgcatttaatgttctatgcatgtgtccaaagacataaacatttgatgtaacagaatttttggaagtttgaaaagaactaaacacacagccccctgtcaatgtgaccaaaataattactaatacttgccgcagggtagagtacgtgacagcttgataacattgcaatctcttggattaaaatcatctggtaccgcattactccaaagaaaccaatggcatgaaggccacatatttatgagctgttggtgactcattaatatatcccagataacctgcattgccttcatggacctgcagaccaaggaacagggtttgacccatcattcctctgaatcttgtcatcaaaatcttcacaaaattgtgataaaaattgtcagccattgaaaatttgacatcttgacccacactacgctaggaagagagatcacagcagagcaaagtgatcaattagccatctcagcattaattaattaattaatctacactaatgatcagcatcaattagtttttagcaactgtacaataattccctcacttgccattccttcgtggaaacacaaaagaattagcacccaaaaaaagagaaaaagagattgtcatctcttgatgaggctaaagaaaaacaaaacgtggtcgtcgtcttcctcgagaacagcttaattagctctcctcctccatggtcgccgacgagtagtcctcgaaggtgatgcacgacgacgagggcgactgcgacgggatcggcgaggacgcgaggctcacgagcatgtcgatgaaggcccccacgatgacgccatggacgcccttggcgttcagcttgaggtaccacgccaggagctcctccaggccctcccagtcccgcagcccgtgcgccgccaccatgtccgccatcgacgacctgaagtcgccgtaggggtcctccgactccaccgtcagcaccaccgcgccgcccttcagcgcggaggcctccgccgct

SEQ ID NO: 58092 - DNA, 1138 bp, Oryza sativa
ctttcccaagggaatctgcacacgattgcacgaggcccctgcagccggtctgcgcatggaatgaccacccaacacaaaagtcgtccgattgcacgttctctcgctcttgtcctgttgcacaactgttgagatttttcacagtttcactttcacaggtcacaccgtcacagctactgtaactgcttacgcatcgctcggaccagcagcacaaaaaagttaaaacaatggagcgagcgagagaggtgatttcaaaatggggtaccgtccaggagggaagtaaaagctttttgataaagcaagaattcacatatgctgcaacctaacgtggcgtccacagtgtgcagtgctacaaaattgagcgaatatgcatgtctccgtaggctttatggaagaaaaaagaccaatagcagtgccagttggtgataacacagtcacagcccacaatgtctgatgtcagacgactccgtccaatgatctccgctttgcaaaaatgcaaatttcaactcgctgttttcaacacaacaacaagggtgtgctcggcaccctttttcccaactcatctctctcgtttttcatgcacacgctttttaaactattaaacggtgtatttttttaaaaaaaattctatatacaagttgcttaaaaatcatattaatccattttttaaaaaaataataaatatttaattaatcgtgtgctaatgaactgctctgtttttcgtgttactgttccggatttggaacaagcatatgcgaacacaccctaagtgcaccaatgagcttgtcaagactaaaacaacctgttccagtaaaaaaaacagactaaaacacctgttgattttctttttgaaagggtaaaacctcttcctgcagtctgtggctgctcaaaaattcctgtggtacgacacaaaaaggttgtatttcatagatataatgcaaataagcggtgacgtactgacgtcctaccacgaaaacaatatgcaactggacaaaactgtatggtcttgggcaaaactgtaccgaaatggcattcttcttcctctacgttggttgccattaccccactgtccatccacgctctgcaagcacttcacgaacccgtgccgccacatcaatggcatcgttcaggggagggtagc

SEQ ID NO: 58093 - DNA, 1473 bp, Oryza sativa
cggtttggttttcgtgtgtgtggctttcgcgataagccgccatgcgtgcggccgatcaggctcgctgcattgcgtttcggtgctttgcattgcagcgcaagatttgaccattggccttggcccgaaaagctgcgcgtggcatcttaaatttagagcctctggcgtggtttaattctcaacttttttttcaaacttttagacttttttatcaaataaaattttttttacacacataaacttttaactttttcatcacatcgttctaatttcaatcaaaattctaattttttgtgtgaactaaacacaccctctcggagtctcggagtttttgttgtgaacgcaagcggcgaaggcaaatctcgcagactgaccgctcaagctccgagccagcgaccaccaccagtagtagtactgttgcttgtctcgcccaggggtgatggaaataaaaggattaaacaagaggtcccggacaaggatgcttttcgacgcgtaattaaaggcctgatgagatgagaaagaaagaaaagaattgaaggcagccaggcaaaggacgtaaccacaatccacaagcgagcgaagcgaaatttcttcagatttcatatcatatcctgtctactgtagtagtatatcctacgtgcagtgcagcgtaggcccattcttctccgaccaacaatacctgcgctttccatcctatcatcctatccccgacctcccttgaaacattttttagcctctcatgtcaaccaaaacttcgagagatttacagggattttcagataaaaatacaggcagcagcagtaagtacagtactgttgaaataatctgtaatggaagaggaggcctcaccgtggcgttgtctcactgatgagagctgagagagtgaagccatgcgaggtgggggcccacgccgcatagagaggagcgaggacaaaaggcgcctacgtcccctcctctccgcctcgccgatcccccactctattacccgcccttttctgctccgcgccatctcctcctctgctcgcctctgctcctcctcgtacagagcaagctgcgcaacagcagcagcaagcaaccaaacgcagcccacacaaagctttgttcttcttgctcttcttatactcgagcagccgcgcattctgtggagctcagagcgcagcgcggcgccatggggaggcacaagttcaggctgtccgacatgatcccgaacgcgtggttcttcaagctccgcgacatgcgcgccgcccggggaggtgcgggcgctggcggggcggggccagccacggtggggtggtcacgcagtcttcggtggccgtgtcgcgggcggggagggcgtgccggccgctgccgaacacgcccaggcacggcgcgttgtcgctcccgcacagggcgtcctactactacacgccgcgggccggcgacctgctcgtggggtcgccgctccatcccaagtgctccgacacgcaattccctcct

SEQ ID NO: 58094 - DNA, 1597 bp, Oryza sativa
ataaataggtagaaccagaaacggtagaaaataataccactcatatggaaatggtgctcggtcgacccggaatttccgtgactgttttcatccccagtggcaaaaagggaacaagaaaaaaaattaatttgatttttttcatatagtttgtagattagcaattgaaaaaaaaaatactacagttttagttgaactgagcagattattggctatgtattggtcgcaaacttgcttctcatttaccattcttaagagccccaccgaccgctcccttctccatctctgatgagtatgtcgctattgatgcatcttctccaattgtctccaagtacgacacaatcccccttctccttcgtctccgatggttcatgccattgccgcctgcttcctaacaacatgaccttctttgtttccgcggttgatcctatgcactactctcgttcatccctaagcctctggtgctaacgcttctgtctttccctcaccggcccaccgtctctgccactcattgctattcctccatccctctaaacctgctctcatcgaagtcctcgccatctccctcattgacgcctccacctcttggcaggccatggattttgatccaatgacatccattagtggattcagaatagcaaagcataaaattaaaaccgtttatcatgttgtctattcgtaaacttatgcgtgaagattgatgaactgaaccaaatgtgaaaaccccatatacaagactacaaattacagcactattttttttttttgaaaatccctgatatgactatgcctatagaaaatcctatgacgtaaatatgaggtggctttgcagtattgagactctgaacagaacctctctcaaagaaagaactaaaatacgtacttcaagagaactcgattgaatcatggcccaaggcccaaagcccagtcgacgcacataaaatccaatctctcccggttgacggaccgatccccagtggaaaaagtctttgactgcttccactatcgcccgagtatgatttatttcctccaaccacaaaaccggtatatcgacttctctaactattaaaaccggtgcaaacaatatccctcggtagttttggaggtgggtttggctgatgtggtggtattgactaagtctttctcctacgtggcgcttacgtggcattaaaataaaaacaaaaataaaaaatatgtgggatccatatgtcattaaaaaacaattataggacccactgatatgtgggacccacctgtcatcctccctcttcttccctcttcctgcccctctctcccttgtctctctctcctccccggcctttctctcctcgggaagacgacggtgtggagaggcggtggggagcggcggcgaacgagggcggcgcgggagaggaggtggacgaggaggtagtaggcgcggagggagtgggggatcgacgacgacggcgacgaggaggcggcccagtagaagaaggtgagcgcattcctagcaacgagctccggggaggaggaggagtggcggtgcttggcaagggagaggaggacgacgtcgacttggtcggcagtggggaaggcggtggagagcgcctcccatgtcgct

SEQ ID NO: 58095 - DNA, 791 bp, Oryza sativa
ggtcagcaatgcaggacgacgcctcgtccagggaggagcgccgcgggttgaagtgctccagcgacgacgtgtcgtagacagtgttcacggtgcggtacacggagccggcggcggcggcggcgtcgtcgtccgcctgcccctgctgcggcgccgtcggccacctgaacgagctggtgcgcgggtgccggcacgacggccacggccacgacgacggcgccggcgggtagcagagctgatgccggccgtggcagtgcggggacgacgacgacgagggcgacgtcggcgtcggcggcgcgcgatggtgcacgtcgcggagcttgtacaggataccaacgagccccttcttggccatggcagcagccggctggcgtccgccgccggcggccacggcgcgcgcccgcttcctgagctttccaaagtggaggtggggagggttcaggggaggcattgcgccgccgtgtttgacggaggcggtggcgtggcgtggcgtttattttcgcttgtgttttatagagagggagaagagaaagaggaggttgcagcacatttacgagagggttggagagggtttcagtagaggaattgaataccgccattgaatggtctattggccaatgactagcacaagatttgatgtggtgtgtctttgggtgtgtttagttcacgttaaaattagaagtttagttgaaattaaaacgatgtgacagaaaagttaaaagtttgtgtgtgtagaaaagtttggatacgatgaaaaagttgaaagtttgaagaaaaattttggaactaaactt

SEQ ID NO: 58096 - DNA, 1457 bp, Oryza sativa
aaattgcggggctcgtattcctttctctttctctctatccgtctgaagaagatcgtcatctcgtcggtctaattttcccggccttcctcgctggctctccggccgcgctcccctctgcttgcagccttacacctgtatcgtgcacgccaacagttcatcgtccccatcaaggtcacacctttccaacagagggcccctcaatactttcgactttctcctttatgattttcggaagtattagtaccccacatttctaacgatgcatatgctaatccaatgtatattcttaattctgcactatagaactctacaagtctattatagatgcttgctttccgtgtggttgtgcccaaccgcatcagcactaacggtgattaaacttccaggtaggaacactactctatgattacgaggcggcagttttctttatttttttttgccttttcttttctctctgttggatgctgagagcccgagatggcagttcgagctcgggggaggtaatttctggcgacgtgcgtccttggcgatttgtatctgaactgtcagtatttcgatctaacatctgctttcgcgcgggcaggctgtatcgtctgcttgccgtaaccgaatcgaatttgccccggttgatgatggcaacgagatcgcttcgcgttcttgaatgtctccatacaacaccacccatcttcgaagtcagatcgatgcaagtatcgaaaaaggtttttaatctcactactggattaaatcggcacgataacatgtttttccatcgtcgcttcacagaagaacggttgtttcagcaactgacaacagcctcacagggaaacttgaacgtaactcgggtctgagaaatacggtgggttatgcgtccatgtcgacgaagacgtatcatccaatgaaagcaaacacatcccacaatctaatttcgcaactagaatgtcacagtccgttgatggaaggtcaatgtgccggaaagggagggccaatgtttgcccgtgacagattcagaacaatcccttaattaccttgctgattcgggaatattttgctttcagacagcaccctgaatcacaaagcttatctatataaaatgtcgcagcgatcatcaactcacacacgtgaacaagcataaccccgtttttcagtccaaggttccaagttggttcctttgataatccgtaacccaccagcaacaccgactcctccatactcaaaccttttagcatgaattggctggattctttggtgaaagagctatcatgtaacacgagtaacataagggttcaggcccatcagattacgcaatctgcggcacagtcattcaaatcaaaaccaacaatggaataagacaggtaacgcatatttggcatagaaaagtaatatcacgaggtagcagcagtagtagtatagtcgcacctggtggagtaatctgctggggcaagaagcgaatgtacgta

SEQ ID NO: 58097 - DNA, 730 bp, Oryza sativa
aaattggtagtttatatgtgtagtaaagtttttgatgtgatgtaatgtgatgaaaagttaggaatttggggaactaaacacggcctactagtacatactccctccgttctataatacaagagattttaagtttttgcttgcaacgtttgaccactcgtcttattcaatattttttgaaattattatttattttatttgtgacttactttattatctacagcactttaagcacaacttttcgctttttatatttgcaaaaaaaaaaattgaataagacgagtggttaaacgttgtaagtaaaaacttaaaatcccttatattatggaacggagggagtaatttttttactgttttctttagccaggaagactttttacagtgtagtgttattacgactgggcgctatatttgctatagcaaagtgagtagtagtactgctgctcgctgcctttgcacaggctaccaccgcgatcgcgaaataccggagtgcgggcactgtgcggcaggtgatcagcaggcaggggcgcagggcattcacgtttcacagtagtgggcatgagcgcgctgcggaacaactgtcacacactcgcacctgaggacgcgatgccaaccaaaatgcttcgacgatgccaaccaaagtcgcatggcgcaccggctgcgtcacaactcacgactacaccgcgccgccgtcgcttgtgtagttgtgttgaggatgaatagagactataga

SEQ ID NO: 58098 - DNA, 1468 bp, Oryza sativa
taaaatatacttcctcgatcccaaaataagcgcatcaatttttgtgtccaactttaatcgtccgtcttatttaattttttttatgattagtatttctattgtggttaaattataacacatgagtaatactttatgcgtgaattatgtttttagtttttttaaaaaaaattaaataagacaacgattaaaattagacacagaaattcatagttgcgcttattttggaactgagggagtagcaattttgcacacgattggacacattcaaataccatgaatatggataaggatgtatcctaagccgagtttagttccaaacttttttttcaaacttccaactttatcatcacatcaaaactttcttacacacaaactttcaacttttccgtcgcatcgttctaattttaaccaaactttcaattttagcgtaaactaaacacacccctagtatcatgaattagatagatatctattcatattcagatttatagtattataataagaccaattcagtactaagttgctttttttaagatggagtgagtatctcattagtcgcttgacgcatagttataaatgaacagttggtgtacttaatgcgaaatttgttaggaagcaagtgcaagctgattgcaatcagggagcaaagacatcgcgatgaaccattcagtaatactccgtccgtctcatcataatatagtgatttaagataagatgtgatattttatactacaataaattttgtcttaggttgctatatactatatccatctcaaaatatgtacatccgtggatatctgtgtccaacgtttgaccattcgtcttatttagaaaaataaaaaaaattagtcacacataaagtactattcatgtattatcatctaataacaataaaaatactaatcataaaaaatattaaataaaacaaatagtcaaacattgaatgaacaatgcaaaacattatttattttgggacggagggagtatattatgaaaagtaaccacgctagtgtgtatggtagccgcggaatgggctggccttcgggagttcgggatctttacggattggaataagtgcactttaggtctctctattcgtcgctcagtccgattttcgtccctgaactgtaaaaccgggtacaacccatcccccaacttacgaaaaccggacaaacgaggtccctcggcagtatggagggcagttttggccgacgtggcgtctatgtggctaatttgacttgatcttcatctgacgtgatattgacatggcgctgacgtggcaattcgatccagaaaaatattaaaccccgtggcacccacatgtcagtttgacacacaaattaataaaaaatagtggggcccacgtgagccccacatatcattctcacccttctcttcttcctcctccctccctctccctctccctctccctcccctctcgtggaggagttcagggccgcgcatgtgg

SEQ ID NO: 58099 - DNA, 1668 bp, Oryza sativa
tgtgcaagggattagttcccaactcattccaacgaacgcaacctcgcattctcatcttttcgattatacttatcaaccaaaatttaaatttttcaaccttaaatttgaagttgattttgggaatttttcatcatagtttattttccagcctttgcttttggattgttgaaaacatgtatataaaagttttattcacaattattttttatttgcaaatatgccgttccgttttttcctcaagtatgccaaacgatggggctgcccttgatttcaaggggttttagtttggtatttttatcgctattatttatcaaaagcaaaagaagtctatcaaatcaacccacccaatagcattggaaaataatgcctctatcaggtaatctaatacggtataaattcgatgtagataagattgtatatgtggaatttttttcaccaaatccaacgaaattcattagagatggctcatgtaaattttagagaaaagttagcaacagcttcaatatttttggacacatgaaacaaataatccacaaacaatatctagtgaaatagctgaaaagaacatggaccttaatattcgatgatagccagcaacaaaatttagaattcaatagtccattgggacgaggaatcaaatgcaagcataaaaaatttgcttaaggacaagcattgcccagaggcacttataaacattactatgaaaatagtaaataataatgttaagaaactaatcctttgttttccaaaaaataaagaagttaagctttcatttaacctattttcatctctctattttgatatactctgcttccgactaaaaataaacaacaaaacaaaaatctccggtaggtcaaaccaaaataaaccagcctacttatgtcaactactataaacaatactattatagcagatccccaagtcttgctactgattacagcaaaattccgttgtcagctcggcattgagcgtctgctcacacaaaaacttgcttctgcaacaaaattgtctaaagcctgcatgaaaaacagaatacctgatatcaaagcatgacgagcttaatttgaagcaagggatagatgcaacggtgaatcacaaacctataaagaattccagaaataccaccgggccagtggtatctgcactcaaaggaaactatctacatatcagcatgcccaaatggtgcacgaacaaatagttggccatgaagcgtgacaacggcggatgtttgatgaggatcgatcctcaatggcagattgaccacctgagaaagagtaatcacttcatgttatctgaagagaatgcaaacgtgctcaaattagtattcaaattgctgctatcaccttcttgaatggagtgatcccccaaggattatcaggctgctctgggtccccagttataaccagacgcccagcaggatctgactgaacatgcacctgcaccatttagaacaaaattcaacaattcatttcttctcgcaggtagtgcctcagttcaagaagtggaagctttttgtttgttacgcacaaattaagtcaggtatttattttaggaaaatggaacagtttgaagtgatgcgttcaacattaaagatattttttcacctcttcgcgtagaagtccaggaaccccagcatagatttcgaaacaatctttctgcaggaaagaa

SEQ ID NO: 58100 - DNA, 1640 bp, Oryza sativa
aataaaggagacaagagacaaggaattttcaccgaggttcataaacttgccggtagcctagtccccgttgaggcgagcccaactccaccgctcaaccacgaagccatcgcacgcccccttcatcaaagggtggcaaggcgggagccggcccacggagaggactaccaaagcctcgatcactagggtagttcttccttcactccgaaggtggtgaactccaaaccactcacaactggcgccaggcctcctccacaatctcctcggagaggtcaccgggcaacacctccacaagccgtctaggaggcggcaacctccaagagtaacaagtctaggatgcttgccgcggatgatcaagtaccacactagctataacaatgaaacaatgcacttggattggcttaactcactctctaacacctcactagataaactaagtgcccaagggtgtgagagctcttgcaagggttcaagataatgtaatggagtgccaaaacctcgcccttgctgctggggagtgggtatatatacccccaaccaccaaaactagccgttggaaccgaaatccccaactctgtgctccgccgatcagaccgctgttgtgaggccggtcagaccggactactttgtaacggctagaaaactagtcattgagcccactcaacctggccggtctgaccgcagtgtagtggccggtcagaccgtccacggctcggtcagaccgtcatcggctcggactgaccggttgcggctctggtggctctgtatcaccaccataaaccagaccagtgcaacagaccattgaagccggtcagaccggccttatcacgccggtcagaccggctaacaggcccggtcagaccgtcctaaggcccacggtcagaccgcaggtcacttttcagcacaaccaaccgttagtaaaacggcgatatttcttgacacgggtttcggaatttggcgttcttggactctatggaaagcttattcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctata

SEQ ID NO: 58101 - DNA, 784 bp, Oryza sativa
aggaaggaaatctgggaagtgggaacctcaccgcactgcttgcaagaacctttatctttggtaatggcatgaatccaacaagctccaaaaggaccccaagggcaatgggcaaaacagaatgcggctcataaccaaacactgcaagcacagcacaatataatcaccaacccagtggacagtgccctctatataaaagactccatacttttctatatattactactcctttacttagcttttagaaataggccaaaagggtttgatactttaaagattaaaaagattcaagtatcacaatatcatctttagtagttgtttctgtttagctttaggaatcaactgaaaagcctcggtatcaatcatcaatgtgattcaagaattaatcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaaga

SEQ ID NO: 58102 - DNA, 1118 bp, Oryza sativa
ggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagactatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtat

SEQ ID NO: 58103 - DNA, 2068 bp, Oryza sativa
gcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactgcggtggaagaaaaatacacgcgagttctctgctcgatttgtacactgatgaagagaaggccacattttgtcctctctttttcctaaccgcagccgccgatcaccggagcaccacggcgacgacgaagctcagcacggccatggcgctgccggcgaagcagcacaggtcgatgagcgcctcgcgtcgcgccttgctctccttcctccccttcctgctcttcacgaactcgt

SEQ ID NO: 58104 - DNA, 878 bp, Oryza sativa
cagtggaagacgatgtcatgatcgccaatgtctcggtcacagatgacatagcgctcagcgctgccttgagaacatcctgcgagcacccaggcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaaattgctttgtccaagtagaaa

SEQ ID NO: 58105 - DNA, 1185 bp, Oryza sativa
tttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggaccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccg

SEQ ID NO: 58106 - DNA, 729 bp, Oryza sativa
tagacttgctaatgaaagtagcacatagaatgtttgcttatattgccttcatgcatgcaataagtgtgttatttgcaggaaatgtgaaaaaccatggatgttattttgcatcaaaccaaacatactactgtgtgtctctaccttaccaaatattagcaatgccaaaattttgcatgacaagaattcgttagggttgatttgggcgataaaccaaacagccttattgtcacatttatgctttgaaaaccattaggtcatgtgatcacagtaaggatcaaggttttagttgattgagtttacgaaacattacaagagctcttcttttcttggaattacttcagtaataacataattcatttcaattccaatcatgtttcaaaattctgttgcacctgcataccccttttggtgttgttatcagccattaatgataccaatgacctatcaactcgagggcatatgctcacagaaatataaacctggaaaagtcaattatggcttgatgaagtctaatgagtaagctatgcttacagtaatatttcaggcagtttccattaaggcccacgtgtagcgtgtcacctctgggttaagaggcgcgatgctttcagattcctccatttgcaattcggtttgcaaatgtggtaactggtaaggtagtaacatgtgctcctattaaattgtgtcccctcatccgggctgcaggaattcaattcgagttcaatgcactgg

SEQ ID NO: 58107 - DNA, 1047 bp, Oryza sativa
  unsure (1)..(1047): unsure at all n locations
ttttttttttacataagacaaggcaaaatttggatcagacctgaatgttttcctgaacaatatagtctccaaagatacagtgcatggaattattgccagcttggttacctgatgcatttgatagagtgagatagcttagacaaagcagtagactaattacacaagcacagttaggtctgtagacaaagaacatgaattggctgaaactagagactgttgaattgtgtcattccatccccaataaaatcagggcaacatattgtgtgcatgttgattttcagattgggcatgaatcaaggtcaactactaaatttccagcaagaatttaagttttaaagtttccaacaggtgtcgtttgctgaagatgaatatgttcatctcaaaataggaaaaataaacaaatgcaagattggcctgatttctgaagagtaaaccaacctgataaaagccaatagagttgaatccaaggctcagattaagcaacccaatagatatgccatttagtattccaaatccaatgattgtcttggggtctaaatctttgttctcgaaaagcttcatctgaagagccacatgaagggaacaaaatgtcaccaggagatgccagcttgtcagcgtagtagctgaaagaaattaggagagtgctgtgatttttgcatggttatatagcttaggaaacagttagttttctcaggtggtattgttcgtcatattgtactcataaagtagtatagaatttgtgtgccttattaatgaaccgtgtccatcaggcaacttgtgtttcctgaattttcgaaggatgtcatttttgttcaacaaatacatgaataggatagcagtaacgttgtgcaatttccaattgtcccatggagccatgaatttgactcacatatgcagcagagcagagatgttcagaaaatggtcatcaagtctgcactgaggcaattcanagaacacctagagtgcatacttatctagtcatttgcgttgctctaagctcgtattgccgcaatccaatgtatgcggacagagtgctagatgctagca

SEQ ID NO: 58108 - DNA, 706 bp, Oryza sativa
atcgcaagcgagagcgatcaagtgatgttaacaaactagagctcaaaaatagagtttgtggtgtgacgacacaagcaaaatcatgtcggagtattaggattcgtggtgcgatttgcacatacgtggatctgcaaatcttgctccttccgaccagcttcattcagatgaggcccgcctaaaaaagaagggcttcattcagatgatggcgagaaatagtggcttccatcttttatctttcggatggaaacccaaacagatcgatcgaaacttccgctgcgtgacacagccaaagtgaatcactctcttcccatcactacttccactctccgtgcagtttcgttaagataatggccagtacgtgcgccatgtttatttggatttggtcgctctaatgatgatgaattgatgatgatgtgctcctccattgctgcattacctgtcgagcttttcaagattcaggcaggagagacacgagcacaggaacatgctgccgactgcccactgctttgatcctttttgttcatgcagccgatcaaatctcgctttcgatccctttgctgtaaacaaaaaattcagaggcagcgtttcgtccaaacgaccagaataaacaacactagccgctggcccatgagcagatttttttctccaccaaatccacgatactaattgtagcaacgggcttttctactactacccgtgggctttt

SEQ ID NO: 58109 - DNA, 1070 bp, Oryza sativa
ttatctttacttttcgaattaaaaaatggttcattataagatttcagaatcaataatttcgaattaaaaaatggttcattataagatttcagaagcaatctgttgaagaaagaggtgcaatactttttatttttcagcaatgggatgtgcatggtaatatgatttgacacgagggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggggaaaaaatgcgggagaggaaggtgggaatcgaaccctgctcgccgggatgaaaactttcgatgttaaccatgtaggcagattactatatgtgctacgagattacatggaacttacatatagtatataaacctcggttttggagtagattgaaaactgtccgatccgtctattaatcagattaaaacggatttagctacacgtgtgggacagacgaaaaaaacgcccagaatccttacatattttttaattaggtatatagattttataaggatataacaaataatggcggtaggagtttgattgctaattttaagttgttgaaagaatagctcaatccgatcttggatatcttgaaggcaactccaaaagcttgctgcttcttcgttatcagctacaagataacaattataagaattattttgcatccattgcattgtaaaatctatgctaagcatgatgtatgaataaaacagcatatgtacctcgatacttgttttgcagccaatcttgtgagcacattaaggcctccaagagttctgaagtaagccggctacgatgctcactaagaacccttccacttgtgctaaatgcagattcagatgcaacagtgctaacaggaatagcaaatatatctcgtgctaccttcctcaatgtaggaaagcttgtcccaaccactttccaccaatcaagaatcttaaagttttctgtattaattgaaaccaactcatcctctaggtacct

SEQ ID NO: 58110 - DNA, 4649 bp, Oryza sativa
tgaaagaattatgggaataatagatttcgcatgcaaatctattcaagaattatgagaatcagtaactaactagtgctatttatagatttcgcatgcgaatctatgcaagaactcataggaatatttgactaactaattaataagttaacgctggatattcctcctcgacctgatcaacctgtttcacgccgatgatgccggccacgaaccctaggcaagggcagacgtacctcttgacgaagcggtataccgcgccgccgcgccgggtcccgagcggccccggcgatcgccggcggtggagcgcggggtggggcctcgcgtacagccgcgacgtcgcgcgcaggagcgggtcgctgatgccggccttcggcggccggcgggagctctcctcgaactcctgcgagccgatcacgtcctcgaagctcacgtagccgggcgtcgtgtggcaccgcttgaagtaggcgtcgtgcgcggcggcggcggcggcgtgcaccaggtcgtcgtaggagtgcagccgccgcgagatgggcggcaaccgcgcctccgcccccgccggcgcggccccggaggaggagaagttgtcgctgccattgctgtcgctggtggcggcggcgctggtggagtggtgggagaggaggggctgcgagtaggatgcgcgcatggagaaaactggggcgacgtacgagacttacgagtagccgatcgagggagagattataagaaagaaagtggttaaaagatggagggcggtattagggtttgattatgagagagcatcacacccaactcgtattcggtgaagggggcgtagaaacgtattcggtaaaggggccgtagaaatagtgtatacagttatacgcacccggtttgccgcgcgccgtccagagaagattgaaactcaaaatcgattgaactcactcaactcaacccaaaagatgattgtaaatagatgtcaaatcgaaatagctaggtttcaccaatcatccgcggacggtttgaggaagcatcgatctccatcgaggactcgtgcggagctcgccgccgtcgagccgtccaggtgctcagtttgctgctgccgcggttgacgaggtcgcgctaggattgggagtttgagaggctggctggagagcccggatggccggatctaactaatgaattgttatgggctttggggctgagagatacatgggctgcaggccgaaccaacctgtgggctgagcagctagcggaggcgcttccgcttcggttcgtttgcggcctggaaaccgcgccgaacaggctactgggcgaagtggccaacacctaaaactggatttaaaagaaaaataaagccaagcataacaatactagtatttagattcggtgtaatggatcaatttacggtgaattttggatttttactctgttcggtagaaactggtagtaatataccttaggatttaatttgtcaaatacttttacttatgttatggtgggtttacactcgtcccttgctaatatcttccatagttggcttggtggtttacaacgtagaataaatgttaactttttataggtgccgtagctttgtgttggacggtaagactttgtagtaatgatataatcttcaatggcttaagtactaactcccctctttgtaggtaattttcaggtgaacccactgcgctagtggtcattgttgcttaacgaggagaatagcgatgtggttaaacacatgcacaagttaccggaggctagagtttgggatttcttttccagatttgcgtggaacttgagtaagcggttggagacctagtatccacttttgtcatcttttgttagttggcttctattcacgagacgacttcgttgtgaggtgttgtagtctaagtacccttgttttatttggtcggtggtgttgatcttatgcaaggtgtgatgctaagtactattgacaatgtatgtttggctatgtacgtatagtttggatgtagaggataggtttttaatcatttttttaaaaataaattgacattttctccctctacatgtttatctatgttttgttagtattgttgtattgctctcactaagcctagatgctcgctagatataatgtatttttgcttacttgtactcccctccgtacgttcaaattttttttatgagatagaacacaacctatatacaataggatgtgttccatccaatcgaacaattatattttgaaacggagaaattgtaagaattacaagttgtcctagcatatctgcactcttccatccatcccaaaataaataaaagaaaacttttgcaaaaccataaacagagtaaaacggaccgagacgagaataagccagcggagcacacgcgcaacaagacaatttttttgtttggcattcctatcaaaatattcccaacatagcatagcttctagtggaaactgtgaaccactgaaccaccaccatagacgatagcgtttgtagcttgcttgcaacggacaaaccaattaaataccccctccgtaaccgcgagattctaagttttcaacgaaggctgtatttagttccatgtcaaaattaaaagtttgaaaaaattagaacgatgtgacagaaaagttggaagtttgtgtgtagaaaagttcgatgtgacgaaaaagttaaaaattcgaagaaaaaagttagaatctaaatagggccaaagcgagaaagcttccttgcaaatcctggctgtgtgcatatgtatcagtacttccttcgtctcagtaagttaatttttttttattttttttatttattccaaaataaatttattttaaaagtaataattgtatcaaaattgatgaaagtagaaaataattatattgaaaatagataaatgagaaatagttgcattgacattgataaaacaaaggtattttagttttttattgatgatatgtgaaagaagatactttctccgttaaaaaaataaatctaaaacgggatgtgacacattctgtacaataaatatgaacaaagatatatatttagatttatactagcacactgcacacgacacacacaccagcaacgggggcacacgacacacacacaccagcaacggggattagaagttgacacgactgtctatctggaatcctagctgtgctgcggtagcaactgtcctcagatgctgatactccctgatagccatagccacgacgcgatggggtccccatccatcctcccctcctgctcggttgttttcgcttcaggttcagtgcagtcacgagcgcggacgcccccaaaaaactcgccacgctgtgtgcgcgcgcgcccaccgcgatccccctgatcccattaacgtttcacccgcgcgcgcccacctgccgctgcaatatatttcgccgcgccccgcgccacgccacgccacgccaccttgcgcgcgcgcgcgcacacacaccccagcagcagagatgagggggatgggcgacgacgggatggggccgatggcgatggcgccgccgcgttccggccacgccacggcggcggcaccgccgccgccgcagcacaagatggcgatgatgatgcacatgaccttcttctggagcgaccgcgcggtggtcctgatccggggctggcccggggagcgcggcgccgggatgtacgccctctgcctcctcttcgtgctcgcgctcgccgcgctcaccgaggggctctccgtgctctcgcgccgcctcgcccgccgcggcggcggcgccgcctcctcggatggcggccgcccggcgccggcgccggcgtcgtccgcggcgctgctgaccgcggtgcacgcggccaggatggggatggcgtacctggtgatgctggccgtcatgtcgttcaacgtcggggtgctcctcgccgctgtcgccggccacgccctcgggttcctcctcgcgcggagcagggtgcggccggccgcccgtgacggcggcggcggcgtggcctgtgagcacggtggcctccctcccgcggatggatccaagacttagtccccatcgattccgttaaacgagtatgtccaagcgccttagccagtagacactatgcactgtatcggatccaatgtgaaaatttaccttggatatctcgctaaaataattgtattttgtcgacttgcttgatatctgttcccgtgcagtcttctctagtcgtttttcgtttgtactcctatgtttcaagatggaatgatactactactagctagtattgatgtgagttctctactatgctaactttagatgaaccaatgatttgttagtactctccttccaaaaatatcctttttttaaatggaatccttccaaaaatattagatttatttcatattttgaattagctacatttgtagttttcatgtatttaaaacttaaatgaatagataaattaaatgattaatcggaacccgatgagtcatcttaatattcattggctgcgtacatgcatacactaattgatctttgttacaccttatctccacttaaattattattatttaaatccttcacccttaagatttctaattgtattgggtgcatatattgtatttattagagtgataaagatgataataattgtttttgttctttcgattaaatgtagctgtgtcttatattcgtttcatatgttgatgaaaccaaccctctagta

SEQ ID NO: 58111 - DNA, 961 bp, Oryza sativa
gtgctcggcgatctcagaaaggtgctcgttattgtagattagagtgtggtcctaactccggccctgaggcgggtactcgcttcgcgcgcgcgtgcatcatgctgcagagggcagagcccctctgccccgtggacgagacaaacacaaggatgcaaaaacgttgatcaaaaccatattattattttttttagtttttcacacgcctgcttaattaacccatatgcattgcgagtgcgacacacagcgacagtcttagccaacaagtgcaatataaatacttgaactaactcattctagcgccggcaatataatactgcaaccggtagatgagatgagatgaggatggcccgcgttttgcccagcacggaatcgcgcttgcgcgcacggccggagggcgagagggcaccagcgatgacgcctcatttagcgcgcacggagcgcataatataggtacttaagccgcacggttcgtcgtcgccgtggccccgcgcgcgcgcttaattttttcgcggcctgtcgggcgttgcgcccgccgggcgagcggcatcgccgactccgtctccacctactcggctacacgtccttcccgatcgatttgttaaccgcgcggaaacaaaagcgcgccagcatcttggttcccctgggccatgcgtggtgacactatttgcttgccttcttttccgggctcctagttacctaaactgcttattatcaaatgttaagagtgtctctctcactagccatgcaggcaaatggagtgcgtatcagctggctggcttcctttgacttggaggcatttccgtgctagttgcagttacgccaacaatggatgggctcagctcaaagaaaaaaaaaactacgaaagggctaacccttcacaagttgtgtctgtatcgtggatggaatgatgatacgttgatcctgtttgaaactgaagcagataaagattttttagagaaaa

SEQ ID NO: 58112 - DNA, 886 bp, Oryza sativa
gagatgtctcctgaatcaacaaatattgattaaaggcccgtaataggatgttgtatgcattgtctttttccctatatgctaaaatcttataagcactacagaccacacaatattacaggaaagaggagacagttcacttgctgaaatgccaaactgtaccatttgattatatagttttcagtgaactacatgtgtggaacatagaggtttcaatgaattgtatcattttagcctttattagatgcaagaagagacagttcgcttgctgttgctgaaatgccaaactgcatcatgtgataatagagcccacaatgaactgtacgatgtacagaacatttgctttgtgagctctacattgtgcttctcaacaatgggtgtgtttagttcgcgctaaaattgaaagtttggttgaaattggaacgatgcgacggaaaagttggaagtttatgtgtgtaggaaagttttgatgtgatggaaaagttggaagtttgaagaaaaagtttggaactaaacaaggccaatataagaaactaaagcctaaagcctaacaattaaaaatgattgtcccatagtccataagagaatttctggagatgtaaatcctagcaagtttcttgtgctacattgctcattatatgatagttcacaatatcaactaggaaagaggttaatctagtttttacgtaaccttttcgccgctgtcattgccgacaacccggatttccagaccaacagatgctgcttcaggtgctagcgggatctcatcatacttaaggaacttgatagcacctggatcatagcgaaaaaaaccaaaatcatgtacctgtttcgagaagagggggaaaaattttggattaacattatgccattagcacagggagaacaa

SEQ ID NO: 58113 - DNA, 1932 bp, Oryza sativa
ttgatggtactaatgacattttattctcctctcgtacgggaggcgcgggcacacacgtacgcatcaggccggccgccctagtttatcctgcacaaagaaagaaattaaatttgtctgtaaaaattttctacttcgtttaatgagagtatgagagtgtttatgcgtgcacgtacgcgttgcagttgacgctggtgctgatcttgtaagggagggagacgttgcacttggaggggagcgcggcggcgcgggtgatgtaggggcccccggaggcgccgttggcgacgttcttgaggcagccgcagatggtgcggcgatcgggggtgttgttggcggcggcgagcaggctctgaatgccgccgcagcacgccctgggcaccgtgccccccgcctgcacgtacggcaggcacggcatcagcgtgttgtacaccgccgagcacgagatagccgcgcgcaccgccgtcggcggcgccaccacggccgccaccagcaccaccaccaccgccagcgtcgcgcaccttggagccatgtcagctaagctagctagtctcagtctttgctgctgtgtacgtacgttgttgtgctctctacaacctacgtgaacactgaagacagctgaaacgtgtggatggaatggggcttcctgggggtgtttatatagcggaggaagcttagcttggatttactaaggttgttgagtgcatttaggggaggagttaagaacgcgagctggtagcagatggccgtgtgtgtggtcagaatttgactgaaataggaggagggttttttgggggatgcatttttaccagacgtttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccact

SEQ ID NO: 58114 - DNA, 1412 bp, Oryza sativa
gagctcatgttaagtttgacatccgctagtttgaacagctcctgctagaaagcactagtaaaaatcctgtctctgacagaaatgataacctgaggcatcccaaagacatcatacacctgctggataaatgcctaagcaactgtataagcagtaaaagggtgtgcaagagggataaatttagcaaacttggaaaatttgtccacgactaccatgattgtgtcatatttgcctgacttaggcagtccctctatgaagtccatactgacagtcatccaagcttgcatagggactggcaatggttgcaacagacctggagacttgcagtgttcaactttggcctgctgacaagtagtacactgagcaacatattgctgcacatccttttgcaaccctgtccatgcaaacagatttttgattctctgataggtagctgtaacaccagaatgcccaccaaccccactgttgtgtaatgcaagcaaaactgcctgttgtgcttccttatgatgcccaagccatattcttcctttgtatcgaattaccccattaaccaactggaagtggtcacatcctttaggctgaaggggcagaatttccaagagctgtttagtttttggatcatgctcattgacggagcgtggggctcctcaccgggagaccgcgctggcccccctttgccggttcggccggggactctgggtgagactctaagctcccaatctgtggaaggttcgcgagacaggaagcacacaagacgccggcgatgtatacaggttcgggccgctcagaagcgtaataccctactcctgtgttttggtggatttgtgtatgaaggaactacaaagtatgagccagcctctccctcgttctaggttcccaatctggaaaagtctcctcctccctctaagtggggaagatcctccttttttatcttaaggggataccacatgcacccttttcataaatggacggagatttgtatagttgccatccgagtcaccttctgatgggacggtccacaactacctccactttcgccgggagcagatgcgacgtggaatcgtggctgtctactgacgacatgaccggtgtcagaccagtcacgtcggtcattcttgtccaccacgtgtcagcttagcaatctatatgttcgtccttcttcacacaacatcttgcctgtaatggttaggatgaagcctggcatatatctgaccagggctaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacagaccggataaatgagtgcactgcactgcgttacatgcagcgtgacacgc

SEQ ID NO: 58115 - DNA, 1929 bp, Oryza sativa
ccgttattggtgggtaggaacaattgcttaggaatttctcaaattgcgtgtatgcacttctatttccaaaataaaatttctaaggaaacaatttctcacaacatgttgagtcatcatgatacggagaaaagctcattcgaatccaaatactccatggaatccgaatccaaatgtgatactcgttgtcattgtttctattagcagcactcgtccatgatcgacctttgagaccgcacatcgatccggagctgactagggcaatcatctagtccctgatcactatacactgaatctcgggcctaccttctcctcttcatcatcggtgggagtgccgttgtgtctatcatcgtgctatcttgtccaattcaaccacattttagtgtgtatctctgtaaatagcaacttacacatgtattatgacgtcgcataatcgcattgtcacttttcatatgagaaatgttgctcttgttacacgttatgacattacattgtcacttttcatatgagaaatgttgctcttgtcacacgtgcattataacgttacattgtcgcttacaaatgcatctcctcctccatgtgtggattgggtattttggtctataccaaaatatggtagaaaaaaagattcaaagtatatctgtggcatataaaatgacatgatccatacggttacaaatagataaatagtaataatattttttcgatacaaaaagacatgatcaaacgatgtctggctttggttctagtgattgtgtttttatcagtttcagtgtttcaaccaccatttcctcgatattgcattctaattcagaaactgttgttttcttcttgatggcattactcgttggctgaaatgttggatctttctgcaaagaaagatgtgtgtgccaagaggctgccgattttgcaaagtgtgtcagaaaattttgtctgaatttattgtggtgtttgtttgtagcaacggtaatggtaaaagaaatgtacttgtattttatagtgtaaccggtgtgaattcattcggttcagattcagtagtgttgattggcactgctgcgttcaatttatttatttatttatttatttatttatttattttttggaaaagcgctgctgcgttcaaattcaggctcaggctcgaggaatgtgttcactgtatagaatacaaatggaaaatgctaaaaatggcaaatggttttgtgattcagtagatcaagcaaaactatttatatcggtattacatcacgcacaacattgagagaacttatgaaccactatattgagaaatcttatgaggcattcagaaacacgagcattatattgagaaacttgaattgagaagttttaatagatgatctcatgacttagaattacttcgttcaaatgaaatctcatggatggcttgacaaaaatacctacaaaacttctgctgtcaagtgcaaataaatttggttattagaattacgccactctccgtgcgtaaaactacaaatatactgttaagtgcaaataaatctggttattagaattacgccactctccgtgcgtacaactttgagatacacttaatagtgcaatgacaatgggtgtgtggttttattctgtattcaatctccaacatgttcataatttatttttaaaaaatgtttgaagtgacatctctccctctaaatctacaaaacccagtgttaattaactataaatactttcagttatgacgtccggctgtttagagggacatctctccctccaaatcttgtgttatttagctataataaatactttcagttatggcatctagctgagaccggagcctgcaggtaatactggcatactgctagaactcatgcgttaatccctcaacgtccacaacttccttcgcaacctttggttgcattatacaatgtttggtaatactggcatactgccaga

SEQ ID NO: 58116 - DNA, 1367 bp, Oryza sativa
tcaatgtacagtactagtagtacgtgccaggtgcaacttgctaataataaatcgcttaatcgagcatgcgcaacggcacggcgagacgagacggacgcgcagctgcagaggtcgtgcgccacatgcatgcacgttgcaaccgcgattattttgtggcgtgctattcgatgtagttttccgtgctactcctatatttgttggagaaatagggacgttacccgtgctacgagtcgttctggaagaactgttctcggtggatggagccatggaggccagctagctgcagacgcagctggctcttccgttcacctggagagcatgcaccaagaggcacccttcctatacttgctagtctacccaggtgagctgtgacgttacacgtaacagctccgaagtttgcaattttgagcgttgctgtgtttgagttccttccaatcgagcaaccacgttatatcgcctctagtcttacgatccataggaattaatgggaggcgtgaaagtggcctgtccttgtatactctgttgacttgctatatgtgcacttctccaatttgtgcgtcctcttgtttcagccagctagctccgctgctccgacgtcgttgggcaacccaaaacaaagttgcagtcgaagaagagatctcgcagaagaacggcaggatctcatgccggactggaacgtaccgaggacgagggacagaacagatattggggactcctgtagcggaaactctaaatgcgcgatcgatcgcggctgcgatcggatagcgatcaccacccctcccccctccatccctacacgtttccttttttttttcaccgcattaattttttattttagtaaatttatgcacataaagtttatacacctaaagtttatagacccaaagtttataaattaaaagtttatatatccgattcaaatttaaatttgaattcaaatattttttatatatagtatttctatacatctaaagtttatacacctaaagtttatagacccaaagtttataaatcaaaagtttatatacccgattcaaatttgaatttgaattcaaatattttttatatatagtatttagatacatctaaagtttatacacctaaagtttatagacccaaagtttataagtcaaaagtttacatacccaattcaaatttgaatttgaattatatccaattcaaatttgaatttgaattcaaatatttttatatatagtatttctatacatctaaagtttatacacccaaagtttataagtcaaaagtttacatacccaattcaaatttgaatttgaattatatccaattcaaatttgaatttgaattcaaatattagtttatagacccaaagtttataagtcaaaaat

SEQ ID NO: 58117 - DNA, 1806 bp, Oryza sativa
  unsure (1)..(1806): unsure at all n locations
gaaattttgtgcaccccactgggtaatggataatgtgagccagatgacttgggtagagaaaccatctttgctcgatcggtcaaattccacaatagttctggttctaataaaacctgggattaaaaagtatctttagttccagtttaaaagttgaggggtactttttgatctttagtagatcatttttagtatcggtttaagaagttgttgagttcaagacagaccccgattatttttactcccggttggtataaacaaccggggactacaaatagatctttagtnccggttgtttataccaaccgggagcaaagagtaccccgagccgtgcaccatctcgatattatccgcgcgtctcctctcgatttcctcccctcttaatatctcctcctccatcccttcctctccccttcattcccttcctcacccgttcctccccttcccctctatttgtgatgtgatgtatttgtgatctctgatgtatttcttttcaatctgtgatgcatttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactgaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggtgaagagaagatgtccatgcagaggcctctgatagccccgcaagcaggtgtacactgttacatacatgtctagactctagagatggcaacagggtgctatgacccgacacctgactggtttttactctattagaagctaattatctattatatgctaattatgttttaactcttatacccatgagtttaccgacgggcgaaaattcttacctattaggtacatgggtatgggtctattctttatctactcgtacctaccaacccgagggtgaaaaaacctgtagattaagcctaaatccatgagtaacataaaacttctttcttatcttaagttctattctagttatatgaaattattatttgatttcttgattatgtaatatggttgtagattttttttactcgactttagcgctaatgttaatagcattgttgccagaagaattattgatgggttacggttcaaaaatagctaattatagaacaaaactataaatggtatgagtcaattatatgggtatgggtacccgttacctgc

SEQ ID NO: 58118 - DNA, 1510 bp, Oryza sativa
tccggtgccggagagcaccgccggcactggcgcgacgcgagggcgaggacgtcgagcacgtcgtcggcaagccccagctcgacgaccggcaacaggtcgagcagcgtggccaggtcgtggttgagctcccgcagctccgcctccatctcgtcggactccagcagcagccgcatccggctgcgcgccgagcaatcggcgacgatcgccttgaaccgctgcagcaccaggagcacctcccgcaggcacagcgacgccgaccgcggcagctcccccgcggcgccgcacagcagcaggtcgtcgaacgcggccgccagtagcttggaccgcctcgagatggacgcgaacgcggcgcgcaggaacggcgcgggcgtgtcgacggcggacaggtcgcgcgccaggcggtgcagcggccggagcagctccccgtcggacggcgacgggggcggcaggaacaccgacgaagagccagacgacgacggcgccgccgccgccggattaccagccattggcgcagtaaccacaaccaaaagaaaaaatccttagcttattagtggagtaaaaccaaacggaaatggtggacacgcagcggagagctcgaaaagagagagaggtttataaacttcggaggcggtaggcgtggcgtgacgagttggttgagagctggaaggaatcccctagactgattttgcctttttccgtttatttctattgtgattgttatgcatcatgtgcttagtttatttgtgatggtattaggattatcttatatgcatactatagtattaatgtattatgatgcattggctggaaaggggggcagggtcgtcgcatggtggccgttggatgtggcgcgatggacggccgggatgggaattggatgagtgatgatgagtcagcccgtttcgtttttgatcggatcgcatctcgctctcgggtgcggcggctgggtaagactttgggacagatgagggacgagctaagcacccgagtggagttaaaagtacggtgagagtggcttttgtgagaggacaggcgaagatgtggaggactagatatcgtcagaacctaaggatagctgtaaagattactttgttcaaatccaggcaattttcacgtggaagtgggagacctgtcacactaagaactggagtaactgctagatctatacaagagccggctgctggattaaggtcctgtttggtttatagagacttattccaagtccctgtcacatcggatgtttggacacttttttaagtattaaacatatactaattacaaaacccattccataaccttggactaattcgcgagacgaatcttttgagtctaattacgccatgatttttacaatgtgatgctacagtaaacttttgataattatggattaattaggcttaaaaaattcgtctcgcggattagctctcatttattaaattagtttttttactagtctaggtttaatactccaaattagcgtccaaacatccgatgtgacatgggctaaaaa

SEQ ID NO: 58119 - DNA, 940 bp, Oryza sativa
ttatataatgtggacatcatatatgatcgacctacagaagttgcattgtcctgtttccttcatataagttctgtgcatgtatttgtacagtgtaacctatttcagaacaatgatcaattgccaaattatgtgaacaaggctagaacgttgagaaatgacaatgacgtgactatgtaagtatcaagctgacttatttttcgaatagtaagaaccaatcaattagttgatgcattcaagcaaataatatccaaggagatgtcactatatatacgtgtacatcagcgaatgacctattcttttaggtctcgtcaccaatctagtagtaataatcagttcaaggatcacgcatgctctgcaggtactctggtaccagatcattctagcctgcacgcaaattcatatcaatcattgtaaaattcgtgaaaaaatacgtaggacgaaaacgatctatcttattcagtacacgcataactaactctgaaattaacctgcacttggactatatatgtacatatatacacgcagatgtgttttttagttcaatttcacttactacaaccactacttcattccggaaccgaagaaaacttccttgagctaattcgatcatttagcacgcactcaattaattaaatcaaccgcccaatcacaatggacaatacaataaaattaaggattgatacatccattggacaaattcttttcttcacccaaggtatccacaactatatctatttctagagaaacatatatataactaatctcgcacacagatcttattttccccggcttaattgtgatcacaccaaaatgttagataaatccatgcaagtcaaccaaagtatgcagcatgctcacttgtgttgagggagctgtagtcagtagtacttgttgatggctgcccggcaggatacaccggcggagacgccgacgagatcac

SEQ ID NO: 58120 - DNA, 1205 bp, Oryza sativa
aggccatcctggggcaatgctgcgagatgcccgtcgggtacgtgcagctccccgtgggggtcgccggcccgctgctcctggacggccgcgagtaccatgtccccatggctaccaccgagggatgcctcgtcgccagcgtcaaccgcgggtgcagggccatctccgcttccggcggcgccttcagcgttctgctccgggacgccatgtcccgcgctcctgctgtcaagctgccttccgcaatgcgggcagcggagctcaaggcgtttgctgaggcgcctgcgaattttgagttgctggctgctgtcttcaataggtacactccacatcatccactaatctagtttgttgatttgtgtgcttgctcaaagtgttataagactttgcgctccattggcaggcccagagttcattaatgggggaacaatgtgctctttcagtgcatcttagggtagtcgtcttatgtctgagtaaatggactgatgttcatagctagctctgaatggtattttaagatcaaggtgatttcccacaacggaaagcccttctatcatgtgattgctgacagggtagagcccacagtgtgtaagctagcacatgcactggaggtactggacaatgcattatcaatactatgtttacttgttctaagagctaccagctaaatgcagataatgccagctcatagataatacctttctgaagtgttcaccttgaattgcctttttatgttcgcttaaataataccgaatgtgaatgaatcattggtttgtgctctccaaacttgagaatatgtggatttaagatctcaacctctagtgtgtatctttgcaccttcagatgttcagggactcagggtacacacatctactgacagtttacggtgttagaattttcagattaatgtcatttgtcttttggagtttttctgtgttactgactagtaactgtcgctctgtagtcagtatccttagaggatctattgtctctctctttttttttaaatgtacgatatgttgttttgttttattttgttgtctggaacctttacgtaattgtaggctcatgttcaaaagctttggttactgtcattaagtacactttagataacagtaggcttgtgttccaataagttattgttggttttcatgtttctaattaatgtatctttcttacattgttttctgtcatttgagagtactgagaaa

SEQ ID NO: 58121 - DNA, 1088 bp, Oryza sativa
cggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccacagagccacgagcgccgacccgaggtggtgggccttcgtcctcggtacaatgctgttgagaaagatggaaaagaggagtgaggaggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaagg

SEQ ID NO: 58122 - DNA, 4135 bp, Oryza sativa
ttcctgcagccccacctgcatgacgtaagtagcagtagtaggatcacctgcaagaagaattctgagagcagcaagcgtacgtggcgtgagattctgacggtgcgtacgtggtgttgtgtgttgggcctgcaggtttccgcaggactggcttaggagggacctgaacgtgatcgggttcgggctgatcgggtggatcgcgccgtcgagcgtcccggcgatcaacggcaacagcctcacggggctcttcttctccagcatcggccaggagctctcccacttcccctcgccgccggcgctcgactcgccgttctggtcagtacctctatcttcttcaggcacgcagtatagtactcctatataattagtagcaaaagcgttcagtggctacgtgtctaattgttcatgtgggttttgtgattaatttgcaggctgtggttggtgacgtggcaccttgggctgttcctggcgctcaccttcggccagatcgggttcaagggcaggaccgagggctacttcgacaagtgaatgaatccacagtggcttttggttagcttgactgtacggacggatgtgtgcgctgcatatccttccttttgtatagggctctgatttgatcctcttgcggatgtacgctgttgtaattctcctcaactccttaaaactttaaaggacaaatatatgtgttgtggctaaatctttttcgcaattagacacagacgcacgcacaaacgacactgcatgtacagttgtacacaattacacactcgcacagaccaccaaaattactggaccaccaaaattttgtagtatcacaaaaccaacccatgtttaacggtatcgaccaataaataccataatatctgatatcatgtagcaaattttgccatttaacaaatatttaagaacacaaaattgattggtttgtaatataacctttctctttacataattcattgattatacaattgtcaaatattttagaatttgttaaatagcattattgaggagtaagatcctggctatagtatttgtggatgtagcgtataagatcggtataaggatatgcacgtagatgtcataagaagaaatgcaattagatttttacaagttcgaaccctcaatgtgagtaatagttctattcatgtttatatctattgaccgaaagtatcacactgagtatgatgtctgaggtgggatctctaatctagcatactcaactaaccttgactaagagcaggtacaatagcaggctataagccaactataaacatattttaaaaagataaagaaatagagagaatagcagtgggctacagatctgtagccagttgcagcacggactccaaaacataatgtgtgtatgatatataggatcagatattaatagtatagtaagcaactattgtatgaattggttattacattggctatagataatttagagctagtagtgggctatactattacaactctaaagatgcggcaacaatgcaattggcggctagctctgggcttcccctaaatggatttggcatgaaggctgtggcttgagatttgacgccctattctcctaggacgtggtgtgtctttataccggaatacgaccctggttcaagtagatcttgatcccaagtaggacactagatcttgtccatgaagccataacgtctatgacttgaactatgcaatctttccttgtgtgacgcgtattcactcctagtatacccctattcatagatatctttttgtgtacaattactccctccgtctaaaaaaaaagacaaaccctggtttccgtgtctaatgtttgaccgttcatcttatttgaaaaaattatgaaaaaaattaaaaagataagtcacgcataaaatattaatcatattgtatcatctaactacaatgaaaatactaattataaaaaaaattcatataagatagacagtcaaacgttggcacgggaacccaggtttgccttttttttttgggacggagggagtagataactacattccccgtaaagtaagtatgagtgtatgggatacctcatatctactacttcctccgttttatattataagattttctagcattttcaaaagactggaccgacatatcttaagattgatgaagtcaacacgaacatcttgctgtcgataggtatctcgtctaccactgaaagaataattagccataattacaaacacctgtgatatactctcttatttcctaaatatttgacgccgttgactttttaaaacatgtttgaccgttcatcttattcaaaaacttttatgaaatatgcaaaactatatgtatatataaaagtatatttaagaatgaatcaaatgataagaaaataattaataattgcttaaattttttaataagaacgaacggtcaaacatatttaaaaaggtcaacgacgtcaaatatttagggacggagtgagtaggacttaaggtctgttcagattatagccaaaataaacctagacatagacttattcaaaaattttggcaatattgtcaaaattttggcaggattttttatgtatttaccaaatttaacaacaaactaaacatagacatttctttggcaactttactcaaaaatagtatggttgaaaatgacatcaatctgaatagccctaaatcaggctggcctgggtcaaatacaagaaacataaccggtgagctattcttgaacgaacgtaattcaggatacaacatattgttttgattctacataatttataagttgaatttccaaaactcaatcaaaccatcaatcttcaaatatttcaattggatatatgaaaaccatgtgtagattttcttttaaaaaaatcgtaaacatgtacaaaaaaattctgaatttttacattagttgctcgtttgctactgggctagctagcagtctagcaccacaccaacatggctaggcccaagcccaactcgtgatccagtcatccatagtcgactcgactttgggttcgagcgatcgaaactcggtaacccaggcgaggcgaatccaaatgcgaccacccgctggccggcctccccgctcgccgccgccgccgccgcatgaccaccgccgtcctccggccatccccaccggtcgccaccctcctcggccgctgccgcaccgcgcgctgcctcgcccagctccacgcccgcatcgtccgcctcggcctccacaaccaccacgcgctcctcgcccgcttcgccgccgcctgcgacgccctctcctgcccctccgtcgccgcctccctcctctccgtcgccgtcccggtacgcctgcggaacgccgtgctcgcctccctcgcccgccacgccccgctgcgggacgcgctcgcgcagttcaacctcctccgcgggggcgcgtcccgcccggacgccttctccttccctcccctcctctgcgcctgcgcgcgcgcctcctccctccccaccggcgcttccttgcacgccgcggccatccgcctcggagtcgacgccgacctcttcgtccgcacggcgctcatccagttctatgggaggtgcggcgccgctgccgccgcccgggctctgttcgattcactgacaaaccccagcgaggtctcttggacggccattgtcactgcctatgtcaactctggtgatattttgactgccagggagttgttcgaccaaattccacaccgaaatgtggtgcattggaatgccatggttgatgggtatgtgaagtgcggtgacttggagggtgcaaggaagctgtttgatgaaatgcctgagagaactcctgcagcgtacacatcattgattggcgggtatttaaatgcagggaacatgggagctgcgagaacattgtttgataagctagaggaccgtgatttgttcgcatggtcaacaatgatatcagggtgtgcacagaacggttaccctggagaggctttgaggatttttaacgagttccaaaagcaagaaatatgtccagatgagcttgttattgttggtttgatgtcagcatgctcccaacttggtaacatcacattggcaagatggattgaaggttacatcatgatttatccaatagacatgaacaatgtccatgtgatggcgggtctcattaacatgaatgcaaagtgggctgcagg

SEQ ID NO: 58123 - DNA, 889 bp, Oryza sativa
tgaaatgggatgcgtaaagtaattccgggacagcgaagtcaagtccacgtcggtgtcaagtcgtgcgtgcatggctttgcctacagccgacacggacagatcgtggacaaaccaaatctgccgggtggcccacctacacatggcctgatcagccgattggggatcggcccatcgaagccgacacaccgcacggggggcccatggcttcaagttgcaaacagtttgccactcactcgtgacccattgacccaagtagagctcaccttctgtaggagacgggcacgatgccggcgcggtacacgccgatctggaggaaggccggctcggccatgtcgaagtgggggcgcggcgggttgcaccagccgccgtcgtcgttggggagcgcgtagttcggcgggcacaggttggtggcggtgacggtgacgctgcccggcaggcaccactgcccatcgttgtcgcaccgcagctcgtagcacgacccgcacgccgcgccgtcgttgaacagcaccgtgctcagcgccgccgtgttggtgccgtacccggtgctgtacaggttcccatacccacacgccccgccttttcatgtacacaaacaacacgacacgagtcagattactcccggttttgtcaatgcgtccaaaaaaaaaaaaacaaagtgttacgaggagcagtgcacacgtacccatcgtgccggacgcatcgccgccgccgtagaacgtggcgtgggcgctctgccaggagccgtagtcggcggcggctcgccgggcgaggaagcagaaggccgagaagaggaggagcagggcactactgcgtgaggccattgttgcaaaacagggagaagatcacactaccaacaatgtcctgctagctacttcactcggcttaagct

SEQ ID NO: 58124 - DNA, 3479 bp, Oryza sativa
taggcttttgattggtaagggcttgtttacttttgtgtcacttttaaccctactaattttggtattatcaaatttttgtaaggcaacaaattatacatattcttattaatgttaccctaccaacctttggtagggcctgttcactttgatgctattttcaactttaccaaattttggtaaagttaacaaaaaagtggctacatttagtttgctgctaaattttagtaactatataagaaatcctaccaaaattttggcaagttgtcaaaattttgacaacattgccaaaatttggtaaggttttttttcggcatcaaagggtctattcactttgatgccattttcaaccttaccaaattttggtaaagttgccaaaaaaagtggctacatttagtttactgtcaaattttggtaactatataagaaatcctaccaaaattttggcaatgccaaagtgaacaggcccaaagttaacaggcccgtagttttataagtttccactcgtaaaaattccatcaaaacttgataaggcttcaaacaaaacatatctagcactaaaaatttggtaatgtaaaaatgtgttaaaatttagtataaccaaattttggtaaggttaaaagtgactataaagtgaacaagccctaagccaaataatttggcaatatcaacatttattttttgattggttaattttggtctcaaacaaaagaagcctgaagcctgaaatctgcaatctgaaatctttagacagttcccgtgtactatctccatcactaagacttcatttttagcccatttctacccatgccaatacaaaggaaaaaaaaagaatgttcttactttagcaaactccaatataattattctccactttagcaaatctcaatacgtttgtctcccaatactctaatgcaatgatcgctgaaaaagatggcgtctctgtaagacaaatagatggaaaacaaacttattctgagatgaaggaagtaataccatagtagcatccaaatctttggtaaaactatcttttctcttaaaaacatggtaactcaaaacattatactaatgtaaaatcggataacttagtaccatcttaaagatactcgagttgtaacataacatcgtaacatgataatgacatataaaggctggatctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttcatatggttatagttttgtggctaggaaccttatagtacatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccaggacattaatgccggtgagccgcccccatcgtcagcatctcagcggtatgcagatgccgtgccgatcgttcgacggccttctcccccccgcgaggaaaacgatatccttctaaacgcaattaagaatcagatacacggacacacggtacaccggtgcacaacagatttgctttgccatcaagccagaaaaaccggtcgccgtgaaaggcacagggaaacaaaacctgtttttcttttggttctctgtcacgtcaagtgcaacgaacggcacgtctcgcttgcgtttgcggttgcgcccgaccaaccagccgatcgcacgacgcgtaccgactcaagagtcaggtagacgcgccgcggcgtggcacggaggagacacggcgcgccacgcgttcgcggcctgagatgatacgccgaggcgagccgcgtcgcgccgtaccacgggcgccagcgcggccctggcacgcgccaccgaccccttctcgtcggctgccacgccggcgccctgcactgcaagccgcgcccacacggccacaccggcatgcgggttaaaacgaaagaaaattgtgaaacacaccaacgcactgtacaggtactggaccacgtcgcagccaggacggctgtggttttgaccagagttcaccgcgcttactactagtagggcacacaaggaggagtgctatataaaagccggaccacggcggaggcgcagtagttatcaccggttcatcgtacaaaagaggagagagagggtgatggcgccagggagagaagaagagaaaatggtggcgactactacgatagaggacctgcacggggctgcaggaat

SEQ ID NO: 58125 - DNA, 2262 bp, Oryza sativa
tttgctggtacacaacagaggtcaaacacgaagttttaatggattcccccaaccaacttcataaagcccttttgaaaattttctttcggagatgcgtcattgttagtttaacagtacaaattacttctatgtcatcgtaatttagtaaattatcactaccatgcaacaggagaagttttatactagcagcacagggcagcagctgatcgctcctagcaggcggaaatgatagcgtgatgaattcggaaccatcgatgtttcaaagatcacgtattggaggacaagaaaacaaaatcgcggttagctttcccgtcataatccgttcctttcaaagagaacatgcgtgccaatctttcaaaaagaagtagtctatcaagtgactaattaaccatccatttcgtgcccccacgccatgttagctgcacatgggcatgggccgcccggacatcacgggcaatctcctactagctaccatgcgttgattcgccttattttgcaagcgtcccgagctttcagctccgagcatcataaggttcacgccacaattcctttccctgtttacgttggttacttgggctgtaccgacggatatttgagctagccgagcattgagcaagctctgcaatctgccatcactcacgttcgataaagtatgtaggaaccgcgtagagcgtacacgagtcttaaattctaaggcacttctaatttgaaaaggggcttattttcactccagacaatagtacaacaaagactcttttatggcaacttctactgctaactgcggcaggattgtactctatccgtcccgtaataaaaaggattttgaaagaatgtgacacattatagtcttacaattttggacatactctttgtccagtttcgtagtattagaatgtctcatgtccatttaaaatcccttatattatgtaatggagggagtataatctaagtgcgtgattggtttgagaatgaggtgagataatctatattttttatgaatggaatggtttagtcatatgtttgtcatgacagatagaatcgttatattttctttacggagggtgtggctcatttgtcaataagagagaggaggtgggtaggattgattagtccgttagtttctgaggtgtaaaactgacccaaatcttatgggattacgaaccatcccatgatccgatgtcacttattcttaaatcaaacaacttgaaaaatggattcgcctcatctcaatctattccgttctttcaaccaaacacatactaaatctaattacagttgatcataagcatttcatacaatatgcgaatttaccttggttgtgtggtttttggtagaggcggattatgtgaaccacttccatcataaataagttaaaaataccatataatataaattttaaatccaatttttgctcgtcaaaatttttaccaccgacattagcatgtacagtactcccttcgtctataaatgatggtattaacatgcgaagtgtttcttttgtccgtaaatattaggggttctaggttatttaacagtagtatagtattgagctggggtgaaattgtcctataggtttaccagattagtaaagataacgccaactatgcaaataaaattgagcaacaaatgtaatggttggatgaattggaaaagtaataatgtaggatccgttatattataggcaaaatttaaacatcaaataatttaattatttgtagatagagggagtataatagaaccaggtctcacattgaaggcattgaactattcacgccatgcgctgaagaggccatgactgtttggaagatggagagagagcgaggagcaagcatgtggtgagtacaccaaaacggaccacaaaatcttgccgtgatggcgactgaagcccagggaactcatctgcaggtcgcacccaaacaaaaagagattcatcatgcacgaatggaacaccacgcctactcgtctgaagagaatctctcgtagcagtagggcgctgcaaaatcttcttcatccatccaaccggctcgatcatcagagacaccatcatgcatttcgtggttgttacagcactggttaatgacggttggaaggaaggttttctttgccccggtcggtggttgtccatgattgtcgaggagaatcgtgctcttcgctcgcttaaacatctcatcaattgcgttagctagggcacgctcaatcatacgagaaaaaagcaatttgcaagcggttcgctctcatttccaaagaaagggagctagtagt

SEQ ID NO: 58126 - DNA, 4218 bp, Oryza sativa
acactttatcttgtcttccaccaccatcatgtcaggcatcaatagacccccccttaggaacctctgtgcttggttcaccactgtacttgagatcaacatttccaatctgtcccccctcaatgactatctgctttccctccctctgattactcttttctggaaaatctgattgcatctatgttttcccctgtagatcatccaaaacctgatcactaaaccaaccttgttcagtgtaacgccctgattttcgttcgggaataaaaatcaattaataatacattttctagaaattaaataaaagttaaatcaacttaatcaagtgaattatagaggaaattaaaatttcctttaaaaattattggccgggaatattttgtaatattctttgtgccctaatgtactctccggaattttccgtgaattttcggagcttgagaaatagttttaatagcacaaagatcattgcatcaattaaaataaaaagaaaacaaataaaatcctccttcctctctttgggcccttttcggcccaagtcttccttccctcccacggcctgcgcgccccttttctctccctctcgggccagcctcctccctcggcccgctcggctctctctctccctcaagtctgctttacctccctcgcccgttttcccttctctctctccccgacaggtgggacccgaggccccacctgtcatcttcttccccaacctcccgtcgccccaaccgccgccatggccaccccgtgctccccacgtcgccgccttcctcgcgtggttccctctcccgcgcatgcgtggacgcggtcgccgcccacgtccgcgccgtttcccccacgccctgcgaaaaccgttgccatcccgagctccacttcgccaccccacgtcgccagccgatcccgcctctcccgggcacgatctccatccccgagccctatataaagcaccctcgtgctcccctctttcgtttcccactccatcccgagctccctgcgcttttccccgctctccccacgccggtccccattgccgccgctcgccagcgttctccagccgcgtgcctcagccaccaccgccgtctccgcgctgcgccgccgccaccgccagctttgccgccgcccgggcaagctcggccaccgctccatttcccctctccacctccgtagcgccgtagccacgcgaaccacctctctccgccgccgccgccgactccagccgcgtcgcgccgccgcttcggtcgacgctgacccgcgccgttgcctccctcagctccgcaaggacgaggaggacctcggtcgccgcccctctttgccggaaatccgccggagctcctccttcctcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgagggtgaaacctgaggtgtggtgtgcttggctagagggggttatgcgaagggtcctgtcacggcctctttccggtatgtcgtggtggcatgtcggcgtacggaaacgtgtcgtggggctgtgtctcgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccacaaacccctccttgtatccccttgcacatctgcatcgttggagtaagagtaagagtccggtcaaaaaaaaaaagtaagaaagcgaggcaagcaatattttcatggatcctgcaccgcctacttatgtggttctcattcttcgccaccatcttcagcaagctcttcgtctacgtatgtaaaatgaagtagtgacttagattttatgtgttaataatattggtggtttgtgatattatatgtgtgaaagattagtttcttgttatgagatttcggagtataatagatgattggttttgtgaaataacggttgttgtttaccggccgggtgtggctggttagactgtgggttatgtggcagtcagaccggccagcgatgtaggatctcttattatgatcgagttttttgttgcaagatttaatttcatcctcatgtgaattcacgcgtgttttatggttttggtgcagcgaatctgatcattcatgtacttcacacgattctctagctagatatttgcattcactgaattagttgtatgtgcagaggaattcatggcaaccttatcttctgctgcttgcaaattaatccatgaacacttctaacgccaaaccgttgagaattctttagaattgtgcgctgggttagttcatcgatttcgctatgatgaagtggacgaatagggaaataggcacgatcagaaagtttgattttctgtttcatgttattctgacgaaatgtttttgaatctagctaaatgtttgcttagctttattgagcacaatgcattggattaacggggacgctactgagccttgattaagaatagtctgagttttggatcacgttaggagtttatttaggatcatcaatttttgacagtatagcttctgtaaccacaccttagaacataccgtatgagtatgtgatttgaaaccaattgtttcagcacataaacttgtagtatccattagaattatgacatgttgtcatgctgat

SEQ ID NO: 58127 - DNA, 1223 bp, Oryza sativa
tcctcctcttccggatgtacagcgcggcgaacagcccgagcaccacggcgacggcgcaggatgacacgccgacgaccaccccgagcttccatccgggcagggccgccttcttcttggtggcgccctcgtcggggagcatctcgacggtcatgttccacatgagcacgcagttgagctcgtacgtctcgccggtggacgccgagaagccgaagtagcccttgttgccgcggaggacggtggagaggtccagcggcgcgtcgagcaccggggtcgagggctttctggtgtcgttcttggccatgtacacccacacgtgccgcgacgtgccattgtagtcgacccagacgaagtagttgccgtcgtcagtggtggtgttgctgggcgcgagctggatgccgaatggggtgagggaggcggaggcgttggagcggacgccgttgatgtcgaggccgacgtggttgtcgtcgatgtcgtagggctgcttcacgctgtccagctccacggccgcgaacccgttggtggcgttgccgtcggtggaggcgttggtgagaccaaggaactcgccgtggctaccgaccggcggcccgcgggcgttgctggacgcgacgacgaacgcgagcccctcgcccttgaccgttttgttcaggttcgagcggaacaggttaaccttgaacacggtggagaacgaggcgacgtactttccatcggcggcagcggcggcggagttggacgacgacgacgacgacttggattcccagacgacgaacggggcggtgaagaaggcgtggccggcctggttgacgaggaatatctcgggcctgttgccgctgtccggggtgagctgcaacccgtcctgggcgatggtggcgttgcctgagaaggtcaggttgtcggggagctgcaacaggggcttgtcgaacttggggaaggagaatgtggtgaactccttgccgtcgacgttgctggtgaaggtggtggcctgcgcggtggcagatgggaggagcaagaaaacggacacgcaccacactagcatgagcacggccatggcggcacggcggagacggcgcagaagcaacatggagcagtggagttggcgatgcataagtaaagggagatggagttggtgatgtactgatgtacagtcaagggggtattcgcgggaaggaattggtccagtggttgtcgacttctcccacttgcggacttgccaatcgtgccacctg

SEQ ID NO: 58128 - DNA, 777 bp, Oryza sativa
atgtagtttttgagtttgatgtgaccggttacctaaagtgtctggattagggaaattccttcgcatggacccttctgcgaagcctgctggataggcattatctttcgaggtagctctcatctggagtccggacctggaggtgcctttcactgctctggccggcaaatcctgcgtcagcaagctacaataaaaattgcaaatctgacgtatatgatcatgacgaatgattatccattttcctaaggccttgtttagttacaaattttttcttcaaacttccaacttttccatcacatcaaaactttcctacacacataaactttcaacgtttccatcacatcgttttaatttcaaccaaacttctaattttggcgtgaactaaacacacccttttctagcaagtatgctgggtaaccacaatagcactagcattgtcaagtctgtcacacactattttttacacctatttaccctgaagctgtgcattttactatccacttaacagttcgagtacacacatacgggaaggccaactgcacaggcatcaatacactacggcacatgggggcgtcaattgtatgagttcatgcatagctgttactatctctaagaaaatagtgccactcaaaccccgacaggcacggttcggccagtcagcgaaacgacttcttctagtaagtgaagcagattttagtagaggtaagttctaagtaaagtgactgcaaaccttggtacgagaacatgaatgtaccatagcccagaaattcagcaggtttt

SEQ ID NO: 58129 - DNA, 3528 bp, Oryza sativa
cgcacatccgatgttgtgtatgttcaatattgtgattcgggtaaaatcattggctcattgtgcatgtggcgcacatccgacgttgtcaattggagcgatcgttggctcataacaaggatcacacgtgtgaacgtacctagtaggctagtaccgtggctgcgccccttgctaagcttgcaagcactagtatcagcctgcaggcgagcagcatgcacaaccgtcgatgatgctccactaatatagtcagagagagaagtgcgcctcttacatgtgagagtgcgcttcttacatgtgggtctatggagagatcttctgacgttaaatcagagaggcatggtggctgatatatgggtccataaatgatgagtctcatatatcagtgaccatgtgcgcgctgtacactaatgtgagaggatttggtttcgtttaagcagagcacacaacctctgaatttcttcactgttactagttgcatgtttcctctgtttctcctctgcgggcataaggcataagcgagcatacaagatgtaaaaatgtatagcaagttttttgaactaaaagtgtgaatcgatgaacaaaccaagttgtactattattcagagaattcaggggagcgtctctgcatccctccgagataatatgatcaagtacacactatcctggacttggagaaacaactctacggactgaaatcacgaagtcccacggaagatggaacccttttatttggtgtttgacactgacactaaactgcacgaacgcacaacagcatacagctttagtaagtaacacgacataaactcgataaattaagcggatgacagacacggcaccggcactgcatgcagtactctttgttgctcatggcagagtgtaatctgtgaaagagaattgagaaggaatcgatcatgttagattgttagcgccaaccaactgaaaatgatgaaataatcatagattgttcgtggcaagagttgacagtttgacatgttgattaggctgtcttcttcccttttttttttcaactctattcctccttttcaaattattaaatgatgtgattttttataaaaactgttactattttttaagtttttttaattaatacttaattaccatgcgttaatgactaacaccgttttctttgctgctcccgatctcagcttacctccgcacttgtagccgacggggcggtcggcgatgttgcagcgcttggggatggtgatggcgacctcgggcttgatcccggcgttcctggtcgtgctggacagcatgacggcgcagaggcacttggggctctgcttcccgatggtgtgcaccgccgtgcagcacccgctcgacggcgtcgacttggggtccttggccgccgacgcgcacggcgccagcttcagcgccatcttgtccggcggcgtcgccccgcactcccctgcaccgtccgccgccgccgccgccaccaccaccagcgcgagcaccaccaccacgacacccctgatcaccgccatgtcgatctcgatcaatcgatcgctcacacacacacacgcacgcactgcgaataactagtaattaactaccccctgtgtcacgctgtcacgtagtttttcgttgatgggcttcatggctgctggtgctttatatatatacaggcgtagcaggtgaggtgacacccccatgatggtcggggagagtggtggagcgagcactatcgcctcaccggctcgcgtcggccaatggcgccgtgcaagctcggccacccgcgcgcgcggcgatcgaccgagaccgagcggagagatagctcgctcggtgcgcgcgctagtgggtgggtggttgtctcggcctctcgtcgacgcgcgccgcgtttgtgacgacctacctgatcaagttcgcatacgtgccgtgctctcaagtctcaacaacgcaagcatccaagcatggctgcatgagcctgagaaaaagcatcgtaagatggttcaatcaaatgttgttgcgcagcggtagagaaaaagagatctcgactagtttagcgagtactagttttgaacgtccactccttacttccactccttacttgcatactactcaaatagttataaaaagcttttaaaaaatatattaacatgtgatatatcactctacaaacatacaacttaaaatttaacttctgtatatgacaacaaaaaataaattaaacttacaagtagaaattaaatgttaagttacgtgtttatgaagtgatatatcacatattaatatatcttctagtttttattaatttatttgtaactatttaaatgatatgcaaacaacagaaaaacatccatacaagagttttggtggtgtgtcggtggtgttggtcatcatttcgttcatcggctaagcacttagtactaattataacctactaggattgtcaaaagcacaaatgtaaacgtgtaagtattctgatgactgatgagaaaaaagagtgtaggcgtgttaggtgtagccgtgtaagcgcgcccggccggcacctgtgcacagcaacggtgcattgccatttgccacaatcccaaattcgatgctccgttcataagggagtgtctctagaaggagagtgccctcaaaattgaaaaagaaattcagatcgacgcttcatcctggccgtgttgggcagtattattacaaacttaaaaattaaaaaatagagttggacgaagattaagatagtctacctaaaataaaaaagccattaacatataattaaaatagagttggatatagattaagttagcatacgtaaaatgaaaaagtcacatgattaattaagttttaattgttacaaacttaaaaataaatttatttgatattttaaaattatttttatataattttttgaaaaacatattgtttagcggtttagaaaacatactaataaaatccttggtaaaatccacgtcttaataaaaaaaacaacataagatatgtaagcgagaatgctgggctaagtcatgtgcccatcagcccatgtgtgtctagtgcccctgtgcagcgggcggtaggcgattcgcgccgccgccggccgtggggcgtcgcgtcgcgtgatggtagtatcaggtgggtgggacaattgggatggaaaaatatactttgactccctcaactatagctccgagtatgattcatatcctttaaccacaaaaccaggtaaattgactcctccaactatcaaaaccggtgcaaattatatccctcggtgattttagctgacgtggcgcctacgtggcggtattgaccaagtctttgttctacgtggcgcttatgtggcattagaataaaaataaaaaaaaggtaggacctacatgtcactcacacaaaaaattatattgtgggatccattgatatgtgagacccacatgtcatcctccctctagctccttcccggcttcccttcttcctcctccctccttccctctctcccccagcgtttctcttcaccccggccggagcggcggtggggagtggcggcggtggcggtggtgacagacgaaggga

SEQ ID NO: 58130 - DNA, 849 bp, Oryza sativa
agggcgaggtccgggacgcggagggaggcctcgaggaactcggcgaggacgagctcgtcggccgccgcggagcgcgcgccgcgcgccgtccggatcggggtcggcggcggcgcgcgcgcgggggcgcggacgcggggccgccgcggcgccctggacgtcgccgtcatgccgccggccgatcggcagatcaactcggctgcgagcccgcgacgcgacgtgctctcttgaggttgggtggtggttgcgtgggtgtaaagaaaaacgtggggacgggaggtgaccgtgggatgcgctggtggacggtccagatggagtccgtggtttggaatcgtgttaaattggtgggaaagtggaggcacgacggggcaggctggctggctgacgacttgacaagagagatgggaggcagtatggcgcaaaggtggcggtggccgactgaccggtggggtcacaggctcacagcctgaggcaatgtttggctaaattggaaatggaaatgatttcccacccacaaaaaggcatcttatatggtgtctgattcaagttggacggccggatcagattcacaatccatcgctatcgtcggattccgcgagataaactgacataagccagacaaatctggacaaaaaatgtaaaattcagttacagttttttaaaaagcttgaaccaaaagccaagcggtttggcccgatcagcagagtttcgtgcacaaagatggcctttagagttctggattttggtcaggaacgtacattgagcatccattgtgtttcacttggctgaatataaagaaaaagtaacatactcgggatttaggagaacatacgatgttgctctcacaagcat

SEQ ID NO: 58131 - DNA, 1092 bp, Oryza sativa
cggtacataactacagtctacatatatacctgatgatattgtttaggatgcctggttgagagttgagacgggctcacgcttctgctgttgcaagccaccgtgtctggctggtaagcagagggaagagcttgcaagtgggttggtccaagtggtgtaaagttttggttctttttattgacatgccattctctacaggagcactgctgtttttgctccattttctcctttctcttttctccttacccccacatctgttattatagatctgtgtaaactgtaaacttatggccctgcctttttacagtagattctttgatagatctccctccggggttacatgcagtgtttgttgttttgtgtgtaaatctggattgcacattactcttctgtactatccattaggccatcagcaatgggtaccttcgacccgtcccctcacaaacggccgtttccctcccgtcctcttttcggcgtgagccgtctccccagctaggagcgcgtctactccttgggagacgcggctctatgcaaggagcgctcgcttttcgcggagagccggccctcgcccctgcgaggagacccgctgcgaactcccgtctcctcaccgctccccccaaatccccttcctaccctcgccccctcgcctctctcccacggcggcgcccactcgtcgatccgctccaccggccgccatcgaccggcgggcggggaggtccgcgacggcagggaggagctcggcggccttgaagaggaggagggcgagccagtcgtcggcgaggcggcgctgggcggaggtgccgggggcggcagagtcgagggcggagtcgatgtgggagaagagggtgtgggagatggcgatgtggatgaggaagaggagggagagcgggaggacgaaggtggcggcgatgcgggcgaagagagggcggtcggcgacgatgatgatgagcttcgtcggcgacggctggagggagagaggggagcgggaggagggcgaccggcgctgacctcgccggcgagccgccgccgtcgctgcccgaggccagatccggcaagcccaggccggatctggccacctcgccgccactccgacga

SEQ ID NO: 58132 - DNA, 1527 bp, Oryza sativa
atagaagaaaatgagccgggcaacctctgtaacatgttacagtatgatatttgtgaattttcaaccaaattctgaaagttttcatcttaggggtatttttgtcattagaacaaaattgtatggtactaacggaggctaacttgacggcgatggtaaattatagaagttaaacaaaaagcgatggcatagtatggaactgaacaaagtcagtggcagattgtggttccagggcaaagtcagtgatacaggatagattttctcattgttttaagacaattcaacaggaatacagagtatctcgactacttaggtactgttaatacaatataaaagcatgtatacaaaccagaaatatttagggcctgtttagatctcctggcaaaagtttcatcctgccacatcgaatgtgtagacacatgcatggagtattaaatataaataaaaaataactaattacacaaattacgtgtaaattacgagacgaatcatttaagcctaattgctacatgatttgacaatgtggtgctacaataaacaattgttaatgacagattaattggacttaataaattcatctcgtagtttacaggtggaatctgtaatttgttatattattagtctacgtttaatactttaaatgtgtatctgtatatccctggatattattaatctgttatattattagtctacgtttaatacaggcggtctatatcctatgtgacacgtcgaaacttttcatccctggataaacagggccttactatatttgttaaatagtacataaggtgtatatttctatcctatgttggcaccatatcgacaccaggccatcagctaatgcctgttggtaccggatcttatactgattaaattacgaaattgctagaattgtatcgacacattttctcctccatcacagtcggcgttttgaagcgtccgatttcctttatcccgtgtcaatgcgatcctgtccgtgcatattgctatggcaggctaacgttgaggctgtcaacatgattaattgattaattaaagcttaacgtcttcattagttcaaggttttacacgcatgcatactatactttatacaaatttacaccccacttaaatcccacttacacaccacttacacatataattactgtgtaatttttagacttacatatgtaattttgaaacttacattataaatacactaaatttacatatgtaatttagggacttacaatgtaaatacatgctaattattttttgatgaaaaatatgacgtcacaaatatagctactcccttaaattaagaaaaactaaaacaccttactcgtggtcaggcaccaaaaggactcacacgagttggtgcacaagcacaactgcgcactgctgtaaggttcaggcatccgaagacattttgtgtctcctcagctaccgtaccgtgggtactttacttccccgtcacttgctaatttttacagctcgctcaacgctctttaaagtttacactccgactgttcaacggcggggagtgcaagt

SEQ ID NO: 58133 - DNA, 1163 bp, Oryza sativa
ccctcacctccatctccgccaccgagctgcggtcgcgaagggacgcgatgcggcgggtgatggcgtcgaccttcgggccgacgaagggacgtgaagctatgggacgatgacgccaagagcttcggggacgatgacggacggtcgggccgccgccggatccgtcggcgcagccctccctatcgtcggatccgccgccgccgccttccccaccacaggatccggtgccgccgagcccctcaacgccgccgctgccgagcttgtctccaccgtcgccgccgagcctgccgccgtcgcccgagccgtcttccgtcggcgcagccctccccatcgttggatccgccgccgtggagccttccgccgtcgcccgagccatcttccgccgcccgagccctccccatcgttagatccagcgccgccgatttccccaccacaagatccggtgttaccgagcctgtggcttaccgccgccgtggagcctgccgctgtcacctgagcctgtcgccaccgctgctgccgagcctgttgccgccgccgtcgatgagcccgccgccgtctcctgagggcgagcagggcaagtgcgcgagcagcgtcgtcacgccgttcgctcgtcccagtccgccagttttggccggatgagttggtcccggatctgagagaaatattcctctctagggaccaacccatcccacctcatcccagcaaccaaacactacctaaaattggtctcaatcgttcggatagcgcgtgctctccaggtaagtcaggcgatctctttgttatcccggctgggtttcgttcgaacgctgcaatgctgcgtacctgtcgtccactcgtcccgtgccggtcgccgtggcgtcacgctcggcgcgcatgcggacgcagtcccgatcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacgg

SEQ ID NO: 58134 - DNA, 717 bp, Oryza sativa
aaactgatttcccaaaatttgatggagacaacccaaagctatggaaaactaatagtgagaagtatttcagtatgtaccaggttccttatgaaacttggtcatcctttgccacactccactttgtagggaatgcagcgttatggttacaaacctatgaggagttgcactgtgtagagagctggccagaattgtgtgtagtagtgcatgggaagtttggtaaggacaagtaccaacaacatttagaggagttagaagggttgagtcaagttgggggagttgatgagtattatactaaatttgaggagttgatgcatagggtcttagtttacaacaagagatatgatgagacattttttgttactagattcatggggggtttaaaaactgagatcaaaacaactataaagttacacaaaccaagaacggttgatctgacattatctttggcaaaaacgcaggaggaattattgctggagagtagcaggaagaactactccaaagaaggatacaaggatgcttacaagccggtgattaaacctgtttatcaaggcaaagggattctgggagcatcaccagaggaggctaagaagcctgaggagaaacccaagtgggaggaaagatttgacacactgaaggcagcaaggagagctaggggagagtgcttcaagtgtggagaaaagtatggcctagggcacaagtgtcctaagtctgtacaat

SEQ ID NO: 58135 - DNA, 1326 bp, Oryza sativa
ccgtcttatttaaaaaaattataaaaaaaataaaaagacaagtcacgcataaaatatttatcatgttttatcatctaacatcaataaaaatatgaattataaaaaaaatttatataaaacggatagtcaaagttgaacacggaaaaccagagtttgtctttttttaggatggagagagtacctcagctttgtcatttccagattcagcacaacagtattcaatgcagaatagtagcagcctactgtatgtttgcttgcgttccaagtgctcaccagacaagctactagaagagaagcacactgctaagggcatcagcaatgtgagccactactagaagagtgtcctcattaaccgaggagggcactcatagagggctatagagtacaacctcacgatgtattatccccctgagcagtggctgagggcactcatagagtggctatagagaacaacctcacgatgtattatctccctgagcagtggcttcaaaatccaaagcaaccgggtgggggtactcaggccacagtgggtgtcctagtccacagtagccccaggtggcaaattcccgaaataccctggaaccctctagtcaattccgatcgagacgagcccaaccgtacctgtgggttcgttcgttgccgtttcaattcgacaccaatcacaccacacggcgtcggcgacgaccgttctctctctcgctcagtgtctcccccaaattccaattccacatcatcaaaaagcagagttcaaacacagtttacacacaaaaatgcttaactgaaccaaacatagtactacatgggagtaatagtagtacacaaggaaggaaggaccaggcctaatacttgctgatccatccaacaacttatacgatccattatctaagaaaacagcttatacaatcaaacaaaaactccttaagaccaagccaagaactagaagaaaatacagcaagcatcacaaactagtaagtaagctacaggaggttcttacttaaaaaccttaacaacctccttaacctgaaaggctaatacgacttacttaaccacgcgaaatcaagatcgagcaagaagtatggatggattagtgcttactctaatatggcaactaatccaaccaagacaggggcgagaggaagagatcaacaagagatttttaagtatgaatgtcttcatacttagaactaatccaatcctcgtggtggtgttgctcctcgccgtgcggttgcaggtgcgggtggtggtggtgcttctgctgctcgcggtggtgggtcggcgcgaccatcatgccggtctggagcgcgtcgacatgggagccgacctcga

SEQ ID NO: 58136 - DNA, 4039 bp, Oryza sativa
gtccacacgtgaaagaacctaatgaatatcgaagactgctactgagttgacaccattccaagaattgaattcattccgcaaaccaggacctatatcattaccaactccagacagtcttgcagaaactattaggggatttcaactaatcctcacaatatcggttgtgccccacgcgcccatatgatatcgatataggagatcgttttaaatctaatcggagccacaacttaataagattgactagtcttttaggtaagttatattctactttctccgtttttaatagatgacaccgttaaattttgaacatgaccactcgttttattcaaaaatttatacaaatatataagatatatatcatacttaaaatactttgagtgataaaacaactcacaacaaaataaagtataattacgtaatttttttaataagatgaacgatcaaacgtgtgataaaaaattaacaatgttatctattaaaaaaacagatataatatttttaagttgtgctctccataataagacatcttttgcttgatgtattacaatgacgatgttgctacacgtggacactggtgcaccatcttctagtagatgtatcgttcatcgcagagggcacaaatttctctatcacatataggaggtgcagagcaaaatgatggatccaccaggccccgcgtttgctgcttccgctgaaaaacaccgtgaaaacaaactaaaatggggcgcattgttcacaaaatttcgctgctttggcttcaaacgaaatatagggcgatactcctacaaaatcgcaaacttgttgtgtggtgtacgtataccactcttagaccttgttcggtttagagaggtttaaagaggattggagggggaataatttcaaatcccctcaaattctttcctcatagggattaaccgaataggccttatgattattcttttccccaattccggaggccattttgtactaacattgctaactaatatctccgtaccttatatgtggttaaattatgagaacgttcgactcgcatgcaacaaagtatcatgtgcattagccatttggcctgcaggtcatcacataaggcatacttgttagggtgcacagtacacacgctactaattaagcgaaggtgtgtcacaccctcacacgttccttgtgttaaacatagcacacgccacgacctgccacacttattttgtgcacataaatggcttgtcctaattttaagtcaaattaatgttgtgtttactgttaaactctcgagtattagggactgaactaaaaaacgtgtgattagacgaattgtgaaagctaaaacacaaaatataataaagtttgatttttgaagttcacaaatcctagtgacaaaaaaatagacagtagataatatgtgggaggataaatgacacaatcactaacaagtcggataggagtgctatgactttagagaatatggagactagagtagggagcccctaaatttagggatcttagataggagtttcttgaaacagtgttttagtaactttacatagtgggatagcgagacaattcgtgtaaccattctatccactaaaccaaacatgttataatcgtaagcacatctgacactatgcagagagtatcatctattgtcaggttgagtttgcagaatgacttctgagataatatatttacacatcgttttaagaatcatctctatacatgtatcgtcctgatatttctgcacgtacgtagtgctactttgctagcctattccattaattgaccgggattgccaagtgtccccggtatccatatatgttcatctcgtttttgtgtcataaccgtcataacgtttccgctcctgatcgatcggcttacacacgcccagcactatataaccagctcccaagcgagccgggagtagtagccaacgagcttatagaacacaagtacaagaagctatcagaaatcagaaacgctagctagcagtaggaacaaacaatgaggtcgtccccgatcatcttcctgctcctggccgccgccgccgccatcgccgctccgtggcaggttgcgcacgccgcgggcaagtgcggcaagacgccggcggagaaggtggcgctgaagctggcgccgtgcgcgaaggcggcgcaggaccccggggcccggccgccggccgcgtgctgcgcggccgtgcgcgacatcggcacgcaccagagccacgcgtgcctgtgcgccgtgctgctgtccagcaccgtgaggcgctccggcgtcaagccggaggtggccatcaccatccccaagcgctgcaaactcgccaaccgccccgtcggctacaagtgcggcggtacgtacgtattgcgtgcgaagagctttggttagcttcatattataccgtttcatattacaagtcagactttttaaaagtttgattaaatttatagaaagattacaattatatcattaaattagttttattaaatctaatattgaatatgttttgataatttattcattttatattaaaaatattactatattttttataaactcgatcgaagctaaataaatttgatttttaaaaaaatcaaagtgataacagatgtagtatataatatctctgtcgtagaatataaacatttttgcgtatttttcgaaacatatttggacatctatatatccggatacagttcaagaaacacatagaaatgattatattttaaaaccaagtatatgacaagtgtgatggttctctgccttttgtagcttacacgctgcccagcctgcagggctgatgacgacgtacgacggccttgtttaggctctggcgccactaaaagctacctacagatcgcttacagcatactactcctataatactgttgcttaagtgtgctagctataccctgcactgctgatgaataagtatgatcgagctagcaaagcaactctacatggttgggacgtcaacactggttaatctcgtgcgctgcaaatggtctgctagtgtaatcctgtccgcatatgctgcttgaggttgtaatgagaatggacaaagtttactatccgcccgactgatacgtataccgaacatttacgtagcaatgagcgtatgcagatacgccacacaaaactatagactggcatggcatggcatgttgtctgtgttgttgtcacactgttgcgtgtgtcagatgcaggaaaatacatagtgaaaacctaaaaattactaattgaaaactaaaagtccaagatttattacgtcaccatagagtgaaattttctctcaataaaagttttactcatgagtaaatctacgagtgaaattcttactcgtgatgatgtgtacgaatctcaaacattcatttttcaattcaacggtagttctctagtttctgccgtatattttcccatcagacgccggtgctccctgctccgtggcgccgcaacgggctacttgtcacgtgctcccgcctcacgtttgccacctcatgggctgggcttcctcccgcaaccaagcccagaaactcaccaacgccgtggcaaacgctcaatctcagccgtccatcacgagcatatcgcccgtgaataccaccaccaccagcaaaccaggcggctcgatctccctatcccctgattcccctccagcctctgcgtccccattcacctctcctcctcctcttcttctacctcgcgctcgctcgcttccctcgtaaaccatccgcgcgcgtggtccttccatggcggccggggctctcctcctcgccaaccccgccgcgcccacggcgaggcaccagcaccggttgctgcagcagcggaggcagccgcggctcctcgcctcctctcggcctccccggtggcggctctccgccgtgcaggagaccaaggagggggaggcccagacggccgaggagatcaccgagaagtacggcctcgagttcggcctctggaaagtaagcacgcggcgcaggcagctatatttgtcgagttggagagcaaatcgatcgtgagcgcaatcgaatttgccgcaggtgttcagctccaaggaagggga

SEQ ID NO: 58137 - DNA, 1390 bp, Oryza sativa
ccccgggacgccctgtgatttatggccgagtttagtttctaacttttttaaaaaatttctaatttttttatcacatcaaaactttcctacacacataaacttctaacttttttttcaaactttaaattttaacgtgaaactaaacacaacctatgccaatatgccatgtagcggctactgtagcaatcgataccgtgcaatgctgtcgcattgattgctcggctagatcagatggctgtggccggcacatgcatggatggccggctaggggaggaatgcagattttctcgcacaaaggtccacacaactgtctcgtaaaaatggatcatgggcaaacagatggtagatttgtagtaccacttgtactaaatctaggcgtccagcgcgcaatgctgttcgattgggtaaatttaagcctttagaattgcaggttatatatgatcatagccagggttaggtggggaaaaaaaactgtcacaaccaacaagctgttaaaccgtgttaaactccccccggtttgaagaacttcaagaattccacccatcgaaaatgacctatacctaatccttctatgggtattaacgccaatgattgttgtacacttgcacgtaggatgtctgtactagagctatgacggtactttaataaataggagtattatggaaatatgggcagtccttccggctgcacgctgcgaactaaagtactaaacttcctgaatgctcgtcacacaaatgaggaaaaggacttgtggagttcagaaggtagcaagagtgtgacacagtaatactattatgttcagctggactgcctggacctggacacaataatactatgttcagctggctgatggaagggaattcttgaagattcaaccaagaggaagaaaaatgggtaaaaacagagcgggcttgtttggtttagtaccctaccaatatattgttagtgccaaactctaggcaagttaaatgagtgtctttggattgatgccaattgagagccaaattttaaattgtggtgaagaacattctagaattgtgctaaattgagtataggcattaccaaatatttggctttaaaccaaatcatcacatttactatttaaactaccaaaacattggtatggcaatattttgatatcaaaccaaaacggcgcagctttaccaacaagaacctcatcttggaacaaaaattaatatttcgttaattcggttcaaaggttcaaaactgagtgacaggtcctctcctttccctcaacaatttgatgggctaaccagcgtgggtttgaggacttactcattttatttatttgataggaaaaaatgatattaggtaattttttaatatttgcatttttaacctgctctatgttttaccattccaaggatta

SEQ ID NO: 58138 - DNA, 1144 bp, Oryza sativa
taatggtttgatcagtcaccagttcagtttctacctgaggagaatcaatcaccgatctgcagactgcagccatggccatgagggcaatcacgctgtcccactcgcagagcgcctcgtttgggcaccaccaccaccaaaccatgccgtcctccttcaggccaagcactgcctccaccagatcagtaaggtctacgcaaaggaagatgaggagaagggcagcaagcagtcattgttcgggagcatcaccgaggcgctggacttctcgcaggccggtcggagaaggacgcggagcttctgtatgaagccagagaggccacaaaggatggaggaaggatgacaaaggagcaggtatccattgaactactgatccgcacaaaaaattgtcgatcaatggtgttatttagtttagtagtaacttagtactgactatacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcaacagaaactcaagtcaaaag

SEQ ID NO: 58139 - DNA, 727 bp, Oryza sativa
aaaaagtactaacctgctctgaggaaaagctcttatacaaggacggactgttcatcacttaaagaggatgaggaccaggaactcgcaactgcatcggtactgaatactgatcgataccaggtctccaagaaacagaaaataaaggaagagagacaactgtgaacatttacttgatggtactaatatgttgacctgtactgtgcttgagaagcaaagcttgtccaacattagtacgcgagtcaaggttagtatcctgattcgtatattagtatattacgatactacgattttatcaaaccgaaacgataccgcgatatcctaattttgatagtatctcgatcctactattcattaccacacgatcctacgtaatcttatatagtatcctaattctacaatccaacaaaatattatttaaaatatgatagtttgaaaataatgaaatatgctcaagtttatatataaaaatcaattaaatatatcaaaactaatgtggtttttcttaataaatatctctatttgcatgacatatattattactatattttttatatagaatggctatatgtaattaatataaatattaattaaacttttaaaaaaagaaaatctcttagtatcccgatcctacgatacgatactactttgagcaaaactatattaactaagatcctaatactgacaaccttgtcgcgagtaactcaatttcttgtaaacacacacagag

SEQ ID NO: 58140 - DNA, 733 bp, Oryza sativa
ctgcaccccagttttggtggatgccacagaccggcacgctcgacgaacaacggcgacgaggtagtcgagcagggcagcagcagccacaccggcacgcgcagcccgctgaaccgctcctggcagagcagcaagcagaggacggcacagccggagcacagcgtccggtccgcgcccgcagccgccgcgcagttatgccgtggtgaactcgagcgccgccgtattccgctacgcgacccacgtctcgccgtcggagttgaagatgccgtcgccgagcaggtcacggaagacggtgtgccagaaggggggtggccgccgccgctcgccgtcaaccgaagcaacccagccgcgcccgccgtcaacctaagcaaccctggggaagtgaggaagaggggtggccgcagccgctcgcctgcgccgccctgccccgccgcttgcctccccgcgttccctgcctccgccgtcgcctcgccttgcctcgccgcctccgctctcctccccgcgctcgctgcctccgccgccgcactcgctacctccgccgttgccgggaggagagagtgtgtgtgagagatagaagagatagaagagagagagagtatgacatctggtcccacattttttaataaacagaacgctgactgactgccacgtgtatgccacgtaatttaaaaccaccgcggattggatcgaggggggtaattcgtccggtttgcatagttggggatgaagaatatcc

SEQ ID NO: 58141 - DNA, 1404 bp, Oryza sativa
aacgaaaaaaggaccagagcgctaatgttattgtccatcggcctcgtgttgcagacgggcttaagaagagtcaaagtaggtaggagtagagcttaatctccgttccaattttgtgcacgtacaaaaaaaagatctccggaagagaaacacaacatggaaacataaaattttgatgttaccctgtgcaaccctgcaacgcggcgctcgacccaggccccccggtcgcacgcatccgcgccccgtgcgcgcggctctcacgccatcgcgccgacgatttcgttccgcgaggcaacgacgtcggcgcggcacaccgggcacgtcgtccccctctgcagccacaggccgatgcactccgcgtggtagacgtgcccacacggccgcagccgccggcacggctgtcccccgccgtccgcgaccgcgaccgcgagcctccccttgcagatcgcgcagagcgccacgtcgtcgcccctcgcctccgtggcggcggcgacgtcgatgatgacgacctcctccttgttcagcaacccttggcgctccccgttgggatcgccggtggcgacctcgaaccgccggccgattaagcatcgcacggtccaggagatggcacagatcgcggcgatgagcgcgacgacggcgaggaatatctcgaggcctgacagatcaaccatcggcgagagttcgttttcgtagctaggtacgtgttgctggctcgatcgtcttggcgagtggtggaaccctgcacgcacgcgtacgtattaacgtataccagtacgtgctccggctccaggtacgtttgttactcctacttgtttcctatactgatttgtatttcgaaaaggtttgtttttttcccagatattactgcggagataattaaacagttcgtatcagaggagaaaatcgttgtggctgatctccacgtctttgttactcccacaaaaatatgaacaaattatggctcgcatggatgctagtagtatttctgcttgctttttgctcatggaaattattaaaggactaggcaactgggcatttaaggagtggcaactgacaagtatgggctaactcaaaggcgcagacataatcaattggaagagtgcttaaccacgagcatcagttagttttacactgaggcattggggacatggcattacttatctccaatcgtgtggtgttcatcagaaagaaactttggttaaagctttgctcatagggggttgtttattgtgcaaacacacaagtaggctatttgatggtgcaaaatattgtaagtgtatgtggatgggcagagctaattattccctccgagaaatctcagttatcattcaagattgaccctgaggaccactagatagcagtagaaacataaaatctgaacaacactgagcgccattcagcactgta

SEQ ID NO: 58142 - DNA, 713 bp, Oryza sativa
cgtcgccattgacagaaaaaaagtgacgtcgacagaaaaaaaaaaactgatttaattgggctattttgcaaaaggtcttgagctactaaaatgattattattagtttattactacagtattttattttatggcatcgaatatttcgggtaggcaatattgagaacaagtgatattgatggaaatatatttgcctaaataaaagcttcatgaagtttaggcaactgtgacaaatccgaacttcttctaatttctaaaacgaataaaaatcaccaattaccttagaatagtttccaattccaattaccaaccgcagatatatatatatatatatatatatatatatatatatatatatatatatatatatataaaatccctttcatgtgaaaaatccctcaacgtcaaccgcgtgggacccaccagtcactttatgggaccccacacctaattggcgggaacacataacaaaaaagaaaagggaagaagaacaaacttgctaataacattttcccgcgattccaaaagttaggtacgaaatccacccggggggaatcgatccgacggcccagacacactcgggcccacacccccctcccgcgtgtgggaacccattcctttcttgtcgtcgcggtggccgttaccgttacgtgctccgtcttccctctccgtctcgcggaaccactttttgcagtttcccccctccacaagccgg

SEQ ID NO: 58143 - DNA, 8011 bp, Oryza sativa
  unsure (1)..(8011): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattaaaaaaaagataaaaaaaattacctgaattggattctaggacctgttcagattgctaccgaaatgaaccttttcaaaatttgacaataccaaaatttggacaagttaacaatattaccagattttaatattaccaaattttgataggatagattaaatgttttgttaccaaaattctttaggcagtaccaatatttgataacaaactaaatttattaacatatttattaattttactaaaaataatatggttcaaaatgccatcaatctgaatagttgttcaaaatggcatcaattcctacacgcacgatatgcccaccatagagtacgcatttcatcaattcctacacgcacgatatgcccaccatagagtacgtatttcccgtagggaggtcgaatttcaactggcagaccggcaatagtagaggacgattttcggtggagtaaaaaaggactggatattttccgtggagcaaaatagggctggatcttcactgtttgtcctcgccgcgaatacatcgttcccatccagccgctgaaccgcacagctcaccccagccactcacccagtcaccactcaccactaggatgaaaacggatcggatacggtcgaaaactagctttattatattcgttttcatatttttttctcggaatcagaaacccggatatgaaaacggaatcgaatattatcgaatacagatacgaagcgaatacgaatcaaaacgaatacggtaacgaatattaatcggaacataaaagcccctcaaaccgaccttcacaaatcaacgaataaatataactcgttattttttctaatagaacatatcaacattttcaaattttagtgttaataattttgttgtattcgattttttggttgagggagacgattcaatcaagagtaagacattacgatgctattattgtgttctaaaattatgttctatcgagttattgtgttcttactgctattattttggccatattttcttgtgactttgttttatcaagtaaaaaatttgaatttcaaaaaatagcaacttcaaataatattttgaagcagtaaataatttcaactgaaaaagttatgaatataaaagttgtagaactcgtcaagagctacaacttttattttagtcatttcttcatccgaccaagtgatagtaatattgtttataaaatttgcatatctctcttatatcttatgaaaccatatacaagatatgtaaattttgtaaacaatgttactataactttgtcggatgaaaaaatgactaaaataaaagttgtagatcttgataagttatacaactttgttgttggtgactttttcagttgaaatcatttagtatttgaaaatgttgtttgaaggtgtcatattttgaaatccaaattcaaactatttaaacaaagtcatatagaaaaataacccaaacaaaagttgttgatctcgatgagttatacaactttgttgttgacaactttttccatttgaaatcatttactacccgaaaaattatttgaatttcttatattttaaaattcaaaatttatatagttcaatcaaactcggatgaagaaatgaccaaaataaaattggtagatctcaataaattctacaactttgtttttgataactttttcacatgaattcatttagtatcataaaatttaattcgaagttgagggaggacatatagacttaatagctaattcttaggcccgttggcccatttagatggagggatatataaacctaaccctagtttctcccacacctcccaatctcctcccagccgccaccctttcctcccggctcccgcgaccaccacgggggcggggcccgcgtgcggcggacggcgacggcgacgacgggggcggggccgcgtgcggcggacggcgacggcgacgtcgggggcagggcctcgtgcggcggacggcaggggctcggcggcgcgaggcgacgacgtgcagcgaacggcgacaagcggaaccagccgcgccggcctcggggcggccgggtcgtggcgacggcgggaactcgacagcacgaggcgacggcgtgtggcggacggcgacgccggactcggggcggccggatccggggtcgacagcccagcagttgcgggattcgacgtcgtgaggcgacggcgacggatggggctcggcggcgcgaggggacgacgtgcggcgaacggtgacgagcggatccggcgtgcgacgtgcgacggtgtgcggcggacggcgacgagcgtttttcgatgtttgttaatttggattttgttgtttattttgattcggatatctggcaaaaaaaggtcggatagtttccgaccgaatccaatttccgacggataccatcgctactgtattcgaatttgtatccgagaaaaactatccgaattcgtatccgaatccgagaatatccgaaaaaaattcgaccgcaacaatccgcatccgaaaaaccgggatcggaactcagaaattatccgtaccactttcatcctactcaccaccagcaagcaaggcatcctgttcccagctatacttgcctactattcccttccttcttttgcccgcctcgaccccaatacgccgcaaaaaaaactttccgagcagacacacaaggaaacccgaaacccaccccccccccccccccaagcgagtcatctgccgtccatcctcaccaacggacggcccacgacgcgtccaaaccacggaataattagggcaaacccaacaagagccctgtccgcccacgcgccgtcatactcgcccccccttccccttttctcatcctcctctccgcgtcaagtccaagcgaccaccagagatctctctcgcggggcggccaggtcctccccatcccgcggccaccacccacctccgaatctgccttccccagaaccaccgcgacccctctttctttccttcttcctcctcctcctcgtgccgtctccaagctccctccagcttgcgaggcgaactataaatagcggcttgggagcctcttcctctgccaagacgcagcaaacaaacagcacatcggaagccaagccccaggaaagaggaacgcacgagcagcatatgtcacagagggccagcgtcccacactcctcctccatagccttcgccctccattcccatctcctcgtctccagtgagatgtgccccagctcctattggcagcaataggaatagaaaagattgctcctttcttttgagctttcttgcaattttggtcttctttccttttgatttggtttctttccgtccgatttgtgaagaggaggagcaatggggttcaagggatttgtggagggtggcatcgcgtccatcgtcgctgggtgctcgacgcacccgctcgatttgattaaggtgaggatgcagctgcagggggaggcgtcggcggcggcggcggcggtcgcgccggcgcaggcggcgctgcggccggcgctggcgttccacgcggggcaggccgtggcgatcccgcatgacgtgattgcgccgccgaggaagcccgggccgatagccgtcggcgcgcagatcctgcgggcggagggcgcggcggggctcttctccggcgtgtcggccaccatgctgcgccagacgctctactccaccacccggatggggctctacgacatactgaagaagaagtggacccaggagaacggcggcgtgctgccgctccaccgcaagatcgccgctgggctcatcgccggcggggtcggcgccgccgtggggaacccggccgacgtcgccatggtgcggatgcaggccgacgggcggctcccgctcgccgagcgccggaactaccgcagcgtcggggacgccatcggccggatggcgcgcgacgagggcgtccgcagcctgtggcgcgggtcgtcgctgacggtgaaccgcgccatgatcgtcacggcgtcgcagctggccacctacgaccaggccaaggaggccatcctggcgcgccgcggccccggcgccgacgggctgggcacgcacgtcgtggccagcttcgccgcggggctcgtcgccgccgcggcgtccaaccccgtggacgtggtgaagacgagggtgatgaacatgaaggtggcgcccggcgcgccgccgccctactccggcgccatcgactgcgcgctcaagacggtgcggtcggagggcgtcatggcgctgtacaaggggttcatccccaccgtgtcgcgccagggccccttcaccgtcgtgctcttcgtcacgctcgagcaggtgcgcaaggtcttcaacggcgtcgagttctaaaggccaccgccacgatgatgacgacgaacaatccacctctagtattacttctgctagtactacctctgctgctgatgctgctgctatgaataattactactacagcctggttgagagattgtaccttagcctgcctccccatggcatatgttccttctgttcctgcattcgaacgaatttggatggatttgatcaaaaacttcaatggaatccgcatttttaaatttcttgtgtttaaaacgtttccagtgtctcatattatttcgtcagtaatacagtaacctccaagcatgttggatcttggaacgtggcaacctcaagccctcaaagcttaaactgaattgaatattccatctcggtatttttagatgcagtgcacacaaccaagaccaaggtgatctagtagtgtttgaaacagacaagaactattctcaaacgcaattgaataatcaatcaacaaccaccctcccccagttcgaccctactcaatgatgatggagtaaattgctaatctaaaaatcataggattccgcgtgtgcgagtgagttccgctaattcagcagcaaccagtaaccagaaacgtgtctctcgcgccgttaaacatttgggcaggacagtgacgtgcatgttcctggccataggaggcttggggattgggacctgggggtatggcagtgacatttcttcttttttcccctcttgtatgattgcatctttgtatctaaatcatgtgtccatgttcacgctgcaaaacaaaatgtcaccaccacgcttggtagtggataccgatgcaaatcacacaagcctataacaatggtggtaagtgcagccatgacataagcgctttgctgtcaattagtacaaggttagtaccaactaaacacgaacagcacaggagccgttcgccaatgctttgtctgcacaatggatgccaactttggccttgtcagcaacagaacaagtgcaggaactttaaaaggctagacaagatatccgctgtaacaaattggatccacctacggacctaccaaccagcaacaggcaaatttggccgatccggcgatgacctactttgaaacacgctagttttaggcagcgttcgttctgggagattggaggtagaatgcacatcgttttccgcgtgcacgcttcctaaactattaaacggtgtgttttttgtaaaaattttttataggaatgttgctttaaaaaattatattagttcattttttaaatttgaaataattaatactcaattaatcatacactaatagctcacctcgttttgtgtatctcccaaatcttctctatctcccctttctcaaacacagccttaaatgccaatgcttttttaagacatgctttttagatggactcgagacacgtctgaaacactatagtttctaattctgaaatttcacaggacatagggaagattcatgtgttacaaacaaggactttgcatcagagctttctagtcagtaataaaaaaaataaattgcatcaattgcagcagaggttaaaatctgtactagttttgcaaatataactggtagtcatatcacatcttagaagaaaatgtagacgaggttagctattcaccttttgtgcggagtttgagcagaaaccagttgtttctcttgagaaatcacatgattgtccttcaagcacagcatcctggttcaaatttagcctttaagctttggcttcccaaccttgcatgcaaacttgttctgaatcatgctgaacaggaaacacatagcgtcgatttagatgcaaaggactacttcttggacatgtaacaagcaacagaaaattgtctgtcaacttgcattagccaattgtgggaattaaaaaaaaaagcaaaagaaacaagcggcaactgatgacatcataccaaattgaccggtaccataagaatatgcacaacgaaagcagtttgagacatgatggactgattttccagatgcatttgcaggacattagcagcagtgttttgatcggccatacctttttggaactcttacagtaaatttagatcaacagcttttcggagtcatcaagaatatttaggatctcactgacatgccttattaacaacccattttcacgtcagtgtggttggaggccattaaactcagtagagacctgccgcaagtgcagttttgcaaccccacctgcaatacatcccggcacctgagccctgaaaattacattgtcttgcttacttaaagaacaagaaaatgatcgtcattctttgatgcatgtgaactgagaggcatattatcaaggaggttaactttaacctcttgccctaataggttcaagtcctaggatcaacttggatgaccatctcatttttaattgaatgacaatattcacattatccaagccagtttttcttttactctttatcgtttcaataaaagaagattctggaagcacaatattacctcccacagtcccactagagcaatcatgcccatcactcaacatcagaaaatatgtcaaactcaacatatataacagtgtcagcttgataaacagcttgcttcggtaagtggcatattatcctgcatatgacagtatttcatgacatattacgtcatataagttatggccaggctgtactacaaatatccatttatcaagctctaatcagttcaagctagaaggtggcactggccagtagcaatttcatacaaatggtaaatgtaagcttgttagcaaaagattatatatatatatattgtttaataggagcatgagattgatatttaggcatgaactctctctagtctcatttggacaagaatatgattgatgtagatcatgtaaaaccaataaaacagtgattcagaaatcaaatgatggtgaccacgaacctacaactggtcctgtatcaatttgatttatctgaaaattctacaactattctggtgttaagtggatgctgattgctcaagaaattaggtatacgcaaatatctgaaaaatggagggccacaagtctctagtctacagcataattggagtgggcttcacaaatatttaactgtgatatatttccactaaattgcctaaaaaggaaattgtttcattattgccaatttgatgctaataaattttggccaaattaaagtgtcatgtcacaacataactccaatatgcctcaataaatctttgcaactgttagaaaattggctacataatgtatttactcttatccacataagtaggcattctatgtgcgaaccagtaaaaacagagttcacaccacaggtccattgcctaccattttgatgaaggatagagatgtgtacctaaataattactgaatggtttccctgccaactccaactgaatttctttgtacttgagagccaatcatgatccttgactggttctatcattccactccacgatcatg

SEQ ID NO: 58144 - DNA, 13324 bp, Oryza sativa
aaataagaaggataaattacgcaatacaagtcaaatttaactttgaataaaagaagcgtcaagttttaccttcagcaggaacatatgtgagaaatctaccagattataggtgcaggttttgcaatcatgagaacataaagcttcctattagttggtacaactataacagaattctgaagtttgcatcttgcacttttgcagacacttgaaggatcacactatttgggctaaaattggcctccacaacttgttacccgattggacttggcccattaaaatgttttttcagttgccaggaacccagactggtaagaagatggaacatgcatgaagcattagtaaggttaaaaatctgtacatttgcggaaataccagaaagggaatgatactctaggattctagtttctacaatacaactttgaaacaggtgcttctcatctcaacacaggaaggggctccaaagaagcatactgaaatgagaaggataaattacacaatacaagtcaaatttaactttgcataaaagaggcgtcaagttttaccttcagcaggaacatgtgtgagaaatttaccagattataggtgcaggttctgcaatcatgagaacataaagcttcctattagttggtacaactataccagaattctgaagtttgcatcttgcacttctgcagacacttgaaggatcacactatttgggctaaaaattggcctccacaacttgttaccctattggacttggcccattaaaatgttttttcagttgccaggaacccagacatccagacaaaagatcgtaatcttttcctgtcttacaccaacctgttacttaacaactattcaacatttctaagacatgttgcaatatttttttatcagctacaactttcctaggtaggcaagctgacacttattcgaagagttctcacatgttaataccataaagtcaaacaaaccccttaaataggtcagaagtagagagaaaaaggttaatcttatttcaacttttcacctaaaagccagagcacacgtggtaatttgtgtgcaactgtgctatgggtatgcaaacaaacaaaagccatgcacatcaaatagcaaattactcagtgatacaaattttattcgtaatgccatctgttactttcaataattcaaggcactctacttaaccttagaagactcccttatgctaattctgcaatttcagaatggttacagcaatgtgggcaccatggtttgattatgccaaagacatactggtgactggtgagttctgtactggccataagcatagcttctcaacattactacctagaaggccattatggtacataagttgaatagtactgtaccagtttatggtagtattaaactggtcaagaatatttcaaacttctattctattggcattcatattcgcatgtactagagattaaaaaattagccatattgaaggtggctgcaaagtttcaaacaaaaaaaaaggtggctgcaacctgcaattatagcagattaatattggaggatgatattcaagagcaaattcaaaataggtacgtcagcataagaaaagaagtgcattattgtgcaacaaccttatgttggtagcacctgacaagaaagcagctggtgtatttggtacttgtaaagaataatggaagcttcaatcttggcgcaaaccaagtttcaaacctggcgcaaacagtgtgtgttttcagaaaaaaaaaacgttttatataattagcaaaaacataaacgtttcacatcctccaggctacaagaaatgcttgcagcggtattcaaaggggtaccatcaagtgtatccatgtgcacacgctgaagtgcacaataacataatgaagaaaacaatcaaattgacaaccatgtggaaaagctatttcctaaatcaaaaggccggggtactgccaaaaggatctgtgggtttttctgctcaagtgcaaactgattatagttaacctatcaacttctctgtcaaagctctacctttttgataaataataaagaagctctggtgacttccaaaaagagtcctagactactagttatctagtaggattctaggtcaaagctgaattcacaatgtaatgtgactttagaatggcatgtcttcattgaacagactaggaccactaagaaagaacaaccgtccttcacattgctcagaataactaaaccaggaatgaggttttaatagccgacgttctttttctatcaatgccagtctggattgaggtaacttttaatcaaaagaagaactctaacatgcctagaatccatcccaaagaaaggaatgacgacctcatgcctcaaactgatacaccacccaccatcaatattcaattcttcccatcaggcgtcggagctgtgagaggcatatcccacctaaacaacaccttacacctacagcacgatgacccaattcataaaccccccaaggccccaactccccccatctccaggacgcgaacgcgcttgaccctactgccgcattacatcgaacacctagcgtgcgccccgcccgccacaactccacccacctatccgcacatgcggcgcgcgggcagccgagtaaatcgccccgcccccgcatccccgaacaaccgccatcgctgctggtttaagcacatttgatgcatcggtggtcctcgcgcctggcccgcgtgcgcgcgaaaagggaccgcgaccgaatctctctggcttctctagtaaagttggtggatgatccggagattaataaacatttaaacaattgggatcgaggtcggtggtaggatgggttgggtagccctggtaggagttgaccgatcgatcgatcgatccaataaacaactgtttgacttggggaaattaaaggagaggagaggaagagatcgtgcgtgcaaaatgtgatgcggcggagtccaaaactagtcgcctgggttggttagggcgactagtcccgataggaacagcaagcggtggagagaatggcgggtagggggtgaaacgatcaccttgtttgtggccgccgacgctgccggcggcgatgtcggcggccggatcggagaatcagccgtggtggcgtggtgttggtggacgactggtagacggtagtggcgggaaggcggagcagataatgaattgtgtttagggcaaatttgaattaagacaattgaatattattatccaattgtagtgtaaattaaggcaaattgaataatattattatcctacagtctgcaaattaaggcaaatttgaattcacctatccggttatcaaattgtactataaaagaatattgttaagacgaaatcggataggtgacactggtacttttataaatttgaattgatctattatcgttaaggtttctgtcaatatcttgctcccgattatttcttctctatctccggcgcgcatagtacaaaatgattgtcatagcggctgatggcatggatggccgtggagaagcagagtggcgcaagcgcatcgcagcgatgtgggggctcgagctcacctggcgaggcaacgatgtacggacttaagctcccaagggcgacatcgatgcggctttgagaggcagacaaagctcggtcacactgaaggacaatagtgatagtggttgctggagcgagctcctaatagcgatggcaatacaacttggagaggttaaggggagctcgatgacagtgagtagaggcgattgtggttgctaggacgtcagtgcatcccgttctgcctcgtcgtcctcttgccattgtcggatcccttgcctcctccaacaactcctggatctcctcctgtcacacctcttccacctgtcgctgtcaaatctcgtctttatcatgtctactctggtcgccattgttggatcccttcccgtccatctgtcgctggccacctcaagaggaagaagttacatgctttgacagctattgcacgtttcttattttagaatagtgaagtgacacaaatatactttcaattttgttagtgacatttttctaatacaatgtttcagtggcatgatcaaatttaccctcttgtttacgatgaagtctactaatcggacaaaaaaataatgaatgaacattcaattaaaggatatatgatagattatcttattctacattaatatttagagggtaacggagttaaaagttattttaaatactatcccaagaatgtatgtatttttttatggaaatgctaaataccgggataccgtttgctagcgttcaggacgggatcttctcccagcctcacacagctacagataagaatggtgtggagacaaccaggttccacggcagccattgcagtagagacagtctatttcacgcgaggttgcggcatggcgtctgtcgccgtaggttgtgggcgtcgccgtcgtgctgctcagctactcacgccaactgaggacggcgatggcgcgtggggcttggccgccgttgctgaatcgaagagaggtgccgtgttgaggagcagcgcgagctcgacatcggagctgatggatgtgggttgtcacgacgatcggggatagagctatcgtcgaagtggatagacgcggagcaaggaggacacagccgctggcgatgagctccgacatggcatggacggtggaggatgcggccatcagtgacgagcttcggcgtggggcctggatgacggagaggacacgaccgccgccactgagctccgacgtggcgtggacggtggaggatgcagccgccggcgacgagctccggcgtgagacgtggacgatgggaccaccggcgacaatgccttggtgcccggctcctgatacctcgcaagtatcacctaatacgtggtaagaatcgcttgatacttgacaggtataacctgatactttgcaagtatcacctgatacgtggtaggaatcgcctgataccttctaggtatcacatgatatctcgcaaatatcgcctgatactggttaggtatcaggacatgatacctcagaggtatcaggacctgataactaattggtatcattctgtcctaacgggattccgttgaatagcagccccgtttttaagaaatcatgaatcctacaaacttagcgaatataaacatgatataatctatgatatgtaagtggaaaagaacgaagaaatttgaataattttttttctcataaaagaatgaatttgaatagggttgacatcatgtcatcactcttaatgtctttttcccctatgatgcaagtttcacctattcgtgaattatcaagacataacaatgcgatatactaatcttcaggtcatgataatatattatttgactcacgaatggtgccaactccatggacggcataatgtatgaactagccagctaggtatatttagtttggcacacagtttcaaacccagccgcaacaaattctttcgttatcttctccatgcaacaaagaacaaaacagaaggaatcagctaacttaaaatacaatcaagcatggaggagaaaacgtgtgtcgccatcatctgacggtcgcaggttagcgatggaaatatggaattatctgaaaccttttcttcctgagccagaattctgtacgcaagtaataaaaaacttcaggcgattagcccccaaccaatgctctctcgcacttagctgatggaccacataagcattagcatatcaaagaaaagtgtttatctgtcccagaatggcaagagaacaaaaaaactgaaggaacttggcaacaaaaaggggcaaaatgcatccggtgagctttacagaactttatgcactgtaggttatagtctgatagagactttggtttaatctgtagagataacgtgctgcaaatacaagttaaaatactcttatacgaaaaatacaagctaaaatacagtctttctaaaagttctagcagaaattggtaagaaatagtcatgacttgttaagacaataataataaaatagttgaagaaattagataagagatagttgtaattagctgagatgaataaaataagtagaggaatggttatactgcggtacaaattttcaatctaaaaacagtttggagaaatgcttatattgcaaaggctgcaattatcgaaacgaggaggttgcttctgcaaacgtaacctgaaaaaaaaaatctcatattctcatttgttacgcacctaatcccgccaaataagtttgatgagaagattcagctcggtgaaatttcgctaattgcggaaacaaatcgccctgctggtcgttgcatctaatcgactgaccacaaccgtggaaagcaaccggattagttgcgaaatcaatgaatggtttgattcgtcaggcttttggactcccactgaggaaaaaaaaaggtcagtgcatgtactagaaaacaacgcatgcttttgctgcagtattcttcagcacatgtacatgttgaattcgttggaagctaaaccaccccacaagctattggttttcgggaggaaatttcttcagggtacgagcttgattagcagagctgaatcgtatacaccacgtcttggcatgctcttggacttccatgttaacataattcaatgttgccatgttggcataatttcaattaccacttttacctgaataatctcgtctgttactaggctagcagattcctgagcagagtattagctggtgtgttgttcgttaattgggtggtatgaaaatttttagttgtttcgacgtcgcatcatgctgatagacagttgttatacaaacagcgatactacggcttggttcagttcccaacttttttttcaaacttttaattttttcatcacataaaaacttttctacacacaaacttccaacttttttgttacattattttaattttagcgaacgaaacacaccctacagctcgtggaacagatcgtgtgatcgtgtcgcaaactaaactactggttagaagaagaaggccggtgtaagttgaaacttcagaccaatagcaatcagttgactgtaacaacacactgatatttcgagcgagcgagcgtgaggagaagtggtgaaattcgcctcttgttcccgtcgtccactcatctcgcgacgacatgctcgagtgcttctgttgatggaaatcgatggattcttcccagaactcacccgctgcctaattaattaaaaatctagctctgatgcttgatgattaccaccaattggtctctttgatctgatgctatttagagtccagatcacaccatgtcaccatgcagcatgattaatttgtttttgtgatcgagatgcagtcggcgagtcggttgtctggaatttggtggccgcgctttccttcagggatactccggcgccgacgtggcgtcgcctcggcgaaccaaaccccccgccgtccgccgaccagccgcatatcacatcggcgcgtcgccatcgcccgcgccgccgcgtccgcccgcggcgccgcgaagcgtcggcgccggcgcgcgaggatggcggtggcgcgacaagcgtgtgtgtacgtgggcgacgcgccgacgccgccgcccgcgcgcgcgccgtggcgtggcgtgacgtgtcgcgtgcgcaggggaaaggtacgtgggggaaagccaggtgaggcaaaccatgcctacttcggacgctgcgaatcaggaggaggaaaaagggagaaaagcgtcgcttgtttggcacgtatttgccggttcgtctcagctgctgcatttgtttgatttctctgtttttttcttccctcgtcgccattgacagaaaaaaagtgacgtcgacagaaaaaaaaaaactgatttaattgggctattttgcaaaaggtcttgagctactaaaatgattattattagtttattactacagtattttattttatggcatcgaatatttcgggtaggcaatattgagaacaagtgatattgatggaaatatatttgcctaaataaaagcttcatgaagtttaggcaactgtgacaaatccgaacttcttctaatttctaaaacgaataaaaatcaccaattaccttagaatagtttccaattccaattaccaaccgcagatatatatatatatatatatatatatatatatatattaaaaaatccctttcatgtgaaaaatccctcaacgtcaaccgcgtgggacccaccagtcactttatgggaccccacacctaattggcgggaacacataacaaaaaagaaaagggaagaagaacaaacttgctaataacattttcccgcgattccaaaagttaggtacgaaatccacccggggggaatcgatccgacggcccagacacactcgggcccacacccccctcccgcgtgtgggaacccattcctttcttgtcgtcgcggtggccgttaccgttacgtgctccgtcttccctctccgtctcgcggaaccactttttgcagtttcccccctccacaagccggattattattcttttattattcctttccctcctctcgagtccgccggcttctctctctccgtcgcctgcctctccgtcacttccaaagaccaaacaaaactcgagtagaggagagagatagagagagaaggggaggggaaaaaattggaagccctagattttggcgggttggctacggcgaggtgcgggggaggggtcggggtcgggatcggcgggcggatccggtgggtggaggaggttgggcggcgagatctatgcggtggggaggggaggggaggaggaggaggaggggagcggggtgagaggggaggaggaggtggtggatggcggaggcggcgggttcgtcgtcgtcgtcgtcggcgtcggcggtggtggtggctgtggtgattgcggtggtggtggtggtgtgggttgtggtgcggcggaaggtgaggcgcgccgcggcgcggagggaggaggtgctgcggctcacgcggctggcgcaggaggagtcggagatggcggaggtggagtgcgcgcgcgcctactactcggagctgttcccgagcgtcgtgcacgcgacggagatggtggatgaggcggcgtggggggcgccgccggccgtggttccggctcaggcggaggcagaggcggagatggaggcccgggcccagccgcagccgcagccgccggtgggtgccaagggggtctgcgcggtgtgcttccggccgacgacgttcaggtgcaagcagtgcaaggctgtcaagtactggtgagttgtctgaattctgaaaccctcttctgagtccccctttgcatttcgtgaaatttcaccgggtgaaaggggaatcggaaagagagttctgcgattggtagtgcggatttctgtatttcgtagtaatttcggtgttcaaccttgaggagggctagtggttccagaaagcctggaatttgcgtctagttttggtttgcgcataacatgaccatcttgaataactgattggcaagtgagtttggtatggataaccctctatttagtcttttctttgtgcccatttgttgcatttgaagaatctaatgtggacatatggcattgctaacagaaacacagttttgaaagacattagcctgtgaatcgctcatctgtcatattcccaactaggatcctaatggctcaattctttctattacttttgttgatgatgatcttcttggaaactttactttttttagcctgacttaaagttgtccgtccattggctcggggcacatatattattgtcttttatttatgaatgaacttaggcacatgaccgggtttaagatgttaggatctcaatgtctaaaatgttctctagatgagaaaagtatcattttcacaaagcaatattatttgttgtgatggaatttactggtatcgttttcatacatgatgcttcctatgctcagatgctctacatcgaggcaacaaacatagatgatttatcaaaccatgttcaataaatagttgagactctgaaattcatagttattttttgcgggaaaagattcataccttttttttttgcggggagggaaaagattcatactgcttaacagtggtgattcttcacaatatttgtttcatgcgcataagcttatctctaatcatatcctttaaatttcactaaattgcaaatgtttggacaaaattatcacaaaacaacatatttacgccataataaactgtagatttagcatagaatatatcccgatactacagattgaagccattttgttgcaaaaatataagatttaaccccaattttatcacaaaactatatatttttaagatgtacacacatcaatcatgctaatctgaagggtattcagaaaattaaattccataatttcagaaaattaaattccataattttcattgacaaatttcatcacctgctacacattcatgagtatatttatgtgttaacccatgattatggattaaacgaatctgaagttttcgaggttgatagtcgtaataagaatttagcaaactacttatggaaccgttgattacttgagtttatcagtagattttttatggattagtttagttaatcatcctaacaaagatcattattggattacaacaactatttttattctgagttttatcctttgattctaaactcataatacttaacattgaggcttaatttactggatatgatatcaacattgataccttttcaaactcttaagttattatctttgttacattgtatacattgaaaattctgagctatagtgtaatgttgtgcatggcattagaatgtgctacttgttcaacttcaatgataccttcattttttttgcagttccttcaaatgccagatagcccactggagacagggtcataaaaatgaatgccgcccaccaagcactgatgctaatcatgatgatgtggctgaactttctgttgcaaaggaaaggaaaattgagcagacaagtgcttctgaagaaaacatagctgaaaccaacacggcagccaccgtgaagaatttaaatgataaaacaaaagatatgccctcagaagtacttgcttcggtggaggttcctgatgatgaccattctgtcagtgcggtcaaactccctcaaagttcttcacaagtagcttctcttggcagtagaaagacagaatcaaatatgaaacctacaactcctgttgaaaatggttcttacacaaaggacttagatgaggcgttggtgtgtagatttcaaccttctccaccaaagattagtggctctggaagtcttatcaacaaagagtccttaattgattccaagaagcaccaggattgctctcaaactagtaacagcaaaaaatatgcagataacaacaatgctcaagctgctctacctgttgcagtagaacctaaaacttccaggactgctcttcatgtggaagttggacactccaagacaaaagctgctggctcagacaacattggtgtgtcaaaaatggtgccatctgttttgactgttgataaagtttctcctgttcccggtggacgttctgttacacctaattcatcaaaaagggctgataatattgctgaaaggaattctaaaccatcagagaaatcaatttcaacagcaaatagcctggcaacatctctgaaaaaaattgtcaggcagcaaacagcaccaaaagttgtgaggcattatccatcagagccagtaagcaaaactgaactgctgtgtttatagttagtaggagttttctatctgctaatagttttatttttttcagacacattttccatatgagcttttcattaagctctatgaaaaggttgaattgcaaccgtttggtcttcataaccttggcaataggtaagttttggattatttctggatagttggaacacatatatgtgtttcttttttgcttatctcattattttagcatttctctaagatttataacttagctctccccatccttttgtggctatcaggctacatatcacagcttgcatcgaattttatgataatttgtggtgtttatgcaggaattagcttagtacagtgttctgtgttcaccctgtttcaccttgttttttcctctctcttgcagttgctatgcaaatgctgttcttcagtgcttaatgtttacccgaccacttacatcatatcttttgggagggcttcattcaaaaaattgtaatgttctattactgtgtttattacatcattgtttcccataaagcatttctttgagtaattatttaatatatcatactctctaggttccaaaaaggaatggtgcttcatgtgtgaatttgaaaaactcgttggggagggcagacaaggcaagattgctttgtcaccaactgggatactctctcatttgcctgacattggaagtagctttggtcctggtaaacaagaagatgctcatgaattccttaggtaagttattttttttaattgacagtttccagtttaagaagttaagaattagtttagcagaagttaggaacatttatgtgcctcaacgaggaatgcactgggggataagagcgggggtatcatatcacatattcatgcagaaaattaaagttaataggcctacttgaatatttgagtggtagccggagtgcttattaggttctgtggtctgtggtctgcatgaagaatctaatgagcaatgacaacctttttccctatcatctggattcggagttttggtggtggtttgcatcagtataatgttgtaatcctggtagaaacaacctaaacatattattttgggtatgaattggcattgccaatgtccttgttttgaattagcttagttaattgtgctcaaccagttcttttcaacaatagtgtctgatggaaccgcactacctgatctgttgtaggtacgccattgatgctatgcaatctgtatgcatgaaggaagccaggaaaagcggcactcatcggttacacgaagaaacaacacttatgcaattaatatttgggggctatctgcgatctaaggttttcttcacagttcacagaacaagtttaaatttctgttgtttgtactcaattacctgagatcagctgtgtaatgaagccccactcctattgactgcttttttccttcttctagataagatgcacaagatgtgatgctacttccgagcaacatgagcgtattttggatcttactgttgaaatagatggcgacatcagttcactggaaggagcacttgagcgatttacatctacagaagtcttggatggagataataaatataaatgcagcaggtttattacttagttgacctctatctttctctgccagctcttgctgttccttttgtgctcatatgcgttcatacagtgcacatcttttttgccactttccaaaatcctcaaaatgcttgtcact

SEQ ID NO: 58145 - DNA, 4262 bp, Oryza sativa
tgatggctcaagatccagcacgtgtaaagaaggacaaggcaagggtaaattcaggacggtggcatggaggaggtcccatacaccaaggtggtcagatgtacgcagatcacatgacagatgatttgccccatacatatgacgagtttggacatggaccatattcgccagcagaatctcctagtccaagtgagagttcatcaattttcaccagttccgacacagggtcacatagcaccgacagcagtgaaagcactagaaactctaccagtgaggatatggaacgcctcatatttggtgatcaagtttcatactttgatggctctatgttcggacatggggaaaacggccgtatgacttattcccgatcaaagtctagcttgggtaccagttcatcgggtcaagaggtggatcagtataggcctgacgagcacaggcttcagggtgccagggagggttggaatcagggcgatgaaagttcttccttgtatactaaccaaagtaaacatcaatttagtagtaagttaacagaacaatataggaggaggttagatgggactgagcatgatcctggagaagccaatagtgttttattgaggagatcggctagggaaaggacggcccaaacattttattgacatgtggagggtttgggttgtagaggtataataatgtaggatgtattattaccccactgcaatgaaaaaggaaaaaatggctcagtttgtagataatggctgaaaatttcagtcagtgcacgcatcttgtttattcatcttggatctgcatcccaagaggtttgatctgctgccttcaattcgatcagcggatgggcaaacctggtttcatctgctctgctagctagcaagcctggtggggtgattgacaagtgcagcaattaacgagcgtatcatggtctcacggatgctgtgtatgctatattgctatgacatggaaatacagattcttgtgtaaagtttagggtgtttggctaggtagctaaatagctgagcgacttacgataattatttaagggtacaaccgaataaattaaatattatagttaaaaaataaaattaaaatagtttttttaaaagtgttatatataagaatgttttttttaaaaaaaagaaacacgaagtattcagctatcattccgtttgttggaaaagaaatagggctcagcaaccaatttcttctccgaaggggatgcgcatggatgataccataccatattccgtctccgtccatacgtgctgtgcctgtgcctgccaggtcaaaaccagagctgtcgatgtagattgtagcgtctctatctgatccaccaaagccaccacgaattctaaccaagacaacaggaggacgtactggaggagcaaccactttgcagctaattccaccctacttaatttcaaagccacgcacatataattgcatgtggtctgactactaagctgaagcattatattgagagcatacatgcacacatatcagttcatccataagttgattactccctccggttctatagtttatatcattctaaacaatgacacgtacattatgcaaaacatatcttttgggtgcgttctaaactccatttgggcaccctaaacttagtttctcgatcttcattagcatgtttttcaatctattaaatggcatgttacgtgtgaaaactttttatctagaaattgctttcagaaaacaaataaatctattttttaagtttttactcaattaatcatatactaatcatgtttcttgtttacgtgcgactaatcatccgtctgaaaactcactttagaacacaccctttgaatataattttataatataaatataataaataaataaataatcaattttattaaagtgctttcgaagactaatatgtatacgttgttctagtgcctttaaactatatttttggacattactgatagtcaaccttaatgttcaaaatgataagaattatataactagagggaatttattttaacgcttctattcacatattgattttgttttgcctatagaagtactctcttcgttcataaataagttcatttttagattatactgtttgttccaaaataaggttatccacaaataaaaaaaatattacttcaatacccttacatactcaatcatcaatactattttctccatcaatgaagagtattttggtcgtttttgctctatcttaatttgtacttcaaggattaaatatgaactttacaacggaggaagtaggcatcaggaaccagcacttcctcaaattctgtttttacttgatgtgtcggcgtgctaggtacgaacatgtgaatgaattattcaagactgcaagtactactacacccttgacatgttgtacgtcgcgttccagagatacgtacgggtcgataacggatagagaccgattgatagcagagtgcggctagctttggattctttcccttaaaaagcgaacaacattaactccatcctattccacgggccaagtacaccgtctgtctcaagataaatttatttgtcggtttctatgtttaatatttagtcgcccattttatttaaatttttttatgatcaatatttttttatcattagatgataaatatgaataatattttatgtgtgattttgtttataattttttaaataagatgaacagtcaaatgttgaacgcataaacccacaaataagagatggagtaggaccaagattggataagccagctacaggtggatggatcatatcaggtccatcgcttgggcctatcacgttagccagccaaagtgtttatatcacgtgcttgattatatattggtcgtccaaattgcaaacgtccctgtcaatcttatcaaccaatatagctcgatcggttttagagtgccctccaaaatatcctccacataattgacagttctagctactacaacattcaaaacgcgcagttgtactagcatgcatatgttcagatctctcgctcgcgtcgcggcgtcggcacatgaaaaagctagcgtgagaggtggcggcggattcgcggctgtgcgtgtgtgtcgctgccgtgccgtcaaagggtgcggcggccggccggtgggtggatgctggatagcgtacacacaccggccatgcatcatgtcagttggaggaggaggaggagacggtgaaaggggtaaagatgaaaggagatcaaaggaaaatggaagggccctacttatggcatcacaggtaagatgtgattctattaacatgcttttaaaaatgctaaacggtatattttgtataaaagttttctatatagaagttactctaaaatatcaaataaatccagttttcaagtttataataataaaaatttaattgattatatgctaataactttcttgttttgcgtacccacttaatcttattatccatctttgttggaggagctctagaattctagtaagaatatgaaaaaactaggttatcaactttgggtttctagtcaatttattttctaaattttacagctacagatttttaaaatgtcaatgaaaatctatactatttcagcagcaggagagattggaaataaactgcagctacctgaggctccggagtatggcattattagctaggtaatgagctccatgtccttttctctccggatccagtggctaatcctgtcctcctgtctctcctctctccagctttgcttcacttacacttacacctcaccgtgctccctctcccggcaagaaatctctcccggtagggtaaagcagccagggaccctcctcctagcttagctattgttgcactcacactccaagctggagtagctagctgctgcttgtgagggaggtatggagaggaggagtcagctgggaggaggagaaggcgatggcaagctcgtcgtcggcggcggcgccatgggcgagaagaagcagcagctggagtgcttctctgacgaggtggacagccgtgatggtggtggtggcgcggcggaggagacgacggcgggcggcggcggcgagggtgttgctgcggtggtggtggtgggtaagaggaggagggggcggccgccggggtccaagaacaagccgaagccgccggtggtcgtcacgcgtgaggcggcggcggccgagccggcggcggcggcggcgatgcggtcgcacgtgctggagatcccgggcggcggggacgtcgccggcgcgctcgcggggtacgcgcgccgccgtggcctcgggatctgcgtgctcgccgggacgggcgcc

SEQ ID NO: 58146 - DNA, 13456 bp, Oryza sativa
tcggaggcgccgtggcgggcccgctcgtcgccgccaccaccgtcgtcgtcgtcgccgccgcgttcgccagccccacgttccaccgcctccccgcggaatacgacgacgcgccggcgcccgtctccggcagcggcgccgacgctgacgaacaccgcgggcggcgccgaacggagccaccggagcaccatcacttgacaccgctgcatccgcgcggcatagctctggcgacggcgacgacgacgacgacgactcaacctgtgtacgcgtcagcgtgccagcatgaagaggtatggccgccggcggcggcggcggcggcggcgagcgcaccacggccacggccgccgtaccaatagctaaatcgaagctagtgatgcagtgcttgcgtgatgacatgcaaggccaaggcaatccctttgatcttcttgcaaagttgcatagagtatcaaaatatatctagttaattgatgttggctcactagtaaaagtcattagggtttttaactttgctgtttacctcacgaagggttgacgactcaatgtctggtgagatcgaaaatttggaatgtgtttatattttctactatttgttgcttggacagctgaaaactaatttggaactgattttgaattttagactaaaaaaattgctcgtgcgttgcaaagggtgaagactattttaatcgtattattgttagattttttttttgaaaagtatatatgagaattttattttgatagtattgttatctaattcggaactcttattcggatgatggtcatattctatatgttgctttcttatggcttgaaaaaaattctgaagcaattaggagtccgactctcgtcccaatttagtatgtgatttttttaaaaggatattttatacgactccttatatattttcaaatgcgaacgaatttaaaaatcgactcaaatacatacgacgtaacaaagtatcggcaaaagtattttcaatttttatattttaattagattaatttcggggtattatggtcacttcatttcccaactcatttttatgatggttatgaggacatataaaattcatccaaagttattgttgaacaccaaacttttaattttaaaatcgttttgaattataatccacagaaaaaacaagcttgttctgaccatgattctgattgacaaaagggccaaaattacatggatataaatttagaattattatcctattctggttctagtagtactccctccattccataatataaggcacaaccacttttttaagatgttccataatataaggcatgcatgcatataggccattaactaaggaaaaaaatttggaggaggggtgcagcgggcctgctgtgcaaccccaatctggatgagcgacacgtggcccagctaccgatccaacgagagcgcgcgtagggcctctagcacaagtctcggctggctcccttcggctgagaatcaatcggctcctgtcccggctccctccgttctcggaacaggatcctctgacgtagagcaatctacgtcagagggacgtccgatgccgctacgccgctggatcggtatcgaacggaggtaaacaagcacagcacaccaactagcttcttttcggcccacgctgacaaatcaacccacgaaaacggaaaggctcgctcctggccggcggccgcttctctcgtcatatgccgccgagttcttcgtcgacggtgccgcaggcccgcagcacgcagcatcctgcggcggagccgtccgtgttgagtgtgtggttcgcctgcgccgacctcctgtcgctggggtcagcgcttctggccgaaccttgcatgggccatggctagctgcctcctcgagctcacgctcagacggagcactgctgaatcttactcttcttgccagaatcgacatcatggttgtgctttgagcttggatacatgccagcgtgctagtgaatggcatttgcgatgagcccctgcaagttgaacgacatggtgatcgtacggagggccttgctgccgggatgggtgctgcatggccacgttgactacgtctccggcgggccacaaccggccgggatttatttcgccatcccccgaggcacgcactccggctggcgcaggcggtggcgatgcgctccagggcggcgtacgcactgatgttcctggccacacgcacctgcacgcgcgacgacgaggcgctgaacgtcgccatgacgccgtcgttctccgcgccggccgacgtccctgcgagcgagtaaactgttcgattttgtcagcgtgagcagaaaagaagccagttaatctaccgtgcttattcacctccatccgatgccgatcaaggggtgtagcggcgtcggacgtccctctgacgtagatctacgtcagaggatcctgttccccgcggtcacgcttctctcgatgcgcctgttcgtctgccatcaccgcacgcgctcgatcggctcgtgggtgtggaaattggaaagctcctatcgcgtgcccctggatcacgcggacgtggagtgagacgtctcatcctgcgcctcaagatcacggcaaaaatcgccggcaaccgcagcactgcagcagccatggcaggacaagtctccacgggcaacgcagctgcatcagcttccatggcaggagaagggcaggaggaggaccctgcagctgccgggacatctcatctcgtgttgttttcacctgccctagcacatggcatggaaggacatggatttcaatcacctgcgcccatggacgtcgaaatcaccggggatgttggagccggcggcgagcggataatgcaggtaatatcgtctagttctttaattatcatgtttttcaatcagcattgtttgatgatggatgatgttcacctatatgtagaggatgaccatgatcatgacaatcataatatttcttatattgtgctaatataattatataactttagttatcaactgccatgtgtatttcagatttacaaaaattgtacagattacaaacggatgaatttccttgcaattacattgcagcttgtatgatttcaactacaatccttacaaactgttaacatttcgcagattacatagtacatattacaaagcctgcatattaaactacagtcctttgaaaaccatcctcttgtggcaattaaagtcctttcaggctgagcattttcctcctttatattttgcacagaaaatacagaaccaccatgataaaaaaatgaggtttgagctcaatccacaatatgcatcttactgattctaatccatcagtccaatccaggagaagaacctgcaagaaaatgagcaatttaatccgctagtccaaggtttaggaaacaatttcaaaactatgttcttccatttttagggaagtgatttcgaaatgtatgcgtacattagtttacagcaagagttatatatatgttcagttgtttgctgtcttgtgcttcttcagcgggaggaaagcacccgggagataccattggaaaataaatatacataagtattgaacattgctctgctgctgaattattgtcagaaacgaaacagagattgcagctgtagtttcaggtgagagcaaataatctggatctgcagacgctggtggtggttctgatttctagagagatgacgtacctatcagaatcagacttgttgtccagacgacacatacgcggcacggcacggccgctcgccgccgccgccggcgctcgctgctatgagagaagcagaggggaacacgcgggcagcggcggtagatgagcaggcgcatcgagacttcgagaaataagggagggatatactttagccgagctggcgcatcgagggaagcatgagcgcggagggagccgggacgggagccgatcgattctcagccgaagggagccagccgagacttgtgctggaggccctacgcgcgctctcgttggatcggtagctgggccacgtgtcgttcatccagatcagggctgcacagcaggcccgctgcacccctcctccaccaaatttttttccactaactaaattattacttttttaaatcctccactctcatgttctctaatattctattggatgcatgtattgtatttattaggatgatctaatctataagatgataataattattctcttggtatttgggttagggctggttatgtcttatattttgaaatggagggagtagtatatagtactccctccatctacttttgatagtcatatttcatcttgacacatagaccaaggataagtaattctacttatcatccatttaaatatgctactagttattcctcataaacaagcgattcattaatatttatatttctcaaagcccatgtagccaatcatgtgtggaagaatggagagtcacgtattaaattcaagaaaatcaataagatgataggttgttggattgaaatatgcctatcaaataaaattttcagatttagaaatatgactatcaaaagtagatggagggagtaatgtggattgatttaattgccattgctctgtgcaacccaatataaaatcctacatttattaggggcttttatactgttggctaactaaacatagtgtaacacttattaggccgcgaaagtaccaatggaaactctataaccaacgaccaaccagattttattccaaggtgtggataatttaaccttgctaaccagattttatgagtgttttaccatcggacattcatttagcaacactgctaactaatccaaaatagaagtaagctgttaggacgtgatgtttggtggcaataagtttgtttttgatttttaaaagaaattttgatatggaattttttttcatggagcatactatttatcagtttagaaatagtactcactgaagacgagaaaattttgaaaatatgcctaaaacacgacgtaagtctcgctagctatttatattctttattataattatgatcatatatgcaatctcatttctctgctgctcatcgctctccttcctttcatatgatccagacgacaccgccgttatctcagccttgttatcgccgttcactgtctttctaatttccttggtggccgaggtgcttgctatgtactttctttgtcccaaaatataatggattttggacggttttattatattagaaagtatcacatccgtataaaatcccatatattttggaatggagaaagtatatactagctctctgccatttgcacaacgaactctcccgacacacccctacactatccaccccacctcacctcacaccctgtcaatcctaccctttaccatgatgacctaattcgaccatctcctcatgcaactgttggatattgaggtcaaaaagcctatagtagaattcttcaaatctcagacaactgattagtactaacaaacttagggaccgaaggccttcactttattcactccagctcacagagtactagctgagttgcttttcatccatggtatggatttttgtcgctagagagaatgtcttctcgttttattttacttatagtctaaaaaatcatctttttttcttataaaaaaggtaagatagattaatttataatgtcatttcacgagatttggagaattctagtacctatataaatttttttttaaaaaaatgtctatgaattacgaattctttttgtcagatttgttatatttgtttttacttgtattaattaagtttgaacttatattttaaagatttagatgacattgaaaaaaagtacatctctttcatgggacgaatagactttctatgaattacgcattctttttttctttagaactaaagtacatctctttcatgggacgaatagactttcttcccatccattagccggtgatcaccattcaccagcgcaagtacacaaccaactctgcaggccggccaacgcctgtgagtacaccaccaagataccctcgtccccactcacctgcatgccgctacaacgctgctgctccgcgtccatctcctctgccgccatggtggttggagttggaggaccagcaggtgtggagctataacgaaatatagagagatgtacttgcttaatttagtctactttacatcgagtttaagctgatatgagtgtctaattttatattgagaggtgtgcacatagtgaaaataagtaagatatagttaaaaaaaaatttgttgatcagattcctgggcaaaagcgctagtctccgacgacgacgcagatcaccatcggtacgtacgtgtataccggcggtttcgttgctgcgacggcgactgcatctccgatttctgcacgtagttccagttcgcctgtacttggagaggagaggacagcaacctgcggtggtctcgcctctccctaccgcgctttctctgcttttctcaagccgatgcaccgctcgctttctctgctttccaagcgtaccgcgacaccagttcatcagttagctcgtcagttacatccatctctctttattatctcgtagtacttcttcacttctttatctcttccatgctggagtagtatgaccgcccacagcccacagctccatgcaccgatgtactcatttttacctgtctctgatccgtggtggaaaagagttgataatcccgagtgatctcttcagcatcacgctgtgagtatgtgatgatttttttttactggtttctcctcgagaaaactaccacatgtgaattgtgatgttcagaacgggttcagcggtatgcgggctgattttgctttatgtttatcgataaattttttctaagaaattatcaaatataactaaagtatttgtggctactatataaaactttcacataattctaaatcaatagatttactactccctccgtctcaaaatataacaacttttaacattcacgatttgtcctaaattataacaacttctccaacaacattctcttcctaaccaatcacaacctccgccatttacttttactacctacctccactactcatccaatcacaaccctccaccactcacttctacatactttattaataaccgcacttctacatactttattaataaccgtgtctaaccttaaaacttgttatattctgggacggagggagtacaagattcatgcaagttggaaagaaaaaaagatcaagcgtacgtacgtgagtgatgtcgcgatctccgcttcatgaaaatagcgtgttatcatatgattttgaaagttatatacaaattgtatcataattacatacgaccacctatacatttgtcgacaaattttctgctaaaaatttgacagatgtaattacagtataatcgtagtgtaattacactgtaacttgcatgtaactacagtgtaacttgtatgtaagatctattacaagatttattttggtgaggaagaaaacaaatcacagcacacacatatgtgaaagaatttgtttccacgacctctattttactgaaataacatgttatggagaggtttttgaaagttacatacaagttacattatagttacagtgtaattatatgtaagttacagtaattacattatgattgtactataattacatctgtcaaaatttggggggggggagatttgtcgataaatatatagcaaaattgtctaagaaaatttgttgacaaatagtccctacgtggtctgtgttacagcccacgaaggcccgtagtgggtagaaatgggccgacggcccaagggaattcgttgcgaggcccactaggagtcgccaactagtataccccacgcgagcggcagagaggccaggcaaatccccatcccgtggctcgatctccctatttctctctcccgtgtggtcggagctcactgcagcggcggcggcggcggcgaacgaggggggagagagagaggtcgaggtagagaggaaagggagaggagggcggaggaagatgagcgggaacggcgtgaagaaggtggcggagtggccgcgaaggccgggaaggcgatcgactgggaggggatggccaagatgctcgtctccgacgaggcgcgcaaggagttcaacaccctccgccgcaccttcgaggacgtcaaccaccagctccagaccaagttctctcaggtattcaccacccccccccccaccccacacccgccgccgccggatcggacctagggtttccggatctggggggcatcctcccgtatccgatccttctgatcttgtattgaatgcgaagatcccatggtgagatgttagtggaatcgatccatttagttgggtatattctgtattcgtgtgcgttgtaataattttgttggcatgttgatattcagttagatttggactttaccaatatacatcggagataggttaacccatacaaatgtagtcgtcgttatgccaacattctcacatcgttggtgcttacgatcatcagcataagaacgttgttaattatggacatctttattccgttcaccgcgtttgcgcgtttggatttttattatagtctacagactacgttcgatcaccaaggatctgtattgtctttgtggctaataagattaatatggtttgaattaaaatgatcctttgtcttgtcaaattgatgccgtcatgttcctttggtacttttaccttgaaaaatgcctggaagaatctagaactcttggatgcatgcattttctcttgatttgcagcatgcgttttctcaatgctgttaatttctgaggtcccgtattatgtttctaaaagtttctctcttttgacactgcaggagccccaaccgattgactgggagtactacagaaaaggaattgggtctaaagttgtagatatgtacaaggaagcttatgaaagtaagcattttaggccctgtttagattccaacttttttcttcaaacttccaatttttccgtcacatcgaactttcctacacacacaaacttccaactttttcgtcacatcgttccaatttcttcaaacttccaattttggcgtggaactaaacacggccttactcttcaaacatatcccgtctttcaaggaagtagggttaaatttgagtgtgcttttctttgcacaaacgttagtgtgtctttgtaccattgttctacagtgatgttacaaacttaatgctcagaaatagtgtttgacaatattgattttttttttctaatctattattggaatatgattctataatcacatcaacatatttcaatatttcataaggcgtgggaagtggcaaatatgttctttctagttgatattgttgtttgatgattatgtgggttgattctcttggttgtctcttagcgtgtgctaattttctggtcaatgaccttgttatgccttttcttgttgtcgctcttgtgtatagacctttgaatctttcagatcatatcagtaatatgtatatgctgttttcagttccttctaatgtcaatcaatacgatatcttcgtaccatgttgctgacatgcaattagcacatactacctaccatgttaatgattctaattggctgtacctttttatttcaaaggaacaagttgttttgtaaatccaaatgttaatgctttttgtggcactgtaatatgctcagaaatgcatgttcttctctgtgatttagtcaatagaaggtagtatgtgttatttcacatgcccttttccggatgggaaaaggcaaatttattgttggaatattagtaaaatgctgatcacatcaaccttacactttgaatttgcaattgaccccatgcaagtattacttttgcttaattcttctggtttatatagtttgttccgcctacttgtagtgaagatactaagcatgaaataaatgcaggcattgaaatccccaagtacgttgacaccgtgactcctcagtacaagccaaagtttgatgcgctggtgaggaactataagtctatcacccttgtctggaactatcattctgttatatgtgcccgtctttctctcatcttgcttcaacaggttatccttctgtaccctttagatactgatgcaccttttatccttttctcttttatcacgtcatatgcagcttgttgagctgaaagaagcagaaaaggagtctctgaaggagtcagagaggatagagaaggagcttgctgaattgcaggagatgaaggtgaggatgatctctggcgaaacttgtatattgcagtccatttgtcagagattggttgtgcatgcatccattattaagagcatttttccatttgctttaacatatacttgttcacgtatacagaaaaatatcagcacaatgacagcagatgaatactttgcaaagcatcctgaggtcaagcagaagttcgatgatgaaatccgtaacgacaactggggctactgaagagtggaggaactctttgtttccctttcttggaagagttaataattttgtcttgtgtcccagagtgtatgtataggggaatccactatcgcaacaatggtggtttccataccatgtggatggggcctgtttaaactcccaaactgattctaccatgtcgtccgtgctgcagttccaactgaatttgcttgtgttggacctcttcattttctagagggttgacccttaagaagtttatgttttattgtttttgtgttcatctccgttctacatgaataaagatgatcaattgttgaaagattatgttgatctctataatgccgagataatttgtgtatttatgtagatggtttgtttgtcgagtgtagtatttcgccctctgttcacgtgagccccacctgtcatagggcgagtccgctctgacaatctgggcccacctgtcagagcgaccagcagcatctccgtggctacacggaaccggtgcgcgcacccacggtttccacccatccatggcggccgtgcgcattgccccacgcctccgctctctcccgctcctgctccccggaccagacgccgccgccaccgccgccgccgtccaccgcagctgctcctcctgtggcggtagcttggccgcgttggcgcctgcccgcctgcgcgccatgtcgtcgtcgtcctcctcctcctccgtctccccctccccgtacacgacgctcgtgggtcgcgtgagctgcgagcgcgagatcaagaagagcaagttcatcgccatcgccgcccccgtccccgacgagcgcgccgccatgtccttcctcaacgaggtgcgtccccctccacgcgcgctattatcatctccctcaccgacgccccaaatcgggcaagtcttaagtcttaaccttgagccacagggaactcttgtccgactatgtggcagccaacaatcgccaattttttctttgaagggagagcagacaattgttctataggggaactcgatagtttttcagtgtagtctgcactgtaaagtactaatccatcatcctttagttttagtgtccatacctagctgaagggttcgctcattagctaagttgaatgcgtgctatttcgaatgatataaacttcatctaggatttgcaggtatttcgtttagcgtttcacaagttgtttatgtgaggttaagtttgcagttgtatgtgtacacataatattggtccatttaccttcggcttccagaaaactcatccatgtgaaaattggttttacaattttttttgtgtggtatattatcgattaaatttatgagtctcttttgtaacaggtcagtgatccccgtgcaacccataattgctgggcgtataaggtttgtacatatacctgaatcgtacaacaattcatgctcatgtagtaatgtttgttgatgaaagattggtcttttatacatgtctatttagctgggagagcaattccgttacaatgatgatggtgaaccttcaagcaccgctggaaagccaatatactctgccattatttcatctggcattgatatggtcatggtggtggtaatcaggtaaccgatttgttaagcaaaccatttcatgtaattttaaaattgtgacccacccttttgttgctatttagtgttctactgaattaagtacctcaacttgagcagagataatactgtcactaactgacagatatatgtgtacattaactacaacttttggctagacagatggtttgtgactatttgatactttccatcatattatgatgctatacattgtatagatactttggaggcataaaattaggaactggtgggctggtgagagcttatggtggggttgcttctgaatgcctaaaagatgctcctacttgtcttgtaaaaccaaaggtgataatatctaattcttttgcataagcattttcttggtcattgcaactacgtatgaagcatggacttggtataattattatttaatttctgacttcactttaggctcgtgtgggtatggaggtaccatttgatctcttgggaacagtctatcatcaggtgatgattagtggcttaagcggttccattttctgtaaaaaaaacagtacaactgaatgtgcatttctttcagagacttttttatccttctttctgcagcctaattatgactgcgttgaaccttgaaacagttgcaacattaccaagctgaagatatcaaacaggactatgacactgggaaagatggtactgttatggtcatgttcaaattggaatatgaaaaaattgagaatcttgggaatgcagtaaattcagcctgcagcaggaaaatagaactactcctataagtggaatcatagggttaagtgtgaccatgcagattcaatgttcaggttgtgcctactgcagcctctgttaaccagtgtaagtactaagatattccatatcacatatagtacaaatatttttctttacctttttccctgttttgatattttttttccttgtcatctgatctttaatatatttggcttattatttatttaacttataggcactactactacccctgaaatattcagcctttgactcgacgatagttcttagcagcaacttcagattggagttccccaatgtaaacggcagaatcatgttctactgagattattgatcctccaaacatacatatatattagtttctcatcctgtctaccatctattgtaagttaccaataataacgtcttagtattatactcttgtagcattgatatgttgaaagagatgttatgataacttctccatgatctttatgaccaaattgacattaatttggctgatcttttgattcagctgtgttattttgatgcgtaattcttttcttgcaatttatggcttcatgcattgtttcttcctctttctttacaatatcgttagaagattatcttgttgcaatgatacatgtgtatatcttcattatcttgtgtgacttgaagagttgctgaagaattaattgagacaaatcactgcttacatttagtaaagctttttccttatcagtagattatgcttagaaaatttatgcaaacagtttatatcaagccacttt

SEQ ID NO: 58147 - DNA, 4782 bp, Oryza sativa
aatccctgactagtaaccatgaatatcagtctcatcctcttgaagaacttcaggggctagtggttttgggaggtgaggacatgaatgggattggtggcatctggaacccgggaatggtagggatcgtcgtcgggattgtggtgggaatggatggaatagtggttgggattgagggcattggtggcagggtaacaggaactgtaggaatggttggtatggtggtcggaatggccggaattggaagagatggaattgtgccagcggctgttgggggaatggtaacctttgggataggaacagatggcattgggggcactgtcagcttggggactgcaggtatggaaggtatcggaggcagcgtggttggaactgttggcatggagggctgagctggggctgcctctggtgctgcagctgcagctgctgtgtccaaaagatgacgagctgcgtagctgcaatggaaggctgagaaggccaggagcagaaccagaagatgacaaccagaagaagccatggtaagtgactgttgtttttgtgtgttctggaaggctactgtgtttcttttgatgtgaggtgatgcttgtgaggctgtgaagctaggagttgatgctggagctacttatagcaatctgtgatcaggtaagccagagcaatggtcttattggtagttgatctgtgtgctttagctattgaagtccctggccttggtttggttgttcaccatccaatataaaaggctctgaactttggtggaattggtggcaccaattatctcgagatgttgttcgtcaggggggttaggaaaattctggcttgaactgatggtgtggcagtctggcagggtagttgggtttgttctgaacttctgagtttagacatcccagcatcattttggccacattgttcactcgttaggtgtgggatagtcataagttctcgccttcttggtatatatgcctttcttcattctgaacttttcgagctctctgcaatgctcatcacaagtctggcaagtccatgcatttcctaaggggctcttctggtttggttcaactgggtgctatgtggaagattaacagtagacttcaagctaaacgtcatacatagagaaacgaagagaaatggtgccagcaatgttctgggcttccacttaaaccattccaatgacattttgatacatctcctaccccgatattctttgtcccgtgaagttggaactgtaccaaacgctttcgagatccttactcgctatttttatcctgtagaattgatgctgtaccaaacacttttagatcctaaataatattcttcgagatccttactcgctatttttatcctgtagaattgatgctgtaccaaacacttttagatcctaaataatattctctccatcccaatttgatcatcctctaagcaaatgacatcaagaccaaggaattaatcctcattgatcaaggtgctccgtcactttgtgttcaacgaaaattaattcacactttaaatgttgcatggattaaaccaatataaattaattgattggttgcacgcgtgcatgcaggacattccatgatacacatttacttttagcacaaataaaccaagagatactttgttagatgattattttgggaaaatctcgaaaatcttgaaattgggatggagtatccaaatgctttcaggatcctagataatatagagtgaaattgtctctctgcttctaaaaattacttagagggggagctgtaatgattcctcaacattcaatttctatcagataccacgactttgcacgtgcagttgcaacattgcgggcatgttcagattgtagctaaaataaaccttatcaatgctaaaatttttgcaatttggtaatattgcaagttttggcaagattaatttcttatttatttaccagagtttgttaagaaactaaatggatgaacatattcgataattttactagaaaatgacatggtttgaaatgaatgtgaactaagccctgcatttagacctttgcttctactatttcatttcctgcatgtattaactccggagcagcaggagcaagccctgtcgtgttgtagacttgtagaagtacagcacactggcccctactgccggcaaaacacgaagggattcatgtgatctgcagtagagccaatactgaaactactgaagtactggtggacaaaaagtgcaccagtgccacacatctccactgttgcaacttcgcaacactgcaaccgtgcaacagtatacctgacaaagtctacgtgacgatactggttgccaagtacaattaccagcctactagtaccatgcaggcaagcagcaaggaaaaatgacacgcagtacccctccgttacataatataagagattttagaagaatatgatacatattagtattacgaatctagaaagaaaatttgtccagatttataatactgctccctccgtttcaggttataagactttctaacatattaaccacattcattcattcatatatatatatatatatatatatatatatatatatatgagaacgtggataatgctagaaaatcttataatatgaaacagaggatatatcgtattacttcgaaatctcttatatattgagatggagggaatacaaacaaacaaaaaaacaccaagctagttgtgacacgaaaccggtagtagtgtatcagcatcgcattgttcccctagcttagcttagattcgttttgccgcgtacgtacgtacggcgagtagtagcgaagcttaggttaggctgctacacctcggcgagaagcgtggccgcttgtagccgtcggtggcggcggcggcggcggcggcgaggagctcctcgcggttgagaagcacggtgcggagggcggcgcggagggcggagagcgcgacggccctgtcgttgtcggcggcgtcggaggcgacgactacgtcgagctccaggacgctgcgcgtcctcccgccgacggtggcgacctcggcgcgcacggggcgcgcgctgacggagcgcacggcgcggcccaggtcggacatgagccccggcctgtcggcgcagcacacccacgccctgacgcgccgccgccaccgcctgtcgccgccgccgacgacataacacccctcgtcgcgctcgccctcgtcgtcgtcctcgtcctcgacgccgacctcgtcgccttccccggggacgacgacgtcggcgccctccgtggcgtcgtccgccctgcaccgcagctcccgcacgtgccgcaccacctcccccagcagcgccgccttgtccatctgcacgcacgcacgcacaccaacctcgtcagacgcacgcacgcacgcacacacgccatcgtgggcgtcgtggatgtctcgatctcgtacgtacccgggaggcggaggggacgagggtgcggagcgtggcgaggtgggcgttgatgcgctgccgccgcttccgctccgcctcgctgtggctccgcaccgccggcgacccacccttcctcaccgccgccgccgagcactccccgtccgtcaccatcgatctcacccgcagtccagaatggcaagcgaggtggttgtcgtggggtttaaaagagaggaggcgggaaagagggcgggaggggtatatgtatacgggggggcggggggcgccgacacgggaagctactcttttggtcgggacgacggctgttttggcgcgtttcacttggcggatcgaacgaccgatgtgtgctgcctccgtttcaaaggctgtgtttagatttaaagtttgatacaaagttcagtctttttccatcacatcaacctgtcatatacacataatttttcagtcacatcatctccaatttcaaccaaaatctaaattttgcgctgaactaaacacaaccaaaataaggttaaggttaggctgtttttagttcacgtcaaaattagaaattttgttgaaattaaaacgatgtgatggaaaaattataaatttatatgtgtgggaaagttttgatgtgatggaaaagttgaaagtttgaagaaaaagtttgaaactaaactcgggcttagttatttagtttaaattttaactgcacagctatatttattttgaaataaagagaaggttcagattgtatccaaaatataactttccaaattctggtaagatttcttatgtatttagtaaagtttggcaataaactaaattgatgctcatatttggcaattgtacttaaaaatggtatggtttgaaatgatgtaaatctaaacaacttcatatatactcagttaccaagttgaaaagagtatgtaagattaagtttaataggactccatccttcctaaaatataagaaattttggacggatgagatattttagagaattcatgtgaaatgtcctatccgtccaaaatcctattttagatagaggaagtaggctataagataactatatatactcaggtggaggagagaaaaaaaatgaaaatgataaatgttagctcttatataagaatataaaagaactaattatacatatgcttccaagcaaattatagatgctatcgccttgtttagttggagaaaattttttagatttggttgtcacataagatatacggatatacatttaaagtattaaacgtagtctaataacaaaacaaattacagattccgccaaaaaaccgcgagataaatttattaagtctaattaatccatcattagtaaatgtttactgtagtaccacattgtcaaatcatggcgcaattaggcttaaaagattcgtctcgtaatttaca

SEQ ID NO: 58148 - DNA, 2372 bp, Oryza sativa
gggacatggaggctgggatgatcggagggaggtgtcaggggatggcagcctttggggaatggggattttcatcagaattcctgctggggatgccctcctctttaccggaccctcctttgaacgttatttgtcggctgccctcggtcaaaagcgcgcgtcggccgatccatggattttatcccaacagtgcaccgtagttaattaagtccttctcatggatgtttatcacgataggggcagtcaacagtcatttgttaaaaaaaaaagatgaatgaggcagtccccttaaaccttactccctctataaaaagaaaatcaaattctaacaatacgtgtctagattaatctttaaaattggatttttttaacacaaagtatactcctgtacatcggttcaataaataaatatgtggatatggtacacacaatagaagtatggtacaatttcatttatctaataaaatgtttgttatataaaatataaatatgactttttgtctaagtttggcctttactacatagtatagtaatattggtatgtcactaattttataaaacaatccacattatactattagatcattttccctctgttagaacacctagtatttagagacatgctatttggatagaatttgtttgtgtcaactcactttcctgaccgtaccaatgtcgtttcaagaaaatgatatcgttttcgactgttttcgtccctagtccatgtagggtatctttgaattttataggattcaataaattttcttttttgctccttagatacaaaggaatggggttttccaaatcctatgaaattcgtatggaatggttcattgcctatagaatttgaaataaacttagaaagagctccaacattttgaaaaattttcattttaatatatctctcttattagatttctgtggtttgcaattatctactttacacttatattcctgtcagattcttagattttttttctatttttctgtttttttattcttgtgattcgaaggacccgtagtattaaccactgcgagctcatctatgttgacatcggttggattgtgccaagctgctatgagaacacccattctatactacgttgccattgcaacatgctcatcgctccagggtttagaagctttcggcatacaatcgttccttaccggagactacaaaagtggccatgaagaaaagaagaggtagaccgatggaagaaggaaaacgtagatacataagtttatctgaagcagtatattttagatcgtccataaactcagttgtgcattgtcaaatactcgactagaaaaagaataaagaccactacacccacttaaggcctattctttagaactagtaacagataatggattatcgttggcatgctttccaagctcctaatcaactttctaatactccatttcattagcatttctttgaaaacttttagaaaataaccttttcaactttctatcatttagtttattcgtacgtgcattcaaacaattatcataaattattttttatctaccatcaatcagaactttataacaagtctaaggccctgtttagatcccaccctaaaatttttcactctattacatcgaacgtttgaacacctacatgaagtattaaatatagactaaaaaattaattacaaagattgcatgtaaattgcgagacaaatcttttaagcctaattgctccataatttaataatgtggtgctacaataaatatttgctaatgatagattaattaggcttaataaattcgtcttgcagtttacagatagattctgtaatttattttgttattagactacgtttaatactttaaatgtatgtccgtatatttgacgtgacttaaaattttttaccatcaatctaaacacagcctaattaaagacgaatcaaacttttttttacacacactaccgctatttttgcccatgatacccaaacgacgatacctactgcttcatgcagcagggccgtgtgtagtcattcgaagcctctctggcacaaatataatccctccgttttaaaatatttgacaccgtcgactttttaattatttattcttttcatatcatttgattcattgttaaatatattttcatgtacacatatggttttatatatttcataaatttttttaataagacaaacggtcaaacatgtgcttaaaaatcaacggtgtcaaacattttaaaactgagagagtaagaaggaaactcatgatgtcgaagacaagcggcacagggctttgcatacccccaaacagtggtaaaaaaactctctccagctgagcctttttatctggtgccatttcaccggcatcgctccagtgaaatgccggatggagccggggaa

SEQ ID NO: 58149 - DNA, 28222 bp, Oryza sativa
  unsure (1)..(28222): unsure at all n locations
tcgcattgcattctagaagaccatgtagcgttgtgggtttctccaaaagacctaagcgagcaactggttaggtgtaaccgaagctgagttcatgagttatgatagctttcgaatatctgtcgaatacctttcaaggatattcgaattaactcagaattataaactggttgatgcaaccagtccatttttgccaaacggggatcctgacggagcaatcaaagcaagactctgcatgatcctgatttgacgcgcgctaacttgccccagttcctccatggctgcatccctgctctggtggattttggtcaaattagtgttgaaatttgagatagtaaggtttagaagtatgggcgtgggcaagggaatctacttacagtactatcgaaaggccctctcaaagagttgggactgttgtcatgattcatggtttctgaggtgtccttagctcttttctttccattgctacttgcttgatctattctcccttttctagatctctgtgtaatgttacttgactccgcctctgccctactaccacctcgtttgatgcctcgtccaccctttgcaacaggagtaggatcaccagttatgttcaattcactagcgcagcaaatgccattgatcacttcatctacatatgccatctcagcagcatgctgcttggcaataatgtcactgaacagtatatccctaaccataacccttatttctgcatgagaagccaaagttccatctatggttgaatcatcttcatgctgatttgaattctctggtgttctatttacttcatttgcaccttcacttgcacttgtatcactgaaaagtgatgttctatcctccgatggatctaaatatgccttcatgggtgtacaagcagatcgtctcagtccttcccttctacccactgatctctctgtcgttgtcatcttacaagcctcttcatcatatacagaaccaacttgtttttctgtcttataacttgaaccctcaatagaagcttttttaccactggcttgatcttcaccatcagtaggactgagttgtcttgcaccttctcgcgttcttcttcctttacgagtggcaactccagttgttgcagtatatccaagttcttggtgctgctctgcactatgctggtcttttgtatcctctcccatatgctcagaggctggtgattcctttaagcccttttgctttctgactttcttggaagaggtcttggctgtgtccaattcagtcacaccatcaggaaaataaatttaggtacatagtaaagaagcaaaattaggggcaaatggattaatactaaatagatggcatgagtcaggaaataataccaatgtgccattgacatgtttctgtagaacccacttgatatcatcaaaattaatgacagttttaaacttatacatgcttgcatttcaccaagcaaaaaaaatccttttgtttcatagaaaaagagtacatttgcatgttatgttcgtcatatccaattgagcaatatttgatattatgtgatgtttgaactttgaagatcatgtatatcaattaccttcaaagtgatgctgctccatactacttcttaataccaccattgcaaggattttattaacagaaaaagagcattgttgacatataatttcttattttttactagtaaaatagctattctttcttctgtcatccaaattctgctctatctattgttagtatcgccatatggctcttttctgttttccactactgcttgttcaaatgttctcgattccaataaagactaacatgcctcaacaatgagttactgacaatgtgacccatatatcagttttataaacctcactgtgtcatccagttatccagtcatccacctagatattttctcccactgacagaaggtctacaacggttagctttgaggcagggttggaatggtcattttacaaactcaaagtctaactgacagtagtagcaagaggggtaaattctggatggcagaagaacaaaaattctctagtaataaagagcgaataagggattgaacgaatgatcaaatcattatccataaccactaaaaagctgagtaaaaaaaaacttgtatatgtgatatatatcttcaggtaaaaacagaaactcacctttcaagttgccagcttcttcagtagaatcgcaaggtgaattaacgtgggacagctcctgcattatgggatgttttcagcagctaaacatagttacatcttaacatatgtgatgcaattatgcaaaggtgactgtcgtaccttcttaacggcctcatggaatgcttccattgcacttttattctctcgcttcagcatctgcatgcgatgagctcatatgtgaaatataaaatgaatatcgatatgattcattttcttccaagagaaaagataaatggcacagatttttttaaaagtttgaaagcccaaaccagctttttcaagcagttgtattataaccattctaaactggtttatgttatcattctgcagtgataacctggtaagccgaagaaaataaacgaagcaatcaaatataattttagggtaagacttttatatttctattcttactttcttagcagtccaaaagacaaggctgaaaaatagaaaacaattacaaaaacccaaatcaactctaaaattaagttctagaattcaaattctggctgttgcttataagccaacaaccagccaagaaagcacctagtgatatcatggttgccttggatatctgtcagagggagtagaaatttagaacaggccaactatgatttagaggcagctaagttatttgcgaccatgtgaaaatctcctttcacttcttcattctctcccccattcactccattctcacacttgatctggcacatttttttaactccactgccatgctgctactagcggatccagcacgtgctgccgctgcccttagatctgatgtcatgcctgaagcattcaaagtgttgatttgaaagcaattgtgttgtttaattgaaagttgttatttgcagttgaaatttgttttattttcatagtttaaagtttgaaccatggtttataatattgggaattttatggttcaaagtttgaaatgcagttgggagtcaagttgttcaatttggaagttttttacttgagaggtttaaagtgaggggaacatcaaaggagaaagggaggatgactgtgagttatggaattcatggtcaactgtgtcagaggcactttctttctaaatctacaatgagtggcacgggagcaatgacaatatatcagtatccttataaatagatattgtgcataccattttgaattccatgttagacttccaagggtctacgtacatgctgaaaatagtaaaagaaataaacttttgtcaccagaatatcatggaaagaaaagaaggcatagcgcattaataagatcccttactgtacacaagtgccatacaaacgaactggaacatgatgcttggccgtcttcttaggcttgctgctgatacatgaattttcaacgaccttgaattcagaggaaaaaaaaaaacaaaacaaaaccagtgtaaatatacacatgggaaaactaggatcatggacaaagtagcagtcagcaaaagtccacttcttagcttctgcatcatctgaacttcaaaaagaagttcatgccaattccatatatctacaaatgtcaatctattatcccagccaacattaatattttacgatttagaatatagcctgcctaatgcaccgttcactgaaaatatctcatcatcttatgaaagaacgatactttgtgcattcaaagttaaagctcggaagatgtatgcaatcgtacctgtgctggccaccacgagccagtgtgcttaacccatgtaatatctcccaatcggaaactgtgcctcaagttatcttctgaaagcgcaggagacgattggcattcttgaacgccatctcctttctctgcatgttctttcaccatgatgatcagttcagacctgcaccagcacagagtaagaagaaaaaaaaactgttatagagactgtccacaagcaggggcggatccaactttggacatgggggggttcagttgaacccccaaacttttgagaggtttaaggaggagaagaggttcttccagatctagaagagaagctagggttaacgcaaagcaaattccagacaacagtagtcccggtgggagagagatgaatcagaaagaggatgtggatgctcaccagaatcccctcccctgctctgctcgccaaatggagatcgccgccccctcccggctcagccgcgactcgccttggcggcggcgcaaggagcagaggagacaacgagacgggacatttcgcgacacgcgactactacaccttcgaactactccctctgtttcgtcgtattatgctgcatctaaaattatacaaatttatagaaaaaattaacagcatctaaaatgccaaactagttcatacccctcagtacttataaaaaaagtcgtttaggataatgtttaagtcaaaccttagaaatataaatcataaataactctcaagttattgtgaacttgagtttgaaaatgtaaaaattatatgaatagatttgtcttgaaaaatactttcatcaaattatacgggtctatttggcacagctccagctccagctccacccctcctggagttggagctcagccaaacagtttcagctccaccaaaactggcagtagagctgggtggagccctctcataaaatgaactaaagttgggagctgggtttaggcagctccacaactccactccagacctatctcctcgagcaaaatttaggagttggagctgtaccaaacaggctctacatatatcactttttaataaatattttattagaaacaagaagttaaagttatgttgagcaaaatttaggagttggagctgtaccaaacaggctctacatatataactttttaataaatattttattagaaacaagaagttaaagttatgttttggaaaccgtgtcgttgtcctaaacgacttcctatgtgagtatggagggagtagaatctaacattgaatatattttaataatacgtttttaaaaaaaatattaatatatatttttataaaccggtcaaacttgaataagaaaaaattcaaatgatttataatatgaaacggaaagagtagctattagtatttctttctttacgatgactggtggcccatgtattatcaatacttaaaaaaaataacaaactcggttagcgattgtatcgacaacaaactctttctccatgagccaccatcactactctttctccatgagccaccatagttcctcctctccgccttcacatgcacctatagtaaccgacatgtctttttctcctcccatatcgtcatacacactatttgttatggttgttgttgttgttgtggtcagggatatcgggcttgcaggggctctgggacgcaggagctgccccgacaaagaacgaagacgctagatccgggctccttcttgctgaatctagcggttatccaaatgtcggagggaaaaagaaaatggaaaaagaaaatagcggttatccaccgacgtggtatgaaaacagagtggatacggatggacaatgctcataccatatttgttttcagtttttttgctagttaagaaaacgaatgcgaatagctcggatatagaaacaaatacgaaatatctcgaataggaaaatgatcgaatatgatcatacacgaatatggaaacaattttttctcggaacacggaaaccaccttaacttctaatagaaacaaatatcatcatatataattagaccattttatatgaaatattgtataatttacaaaatatttaaaggtttaaataatattaatagtgtggacaagtgttaagagatgggcaactattaaaatctaaaaaggtatattgaatgtcgtaaagttataaagaaatggggtatgtcttttatctcttcagcgaacatttgaatagcaccattcattcgcatccgtatatgaactatttgagagttttcgctccgaaaggtatatgtatttgtttttctccggagtggatagaaactatccgctccgttttcatccccagtgacccacataatcagtgatcatgtccatgtgacttcacaccagaggacctcaattcaaaagcttatagctatgcctagggttactaaagagatttagttcttttcaaacttggaattgaaaaaatggagcagttgaaaaaaacacgattttgataggaatataaatccaaaatagagtattgtgaaacaaaaagaaatataaatgactgtttgaatagaccgtataaaaagtaataatcggatgggagatatagatcaaagaaaaattttcaagaggatggagcttttgctaattttcctataaaatctctataagatcacccattctatagtaatttcaagagcaagagagtatatgcttcactcctttatataaaaaaccttgatagaaattttttctgtagtattgaaaccctccaaatttatatgtttttgctagaaaatcaaagagggcttgagaataaagagaataactatgacgccctcattaattaatgggtgggtgagggaagggttgttagggtaaaatagggagaaaataaatatgggtatgttcggtgtagctaaattgtagctgcacagcagcagccactacagtgcatggtaaagaaaatatatacatcggctatagcatagctggttacagctgaagagcagtgttgtcgattagagcctatagagtgattgagtgggagaaataatactatagtatcttctatatttgtgaatgaaatttaaacattagaatctcttatatttatatttatggaagtaaaagctttataattattgagcaatatatggtttgaactgtatagaaactagttgattcccaagtgctgcgggaattactaaataatttttaatatgtttttttaacaatcgagttaggagtaatattagttattaacaactggtttgacaaaccatgtctagaaaaataaatttagtagaccatatatgagattgtagatgaaatattaggttgtcatctaaggtggtgttttttttctcctgaagataaagattaagttgcatcatcctaaagtaatgtacatttggcactaccaacaacccatctgataatcttacaatttacaacaacaaatcttgcgctcgaggtggcatggcacaacacacagaatctaaccatctaatgagaaccaactttccaactgaaagaagaggaaaattgttcatcaccaaaattgctgttcttgtagaagatccaatctctcttcattttcaccccatttttgcccctctcatcagcaaacaaagaatctatcgtgcacattcagaaccatgagtttggcgaagagcaaaatttgccaaaaaaacattctaattgatctcgatcaccacatgcttgttcttactgcttttgggcctccctcgcttccttgccccaagctttacaagtttgggcttcaccggcaatggcgctgccgccggcggcggcggcggcggcgacggcgctgtcactgtgccatcaccggaaccaactgctgcattgccctcggcagcgtcgccttgagctggcaatggcagggagtagggtcccattggatagaatcccagagcagccggtgcttgcttcgtcggcgaagaagaagaagaagaagaagaagaagaagaagaagaagaagaactggttggtcgagcgaacgcagggccaccggggaatcccatcgggaagaagccccatgagcagtagtacatgtcggtgcccggcacgatgggcggcggcgtggccattgccgcggcgaagaacggcttgcggcagctggggcagagcagcgtgcgcgcctcgtaggagcgggtgtactcgtgcaggttgcagcaggacgggcaggccgtccagaacgtcgccgccgcctccacctccgcctcctgctgccgctccggcgtcggttggggtttagcggcgcgtggcggccgcccgcgctttggccgcgccggcggcgtcgacaccgccgaggccacctccggtgccgcgggaacaggcggtggcgaggctggccgcggtgaccgcggctgcggctgcggctgctgcttctgtggagagggagcgggaggcgggcgaggtgccgccgcggcggctgcggcgtcgaggctggagtcgagggaggccttgcggacagggtcgaacaggaacgcccacgcctcggcgacgaggcgggcggcgtcggcgaaggcatgcaagcaggggcggtcggggtgggagcggttgaggaggagggagaggcggcggtaggcggagtggacgacgtcggggtcgcgggacgcggggtcggcgcagtcgagccccaggacggcgtacgggttgggcgcccccgtcgcgaggcgccgccgctgcgcggagagcaggatgtccgcggcggcggccaggtcgtcggcgccggggacggtcgggtcgtcggcgcgcgcctgggagacgaactgcttgcacccctcgaggtcccgcgccatcaggagcttctccgccacgcctatccaccgctcggccttgcgccgcgcggcggcgggatccatggcgtcgcgtcgcctcgcctcgccgccgtagggggggaggacacgggggattttgactgggattctgctgggaaagagaagagaaggagatggaacggaggaggacgaagaggggcccggtggtggtagtggggtttgcgggtgcgcccagcaattttagttggcgtcctcgatttgtgtttttgtttcgatcttcgtgtcacaggactcggaacagagcatgaacatgaactgctacgtccacacacatagatttacgactccataaatgaagaagaaaattaagctgacgcacatgagaaagctattactccctccggttcgatattaattgacgttttgaacaagtttgaggtcaaatttttataactttaatcatcaatacctttaaaaatatttagtttaaaggaactagaacaacatatacagatttatcttttaaagtactataataaaaataaacatgcatttatttattatatatactataatagaaaagtaagatcaaagatatatcttgtagaccgtgtcattgtccaaaacgtcaattaaaatagaaccggagggagtagcacatactccctccattccaaattgatctacatatagtttttttgggtttattcctaaatgacctacatatttgtgttcatttattagttctattcgttatttgtgcattggagtaaatggacattgatgcatgcatccatgcacacatatatttataacccatatgcaatatattgatttgctattggctagaaaatagtggggatggtgcatgcattgagtttgctgctagagtaaatatagtatgagagagttattagctttttttggtcttggtgtacctatgaaatactcagatcaatttagaatggagagagtaattaattaagctttaattattacaaacttaacaaatatatatatttgatattttaggacaacttttatatagaacgttttcgcacgaaacatattgtttagtaattttaattcgagtgagcggctatcgccccctccctcctccccttcgcctcaccgctgcccgagtggctcgtcagcaaagccggggccatatggatggcggcggtggggcgctctcccccacgaggaagcccagcggcagggacaccgggggctgctcggtagcagcgggtcgtgggaggtggtgaccgaatggtcggcgtggcggatccagccatgccggaggtggatccacctccctcggcagcggatctggccccccgcattcatatcgggatggagtggcgctcccgtggccagatcgagatggagcggcgctggccgtgccgcatcgggaaggaagccaaggtacaagcgaaggacgtcatggctctgacggtggcggtcgcggtacccatggaggaggctgaggtgcaggtggaggaggtcgcgatgctggcggtggaggtcgcggtgccgacagaggagatcatggcgccgtccagaggggtttgcgcttacgacggaggaggcggaggccactgcgacggtggcgcagcccacggtgcgaccgagtggaggaggcatagggcgtgggcagccccagcgttcctaaggagggagaggcggcgagggtagaggaggatgagcgggcagcggggctgagagcgcgaaggcgacgcgaggaggagagaaggcggcaggcaaagggagcacgtggaggctccgatttgacgccgtggcatgctcacacggaggaggcgtgggtcagtgcctctgaggagggtgaggcggtgagcaggccgtggaggtgggggggggggcgggcgtgtggcaaggtggcgtgacaggcgggcgataggccaacatggcgttagatgcgtggctggcagtgtagtgcgtaggagtccagcatggagcgcgcaaagagagtgcccgtgtggcggcacgcggaggctggccgccagtggtggagcaatggcgtgtaggtgtggaatcataggcggcgagtgaaaacctagcccggttttggtcaggtcggcaacattggcgttttcgagctcgcttctcctcttgagggcgttgtcgtaccatctcatcccctctagtggggctaccgggtgaaaacttagtctcggttctctttgagaactcgatggacggtggcgacggtgctttcgttgtttctctccctggagtcgttgtctaagcaaccccttgccaaaacctcccatacaatgggtgcaagctcgctctagactatgtccttctgtgccagcaccctagtttatgcaagttggctacgtcagagggtctagggggagagcggttccattcttctctttcaccctctctccctcaaccctaaagatgtggatagagtgaagtttggtatcgtttgttagggttgggttttgggcgattccagctgtagtttctttgttggcttagcggtggccggttcggtgctagcattttcctgggtttgtgtattggtgctgtcggtgcatgggtggtggttttttttcttcgtttttctgagtacgatctcccagggttataatcttatgattttttcctgctctatcaatatgaatttgtgctgtctggtatgagttattccaaaaaaaaaaagtaagatacgacgtggtcgcaggatgcgagggatgtaaatgtattgaagggatacgctcatctaataattcgacaagggtaattaagtggttacgctctttgtttcaaaaaatatagatactttctaggtacttggataattagctaaatgtagctatattttaagaaaaaggagtagaaatcaactttttttttgtgaaaaacttaaatgcttaaaaccaacattcttttgagacgatgggggtacaagttattttccccttatgtttaacggtagtttcttctaaattttcgctaaactctctagggagaatgagggaacatagatggaacttccaaataaaatcacgggtcgaatataatccaagtaatcacattgtacaatcacctagaaatttgctcacttccatgtgccaaaaacaattactccttcactgaatcactgatataatcaaaatttttggtaagcaattttctagtgcaaaacaatcaaaattttggtgtaaaacaacaaaaaattttaattaaaaaaacaagccaattttggcaagcaaagttggcaggagtgcactcctataaaaagtgtttttttttttaaaaaacgaggagtactacttcactaacccattagaaaatggaatctgtgcaaaaggaagagcccaattaaccgtactattgttgcgtcatgggccgggccaaatcagaccacttcgggatgtagcccatcgtactcagagtctcttgttaaagcccaagtagagcgcaaatccggcccggtcagagttcccctcctcctggttcccggcggcgactgcggcggcggcggcggcggcgacgcgaacgccgagatgagcgtgttcggcggcgacagctgggcgcgcgacgcgcggcagcggaagcgccgcctcgacgacctcatgctccccgcctcggcagtgtccccatcctcgtcctcgcccgattcgttcaggaggctctccaacggcaagttcgcctgcctcgtctgcccccaccgccccgtcctcgactcccccctcatgctctccgtaagcgatccccttctgtgcccccgccttcctttaccctaaccacgtagttggattctagcatcttggattctagatgcttaatggtgtacattgttcttgcctatgcgtgagcacgaagaccggctcgttaaatttctagtcctgaccaatcgatttttatttggggtctgaatgaaccatggattaggaaactgtcacaagatagattggttcaaatgttgataagaatggttcagaattcggattggtatgagagaagtaggtgtcctaagccagtagtacctcccttaagttaagtatgatgaggtattgtgtttgatgttttgattaaagagattagcattgtgaagctattgtgttgtcatgtgatgtggagctattctgtccgtattgaatttctttgccacaatcgttgtcagttgttgccgtctagaataatgtaaaaatcttgtccgtgaagcttatttgtgaaatttcctggattgtcatgaatacatattggatcagtagcattctgtgtgtatggttggttcatttgtccatgttactttagtgtgtgtcagctatttttgcttcaaacatcgagtgatatggctctctagatccagtttcttatccaatgaaaagagcttggggccaagttggtccttcggtctaaagcgctctgtgcatcatgttgtacatgaaactttgtgttgaatgatcctagggagtatatatatgttagaccgagatatgttcgttatccgtctcttttgcattttgtattgttgaaaattgcgaccacgtgttctttgattattttcttcatctctaaatgacaacaaatgaacagatgcataataaaggttcacggcacattgcagcagaatcgaggctgagggagaaagaattatcaagacaacaagagatcaacaagagacttgctatttctccagaagcttccgtttcaagttctggtaagcaacattatggtgttaggtctagtgatatgaaagaaaaaccattgattcagcagacaagacaagctattttggaagcacagtccagcagatttatcatcgacagcgccaacaagaaatctcatgatctggagaggacatcaaattcttcactgtgtgattcccaagttactcctagtgttccaatggaaaaatggagtggagatactgtgaaaggaaaaatctttgctggtgacagaactgcaaccaaaatgcttgcagaggagcaagcagatttccaaaaacgccaggagcaagaactcaaattcactgcttcaggatggaaacgagatggccatggaagatggtacagggatgaaaatgtgagtcacattttttttttgtatggctctttcttttgtatgttattcttagtagtcaactcaatatagaaagaataacaatagctttgctcatataggctaattattctttgtattgctgtcatgagatttaagttgcttttgctatcaacaataatgaatgattcccaattactaagcctttttacactaagtcacataatgcacttcatatttttgtggcggacagtgatgtggcatcagtagaggtaatgtcctttgacccaagggcctcatagaggatagctcatttctcctctccactgtgcaatccaaatttataccagcatctgtatccactaactattaaaatgcaatggtggatggcaggtggagtttgactcagatgaagatgatcctaacatatgccttggctaaccattttaagggcattctggatgcaacatgataatggttcgaccttaaactcagattgctattttcaatgccagatgaaaagcatgagtccctcaaagatttttgctcatctatgctgtcagtcttccatacttactggctacttgtaacacaggtatcttgtctaacaggttgattattagttgtgccgtggttgttgtactgtctgttttctaattctttttccttgtatgtattcataaaatgatgatgtactataatgtgcctactgaactgaatttgtctttgcgagtgaaccaaagcctctgtaatgttctaattctgttgttactatagattgataattttggagggcgttcgtatgatcatatctggacctgctgttagcctgtataaatttatcacagaatatgattaagacttgtactattgttcggtcaccgggctactattttgtttgcgcagccctgtcatcatggtttgtttcagcagtagtacatgaagttattcatgaagtgaaggaagggaagtgtgcccgctatttccatcaatatagacttgcaaaactgaaattgatgtcaatcaaaccgacttcatctccaagcacaaattgcgtgcgacacaaaagaaaataactaattaaatatttatcaatagcttagtttctttaccttccactcaacaaccaggttaacaatctcgattatttttttggttaattcccacctggttcgaagtagtcaataaacaacacggatccacagcttttttagtatgatcattatcacaaatcacaacacacaagctcacagcatcttatttatcaatcataatagctgtatgtattttttttgtttcacgcgttctactttgagaagataacgttaagaaaagagagacaacattggtggatttatgtttgcatcttcttaggtcttagctggtagtattacatctgttcctcgttgtaaacatgtttacattgtaatgcatatattctagttcttaagagcactaagacttcctgacgatgtcaatgcaagtacttggaaacattaataatctcatcctttgaatatatataccttccgacgagccggtcaatatttcaaccaaataatagaattttccacccccaactggacaacttagtttgtgtgtgagggagccatagcatnttagtatagcgccaccctaggtgcggtttagcgcatatatatatatatatatatatacatacatacatatatacatatgtatatgaacggaaccgtctgattggaaatgtaaatctgggcctcatcttttcgcttatgcttacaattatcagctaaaatttgaattttctcatgagctgattttgaggttttttcatcgaattttattttccaacctttgcttttagattgctaagaacacatatataaaatttttattcacaaattacttttcgtttgcaaagcgaaaagatggctccgatttcttatacgatttgagaaaatccaatatatatggatatcagtcaaagcctcatgaacaagcaaacagaaacaaattttaggtttagagttttataattactagtaatatgcccgtactttgcaatggatcagacccatataattggagattggatgaattgagaataaacacgaatcaagctcatataattgagtaatggctgggtggatggattatggataataaagcagaggattcttcaatggttaccacacgagaaggagcagacgacctctactgctctacatggggcagatggaggacaactccgcttttaaagtagagagaatcccttatatatcactttaaattaactggctcctttatatgccacttcaaattggcttctcccttttatgccaccggttcaagtttctcctcccttttatgccattgccgtcagtccaccgtcagttgaccattaacttcattgtaaaaagacgcatttgcccttgagaattagtatacaaccaataataagtattttagtactaatatagctactggatacaacatatgaaaattgattttttctgcatcacatgcaattttagccattaccatcacaaataaattttcaatgtaagcatgaaacatgcagttttctaacaatatttttaatataaagagcatttttcactggttctgacaaaattttattcactcaaaaaggatttaaaataaattagttatgatttttttgaagtttacacattttttagttgagagggcatattggtcatttacgaaaaaaaactaatctttaactaacagtcaactaacactatagtggtgggtgtggcataaaagggtagaaaaacttgaactagtggcatataagggagaaaccaattttaagtgacatataaaaaaactggtcaaattctagtggtatataagggattctctcttttaaggtaacatagatactcctatagcttaactaaaaaccaaggcatagtgaaatcaaaacaaaattggatgtggcttttaatgcatggctcaaacaaccagtaccattgttgtgaccagaacccaaatatacaataagtatcctcctttttcttctctctatcaacatgtgcaaatctcttaacttttcagagtgaacgttgttgtaaccagaacccaaatatgcaatatatatctgcttttcttttttccttgaatgtcaaatatgtaatatatactgtatatccgccttttttctcctcaaaatctgcaaatctcttaacctctcggagcagatgtgtggatgcttattgctactaaaaaccacgtaaatatagtaaaatacaccaaccataatttttccccctcctcttctttttccttatctccttttcctttcccccccccctaattttcttttctgtttttcgcttcttcctcctggattggtgactgcaaaccatgcaacttaattaaccgaagctgttagttaatttgtcttattttattcctttttatctacattaattcttttctcccacattggttccatgcatgctattatcatttccattattgctcgagagaaaatataattaagcacgtctcagtatgttatcctaattaaacgcgatctgcaagcattgcgaaattatatgacaagttgtagttgacgcagcacttgttaagtttcttctcaaactaagagcattttaatagatattcttttcaagaaaagttcaagcaaggcaccaaaccgttgaaaggaactgatgattaattaaagctaattaaacgatgttgtttattaggcttaatttttttttcttgatgaagtttttattagtcttagttggcaactgccggttagcctatgtatctctgcagctgacctggccaatctttgttccttgcttccttctgttgcaaacgtgcatgtctttataaaagaaccccaaattgcttgcttgccttcctgctaatcaccgccaatcttgcattgttctttctttcgttccataagtcgttgcatcaatattagcctgattttgagctatcaaagtagcaaaacgatggcaagtgctagctcaccggaaggtgcaagttcgagctctcctgaaaaggtcaagatggtcaccgtcctgagcatcgacggcggcggcgtcagagggatcatcccggccaccatcctcgccttccttgagaaagagctccaagtaagtgatgaacaatataattgaactaaagttgtgaattgttcttgttacactgtgacttaattattagtgatgacttgtctgagtttgtgtagaaactggatggtccggatgctaggatcgctgactacttcgacgtcgtcgccggcacgagcaccggtggcctcctgacggcgatgctcactgctccaaacgagaacaaccggccactgttcgccgccgacgaattggccaaattctacatcgaacactcgcccagcatcttcccacagaagtagtaacctagtcccatgcatatgcatgcacacatagcaaaccaatttgtcatataaaattacatttcttagtacaacatgcatcgtttgcttgctgaagattgcaacaacttgattattatttatatatatattctaatcaatggtgaatgagccggtgaattcgcaggaactgggtcttgtccaagatcgccggcacgctgaggatggtgagtggcccaaagtacgacggcaagtacctccattcgctgctccgagagaagctcggcgacacgaggctggacaaggcgctgacgaacgtggttattcccaccttcgacatcgctaacctgcaaccaaccatcttctccaaattcgaggtacagcgtcgttttctttcttcccatgatgtttcagtgaccgggctcatcacctacacacgagcataattttcgtctaccccccatcagtgaagcagctaccaccaattttgctctagtagtggatatcaatcatcaatgtcaatatccacttttccagtggaatatatagccacaaatagagctaagacgatgatgtgcacagttttaattaggtggcttaatcagaacaagagaatttttggcgaatgaagattaaccaaagataaactatttttgtgtatagtctttttttcgaacgatcaggctgttgccgacgttttatataaagaaaaaagtgtcccattttaagaagtaatcgggaccaaaccttatagtcaacacacatgggtataaactataaaggataatgaaatgtttggaatttctaatatatggatggtttggtgatgatcagttgaagtacaagccactgaagaatgctctcctgtcggacatttcgatcagcacctccgccgcaccgaccttcttcccggcgcactatttcgagaccaaagacgacaatggccagacgagggagttcaacctcgtcgacggtggggtcgccgccaacaacccggtaagcaccacgtgtcgccgatgcaaacctcaggtttctttttttaggacttttaagggaatcaaactatttcctgtgaaaatcccattctgcaaaagagtcctaataatactccctctgtttctaaatatttgacaccattgacttttttaaatacgtttgaccgttcgttttattaaaaaatttaagtaattattaattcttttcctaccattcaatttattgttaaatatacttatatgtgtacatatagttttacatatttcataaatttttttaaatacgacgaacagtcaaacatgtgctaaaaaattaacggtgtcaaatatttagagacggagggagtatatctgttggaatataataatatatagacatggaactgtatgtgtagacattgtgtgcaatgagccaagtgtccaagtatatcatcctcgaggacaaggaagattgcgacttcttcccggtgaagccgacggagtatggcaagttcatggtgatctccatcggctgtgggtcgaatcacgatcagaaatacaaggccaaggacgctgccaagtggggaatcttcaactggctcatcaagggtagctcagctcccatcatcgacatgtttacttctgctagtgctgacatggttgacatccacctcggtgtgctcttcagcgctcttcaatgcgaaaagaactacttacgcatacaggtaaaatacctatttgtgctagatgagaagtttttactatccataaagaggtagtaccaccgtactttgaccattagtatctcaaaatattttgaaaacgtaaaaatcatataagtatatttttttctttataagacttgcacaatattctaataaaaaattaatgatcaaagtggaacgtcaaaactgagtaaagtagcctaaacaggacctaaacaatgtccatatattgcactgcgtttgagtctatttggggaaaaacaggacctcaaaagtagcctgaactctagttttcttttcaaattaaggagcctaaggtctagtttcaccttgttcttagtcgtaatttgtgacttttcttcgataaagaagacaattagaaaatttttctctaacttaacaagatgttgtatcgatatatgatcgatctgttggagtgtaaatgcagtatgatcagttgacgggcagtgcgggctcgatcgacgactgctccaaggaaaacatggataacctggtgaagattggggaaatgcttctcgacaagaacgtctcacgagtagacctggagaccggccattacgtggatgtggccggcgaaggcacgaacagagatcagcttgccaagttcgcaaagcagctctccgacgagcggcgccggcgccaaaacgagccctcaaattaaattgaattaaggagtgataaaaaaaattaaagtgattttactgttctgctaggccgtaaaatctctttaaattaaaatctcggttatgtgtgatggtcgaactgcttctgattgaatcgaattggtcttcatgtgtgtgttgggggtggtttgttactttgaaacatgttcctcgttccatttttgtatatatcagaaataaaaacttccatttctctaatcatatatagtacatgtggagaaataagtccatgttttgcacaacgaagcagagggtccagactctaaaagacacatgttaagccatgttcactgctactccctcccggttgataatacttattgttttggataagagcacggtcttaaaaaaacaactttaaccattattgtccattataatatgtataaaagtgttaacaaatatatgattttattaagtactttctaagactaatctatacatgtagtcatcatatttgaaagacaaatattttaaaaatgattcataatcaaaagttctaaagtttgacctcacccttacctaaaacgataagtattattagcccggaggaagtacaaaactgcttaatcgtactacctccgtcctaaaaaaattgcatttctagctctaaggctttgtcccataaaaattatatatctagccatttgggccctagcaaattgattcatctagataagtttccttaagttctctcagcttgtaattaaagtatgctaattatatgggttaattctctcaaactttcttttaatcatttgtatatatggaatgtgtgcatgcaatgggttcattaaataaggtcattatggttattttccaatcctattgttttgttctaaattagctagaaatgtaatttttatgggatggagggagtaacaccctatcaataccaaacaaggaaaactcagcattgatagcggtttcctgtccacccgccggcccatgcgcgtcatccgcatggaataaccatcattaatgatgccacataagtgctggttcattaaaaaaaccagtattaatgtgtttccacatggctagtttttcaaataaataagcactgattgcaacgacgtgtgagctagtgacagttcatgccggaggagcgagggatgatggatctgatgccatcacggtgaaaaaacgagttgacactcaatgggatttttttttctagttaacaagcgtgtcttgtgcttgttccgaaaaaagttcgatatggatgtttgtatatgcttagagattatgcaaaaaactggatctatgttctgtaaagtgtttgattcaaccataccaatttttaggatgcctttgtgactgctactttagttggattcgtgattgttttgttttgtggataaagatgctcgatgatgatgcatcggctcggcttcaatagagtcgtaccagctcttttgtttttcaaattgtcaccctatcactctcggattaggaaccggtaacatgaggatcctctcataagtgctcaataattagtgctagtttcaaaaccaacattgatgagggggaaaaactaacactataagtattgttttgtagtaatggttttgttcttggcttactcaatttgtgtacatgggcatttactcaatttgcccgatataaatgacttgtatagggagaaaacatagtttaacgtttcttttttattttttaacatgtaatttcattttcatcataagttggttttaactataatttatagacgatatcttatactgcaataaaaaatatctcctttatctttaaacaaaaattaactatcatttgtagactgttttgtgaatcaggaaaaaaaaatgttctcgtcatatatcctctctagcgttccaagaaactgcactgaacgaacttctatatgcattataagtcacatatatactttgccggcaagaaatctcaatgaaagatgttatgaagacataattaagtttgagataattcttgatcagctaactgtacgtacaatagttttgcttgcaggctgatcagaacgctatccaacttagacaagtttcatatttccactgtatctctgtctcgtatcttggcaaggcattctttcataaacaactctatggaatccaattccagtggcaattatattagtccgagcaaacaacgtcatcaaaaagaatattaatttacacttacactgtgcttatcaagtcaccaagttgatcacatccctcatgtacacactaattaattactacgtccacgccattgactatgaacttgtactatatctatatggattaaacctagctagcttatcctacatgcatgttctggttcatgcatgggaaagctacttgtgcattatccattgctttgaaagtgacattgtcagagggtgaactcctccaccagagaactgtgaggcccctctttttttttttcagccgaggatagcgggtgagatttgaggacccagtgagcgaagttatgtgatgtcacaccccaatctgataccgccgtacaacggcacctgacaggagcgtgtcgtagggaaaactgcgcgaaccgcttcctacgaaaccgcgatctcggtaccagtcccaggacatagtgctggtacccacggtgacaaatatgaatcatagcaatctttaaaataaatagaggacttatttaccttaacttaggttgcagctcagacagcccgagaatacaaccgacgacacggacgaggcgaacaccaacaacagcagcagcggaaccaacggtctaatacccaacaccacaggcgacggctgggaaccaggacgaaaccctaatcttcacttcactttatcttctcttcagggcggaggaactatatatatttatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggcaatgtaccgacctcccgggtcagatcattacttctcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggttacctcatgccacatagaaggatcaaatcctcacgtaagtataggccattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcctacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagaacacgaataccgaggtaccacaagggtggagcgacaaggaaacagggtagtacgacctacggaaattagtgcgactactgggtaggtccgtcggtttggcacgcaaaccgaggccaagcaagttaagtgtgattctaataatgcaagttgcaaataaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagacctattagtagtgccattaaataggtctcaattttacggaattactggaagtggaacggaggcgatcggagctacggatcgagggatatgaattttggaggtctaaatggattttctggacaaggaaaaggaattattaattcccttggaaaagaaaaggaaggagggatcggatttagacttcctcgggcgacttaggcgcggctcgagagattcacaaggcttggccggccattgggccgagcgcggccatggggagacggcccattagggcgcgcggggagagagggaggcccgacggggtgggcgcggtccaccgcgcgggacccacatggcggtggttgggttcacggtggggagggcgcacgcgggggcgggcgctagggtttcgggtgcgcgcggttcgggcgcggcgcgccgggtggacggatggcggcgggcccacgtgcagccgcacggcttgccgtggaccgcgcgcacgggagggaagacggagggaggaggctgactgggcgcgacttgacccagtcaagcgggcccggggctgaggtggctgccacgtggtcggccacgcgggcaggggcgaaaggggaggaggaggaggaggaggcgcccgggatcggacggccgacgacgcgcgaggcgttccggcgagcagcggtgaaccggagcgagcggctaccgccggcagctagaggaggtcagggagaatccgtttaacggcacggatttgagaggggaggtacgacggtggctggcggcggcgaccaagctcgtcggatcggggatgtggtcttgtgagggaagggacaagggggcgcggactcgggcctagccgaaacggtacgcgaccgcgatgcgcacgcggggacgcgggacccgatggtcaccggcgacgcacgcgcggcggcgagaggaatcgacgcgagaggagccgacgacggtggattacggcggcggcaatcaccggagagcaaaaggggaaaacacgacgagacgacgagggttcgattcaaaggggtgggagcatctccggggttcaaggaatccgtttccggcgtcggattggatggagcggcaccgagattggctggcgacgagaggcggtcttcgggagcgggcggcaatggcggcgaggccgtgccgggcggcgacggcgctagggaatggtttggggaggtcctagggagctcaaggacggtggtggcgcgagggattggcgagggggcccatggcggcgcacagtcgggcacggcggcggcgaagcagagcaacggcggggcggcacgtttagggggacgagcgagcaaccgaacggctcggggcttatccaagatgatgcaatggcaagaatttgggcgaggagctcaccggcgagagaggagcaacgttggcgacgcagagggagtcgtggcgaggtggtcgcgacggcggggcgggggcgagcagctggcggccggcaacaaaggcgcgggtgtttcgagcgaggcggagatgaaacgagagaggagggcgcgggctttataggcgaggaggagaggtcggtttggaggagggaaaccgacattggcggtcaagggagctcggctggtgttcacgggcggcagcggcggtttcgtgggcagtgcgaaagcggcgacggcgtggatgcgttgggcggcgaaggcggtggatcgagcggcggaaatcgaaccacgggagcgcgggctggcgcggtcaaggagagcgagttggcgtggtcggtcaagcggcgcagaggcagtgacaccggtagtggtcggaaaagggaaaaagaaggggaaaaaggggcttggtcccttgccataatgaggagagggagagtgaggaggaggaggagagggagggcagctgcttctcccactcttggacgggtgcggcgtggagtggcgggggggggggggggggcatggatgacgtcgacgatgacggcggcggtcggtttggcatggagcgggggcaaggcggcagcgcatggcgtcggcggcgaccggccggtcggccacctcgcgaggcgcgcgcgggaatgggcgaaggcggtggaggttttgggcggcgacggcgggaagcggtgtcggcgcgagagagaaacagagagggagcgagaaaacgagagagagagagagagagatccttctctcggcgacggctcgtgcagcgcacgtgagggagatggcaaaggagagagatgggctggggaggggagatgggccgggggaggaaaatcggtccatccaaaaatacagggaggtaaagtagacttttacagagaaaactgatttggatagaattggagagatttagggtttggattcgaattcaatttgatattcgaactcgagggtttagggatgtatcaagggaaactcaaggaggagtcatggaaaagtttcaaaaggaatacttgggtatttgttctcgggaacatagggtggagtcaaggaaaggattcgaggcgggatttgaataattctggattcgtagaagtatttggcgaggattcaaaggaaggatttgaatttcagaattttgatttcagagacttgaatcggaagaggaatttggatgagggggaggattttgatttcgatgagagggaacaacgggattaaattgggatccttggcacaacttagactctcacacaaagaacgaaaattttcgcaattaggattttgccgagttagtttttaacgactcacgaaaagcggagcgttacatgtgatcttgagggggttaggtaggcccctcaaagacgattggacaaaaggggtttatacagattcgggccgctatgaagcgtaacaccctactcatgtgctatgttcattgagttgggggttacaagatcttcttgttggagtagaaggtggtgttgatcatcaggggcaagagactgctctagagtctaaaatggctcatcctccctctatccgtccaaaaaacaccccctccctaagtaggcctggacctccttttataccataaggggttaccacatgggcccaacaacctaacttagtggagaagtattacaatctttgcattaaatgcatgtcttgtctattgcacgttgtcttgatgatggggcccgtcaaatcttgccgcctgacacggggggtgcccctgtgagtcgccatttaagggatgaagacttctaggctcctgtttgaccagagtggataaaccgactcctgctatgatgagaggctaaaaagcctctcattatgatgtgatgggacagagcacgccgtatgccgcctggcacactgacagggtgggggtacacagccgccgttccatcggtcattcgaccgatcacagaccggttgagtgcactgcacgccgcattaaatgcggcgtagcgcaaccactcaggtcgccataaatgcgggtaggtgagtgcctggaggcagccacctaacccaccgcacgtggcgacctagagagggggtcgg

SEQ ID NO: 58150 - DNA, 10186 bp, Oryza sativa
cactccaccccgggcgccatcccctcggggaagtgccatgtgggtctaggggcagcctccttcctccaaactcggtaccctaagctgggagggggcggcagccactccacccgagcgccacccttctcaagagacgccacgtgagttggggggggggcggcctcctccctctaaacatgatacccctaggcccatatcaccgatagacatatacccaacatattgtcatgaaacaaactcagggcccctttgaatcacagggttgagaaaatgcaggaataggaaaaatgtaggattttaataggaatgaaagtgtaaaacaaaggattgcaaaacgcaggaaaaacacatgaatgatcgtttgattgaaccgcaggaaaaacgtagaaattggatgagagagatagactcagaggaaagttaccaagaggttgaagttcttgctaaatttcctccaaaatctctataggattgtccattccataggaatttcaaaggattggataggatttaatcctttgtttcaaagggctttataggaaattttcttataggattaaaatcctacaaaattcctatgtttttcctccaaatcaaaggggccctcaatggttctaaatatgaattctcaaaaaaaaatattttgctgcattgcttggaccacttatcgtaaggtttatttcataagatatttaatatattcctataatcgaatagataatatgtgacatgtgaataatctgtttcaaactctaccttaaatctacgtaaaactagaatatgaccatctagatgcttggtccatttatttccactatgttcactttagagattaaaaaaatatcacattaataaaagaaataaaaaaaatttcatcactcgatcgtggcgggttaagatgataaagccataaaggcgatgataaagccataaaggctcatatatattgatcgatatggtcgtatataaaatatatttatatcgaaatggaaacaaatatatttatctattcaattccacttttgaatataaaatctagctcgtgtataatcatggaaaatggtttgctagttacacaaatgcatgacggatggacgatgcatttaaatatcttgttttaaaaggcagagagaaaaagatgcgtaccgtcataattaatcaaagcttaaaatatatcgtattgtctgtttaggcgaccctactcgtacgtacggccggattcgttaagtcaactatcaaagcgatggttgtgcttgtttgctggtcctctccgtcgaccaagttgtatgtttgcacaatttatatacgaatgatcttaccctcctgagaagtcaccggaatacatcctagctagtatataaattttggtacgtacaaaaatctctctttggttatatgagaacatatcctatgcacgtaaaccatcatgaatacaccatgtacaccaactataaatatcataaaaaatctagaaaaaattgttccaagtggcttgcgcggtcggcgccggcagcagctggaggcggcgtccacagcttcggcatgcacgggcgatgggccggacagcgaccgtggacgggaggaggactggccgtggtgggtgacggcggcgaggtgaggatggcgacgacgaggtggctgggcgttcagcagcagcggttgcggtggtggtgaccgtgactgcgatcactggaggtatgacggcctcggacggctagccgagggcttggcagacggctgcatctggccggcgcggcatcgtttggaggaggggttggagaccggcttggcgcaaaaaggcgtagccgatggcagcggaggccggcttggcgcgagaggcgcgagcggtggagatgaaggtcggcttggcgcgagaggcgcggccaatggagggaggctggattggtgcaagagacgcgtccggtggaggaggccggcttggcgcgagagatgtggccggcggtggaggaggcgacctcggtgcgaggaggagctgccggtgggtgtggcgtggtctttggcgcatgaaggctggccggcggggggcgccggtgcaggggtcccagatgtcggcagagcttgagtggtggtggagcatcggtgcgtcagcgtagattcgcaggtggtgagcggcgggtgaaaacccagtccggccttggccggaccgacaacgatgattcattcaccctcctgagggtgttgtcgtgctgtctcacacctcaagggtggttgccgggtgaaagcctagtcttggctcatttgagccccgacggacggcggcggcggtttttccgtcgcttctcttcttgaaaacgtcattttggcataccctaagggacgatctcgtctgtgttcctttgttggtctagtggcggtcggtcacgcttaacggtggccggtcctgtgctagccttctcctagacttgtgtgttggcgttatcggtgtgtggggtggtggcatattttttcctttttcctggttatgacccttcagggttgtaatcttgtagtttttttttctctatcgatagaacttcgtatcgtcttgtgcaagtcgttaaaaaaataaaaagacaaaatttcaatagacttgtagtcttaaatctgtcagaatttttgtttttttacgactaaaatgtaatgaatttcaggttaagatgttataagtaagtgtaatactattgattgattgtttttggatttttttatgatatttgttagttgatgtgcacggaatgtacacgtaattaataaatataaagttgtacttgttatactgttgtaattttagcttttcttacatgaaatgatttatgaaattcaaaattaatacaaataaaattgtactcagtttgtaccaaattacagtttttcataatttaataattctaaaactcaaacgtaaaaataagcatggagttgtagccatcttggtgttttgatttattactattttaatttattagttcttataaaattcaattaataattctcaagtcataattgacatggacccataaataacaaatatatatagttacaacttaaattccttcttgatatattaattccgaaatccaaagttcataaatacagttgtacttggcctgtcatctcagttgttttacctaataatttgaaaatcgtaatgaatagacatgaaattttaaatattttggactttcaggttagcatcatattgatttaatttacaattagacatcaatatttgggaagatctaactaatgtaaactcaagtaaacaacaataatttagtcccagtgcacttagatgaatagctaaatttattcactgttctttttattaatgtgagattcttttaaagtccaactaatatataatatttccgttccaaaatattgcaatctaaccaaacgagatatatagtccgaggaatccagatagatctctatcttgattcgtgatattaggattggtttttcagattcgtagtattatgatatgtctactccggttttatgttgtactacctccatatcaaaattaatggtcgttttgattttttttaatgtttgattattcgttttatttgaaacattcgtacaaattaaaaaaatcatacttaagatacttttgataataaaacaagtcacaaataaaataaataataattccataatttttttaaaaagacgaatgatcaaactttacaaataaaaacttaaatcgacaagtattttaggtattttaggacggaggtaataatattttgggatgcatggagtatatagattagatagatcaattttcgttgacacgttttcttactactggagtaaaatactccatagtagtaggtagtactagagtaaaatatagccttcactgaattatggaatggcagtgcaggcaaagcttaattaagcagccgttgacttcaatgtgtggtgagcatcaagtagccaattagccaaattggtactgaacgtgctgccatgcatgcatatatactgtactctgtgttcatgaggcgatgaggattctaatttcttcccctcatatgcttctttttttttcctgtcaaatttaacgtaaatggtggagaaaatttcacaatatagagcataaatttagattgaatagtaccgatatgtttatacattgaatttgttttttaaaatatttcttgatatgttaaactgagtttacatttgattttctatactatttataaaaatttgagtaaattttacaaacaacatatattttgatcaaactatcacacaaaactacagatttaaggtgttctatcacaaaactacatatttaacaaaaaaaaaacttgtcataaaactacatatgaaaagccaagtatcatataattagagattctagagttcaaatccctaacactatctttatgttggagctatataaatggtgtagttttgtgattagattggtgctaaacctatagctgtgtgataaatttgctacctaatctttattttttacactccatcttaattttatttgacactatcttaaatatttagttttgtgagaaatttcatgctaaatctgtagttttgtgatctgacactttaaatttgtagatttgtgatagtttgctcgaaatatttatggttctgtgaaatttattataaaattttgagggactaaaagagtttccgattatcttgggtatatagtttatgaaaattgttgtcgtacgacatccaacgtaacttgccacccatataaggtgaaatattgcaagactacaaatttagtaacaaaattatcacaaaactatatgttttatatcaactttatcacaaaacttggatattaaaccccaacatgtttagttttgtgataattttattattatatatgtagttttgagatatttagccttaaacatgtagttttgtgataagtttattgttaaatcagtagttttacgatacaacaccttaaatctatagttttacaataatttgactaaagtacctatagttttgtaaaatttaaatatttataaacacaaacacatatatatatatactatctctccgttataaattgtcactacctaatgaatctgtctagattggtagtcctaagaagtatcccatcctatacaggaataatggaacttttatgaattcatgcatgtgcctgtgcttgtgcatgtgttgccggtcaaatgtcaaaactattgtgtcttactgatgccggtcaaaaagtcaatagtcaagaccactagtatatataccgtgtttagttttcattgtttctactcgtactccattaagcaccatggacgacgcagacaaagctagatgtatgtacctttcagtacctcgtctccatattttggaaacgaaactacgaaaggaaaatatttgtcttcccaatggatgacgaaacaggagctttccgtgcaatttcattgatcgagaagaaaatgtcgtgtatattacggtgatatcatttatgcactcctagcaaaaaaaatagatcaattatgcgctagatgacatgcgtccacaaacacaattaatatagttgcttttatgcaatattctaatgacagttaaggatgcatgtatctgaacaaattatacgtcatctcaatactgtgtattttatgccagtactatcttaattatttcaggcacacaaagttgaattttacttgttattaataaacctccaactctgatcctttctacggtcagataccgtaggtgatacgtgagatcgagctacttaataattatgtagtatgataattaacataccgtatactgaacgggtacgatattttttgaataaacactacttgatcgatcgagacacaataatacgagatatatatagaagtgtgtcaaagttgtcctatgaacttcaaaaactgtagaaaattaaaactcgcagaacggaatatatattcagatatgtttgtatgcatgtgctaccaaagttttaatttttaattttctcctgtatcgtccagttataatatcccctgtgttctacgcaagggggcttactaaaatgcgcatctttttttgtcgtaaccagtttatctttgagagcggacacgaaatcgattgtttcggtgtctatcattgtcaatgaatatgataatcaactactgaccatgcatgcaaactgatagattaatcagcacgttttggagcaagttgaaagtgagttaattaattactgaggctgcttgaatttgtccattgctgcatcatatcgcacgccagctttgctccaattcgtggagactgagagctagcttgtcatcattatcttgctctcgcagcggagatcgaccagtttatctagctagttacttgggcggcttggagaaggtcacgtgacacattcacgtaatcacgttgtgctagcttggctaaaggagcattatctgaagctgtacgaggctagtagaaaaggcaacatgaaattacattcctatttacgcactccgtctaaaaatataacagtatttaaaatgtcatgttaaccaatattacagatcatccctatttaatttctcatcttgccttaatccctagtatatataaaagaaatctaaaagtagctactatatccgcctctaagatatactctcttcatttcaaaccatttcaggttataaaatgttttggttttgataaagtcaaactactttaaatttgactaagtttattgacaaatgtagtaatatttacattaccaaactagttttatgttaataattaaatatatttttagaataaatttatcttgggtcgaaaatattactattttttttgtcaaacttaaagaaatttgactttgaccaaagtcaaaacatcttataacctgaaagggggagtatccttttaagttatgagtctgttaatagatatctatccgagataccgcatccgttccatcataattgtatttttaggattcaaatttgtcccaaaataattatcataatagagtagtaactatttcattaatcacttttgatttgaatttctctgtaacgctccgtttttcgtgagacgttaaaaactaattcggcaaaatcctaattgcgaaaatttcgttctttgagtgttgagtctaagttgtgccaaagatctcaatttaaatccctcccttgtctcgataccctgttatcaaagatcgtctcctcaaaatttccatcccaatatagtcccgaagctcgattccttctattcggaatcccctcctggaaccccatccgtgaactttgtcgaatgcccgaaccctaacttcatctaaggattcaccttcgcgtcataagctctctccttggttccttcaaaccgattctcaaattcgaattcaacctctcaggttttgattcatctatctttctccctgtattggttcatcaatctacccttgttctctttctcgaacttctgatccaagtctgaatatgcaaatcgagatcacttccacccttgaactcaaaatcccaagattcaatccctttcgccctgagttctccccaaaatgatttccgttccgaaataatctcgaagtccgaacccttctattcagacttctctccaaaatccttacccacatatctcgttgagtagtcaaactcaaactcccaagttacactctctttctctaaattatccatccccttttgactcgtctccgaatattgttcccttccttgactccttcctattctcccgagaccgagtatcaacctcgaaattcgaatccagactccaaccctaaaacctcccaattaaatctctctgtgaaagtctatttaacctccctcataggttggattccttcatcctttttccggtccacctcttccttctcttccatcccatctctctctgagtctcgatctatctatctatcgatcgatccatctatctatctactatacctatctatctgtttatctatccatctgtcaatccatctgtctatccgtccctctacctatcaacctacctttctgtctatctatctatccatggcattctacgctatctcccttgttccatttttgaataatgatcttccctttttgaaatcctctgaaataatccttcgtgccgccaaatataaatccatcccaaaaataccaaaattcccgcttttgaagcccttccttgacccctcccttggatccaccttgaaccctcgtgtacaaatatacaaattgaattcaaattcaatctccacatcaaacttctctccaaatcaaaccttctggtaaaagtctattttacctccctcgtgatgatttgggccgaaacatgccgctggcccatctcttctcaactccctccatctccacgtgcgccgcacgtgaccaccgagagagagagagcgctgtctctctctcccttccctctctcggacattctctcgctctctcgtcctcttcctctctctcgctgtctctctctctcgttcgatctctctctcccgcgccagcgctgccgccatcgccgatttcccgctgccgccattcgattttcggctgtgccgctcgttcccgcgcgcgcgcgcacgctcgtgaccgacctcccggtcgccgcctccgtcagcgcctgcgctacgctgccgctcggccccgctgcctgccgcgagctctgcagcgcgtgcccgagccgctccacgtgtgtcctgccaaaaccgtgaggctgagctcccgctcctatccctctccctccccaactcggcaaagagaagagctcacttttttcccctccttttctacttttgcccgacaccgccggcgtcatcacctgtcgccgccttggctgcacgcgtcgatgaccgccagctcgctctccttgaccgccaatgtcggttcttcctccctaaaccgacattgccatctattaaaccgagccgccccatctccctctcgttcattccctcgccaccaccgtgcccttgccgccttgctaccgccgtcctcgcttccctcctccatcgcgcgtgctggtgaagccggcgtgcgcgcgaggagctgacgcgggactccaggcgccgtctccttccccttccccggcccgaggccggagagctcgctcccgcgtcgtcggccgctcgtcacagcgtccgtctcgactctgtagtgcatctcccgttctccctccttgctccctctcctctccttagctctgggcagtagtgcgagtagccttccagtagcaagctggcgccgccccgaccgccgccgctgctcgccgtaggctcgccgccgtcgctgcccaaactcggtagtagccgctcgtcgccggccttcctcggtgtagctccacccaatccgactctagaaatgaactcaggaggtcgcgtagatgctcaagtccctaggaatcgagctctcatcgcgtcgtcgtcgtttccctcttttgccgccgccggcaagcgccgccgcgattcgtcgtcgccggcctccctccggcgaatccgatccggtggctcactccctctcgtccgtcccatcgttcaggtgtactccctctctctcgaatcgtcgcgacgagctccggtgaactcggctgccgtctgccgtccatctcggccgccccttctttctcctcccgccggcccgcgtggctgccacgtaggcgccatctcggcgccacctcggccttgaccgggccaagccagtcagccgccccctccctccgtcttccctcccgtgcgcgcggtccacggcaagccgtgcggctgcacgtgggcccgccgccatccgtccacccggcgcgccgcgcccgaaccgcgcgcacccgaaaccttagcgcccgcccccgtgtgcgccctccccaccgtgaacccaaccaccgccatgtgggtcccgcgcggtggaccgcgtccacccgcgtcggcctctctctccccgcgcccctaatgggctgaccacccgcgcccgcgctggcccaatggcctgaccgcgctgcgcatgaccccttgggccgagcctaagccgcctgagtaagtctaaatgacatccctccttccttttcttttccaagggatttgataaatccttttcctttagatagaaaatccaaataatcttaggaaatccatatctccccaaccgctcgtccgattgactccgttccacttgcaataattccgtaaattgagatctattta

SEQ ID NO: 58151 - DNA, 797 bp, Oryza sativa
tcctcagtaagtagtactctcatagctaaagattattcattacttaaaataggaaaacaaggctccggaagatccaggaatgaacataatcggctttactaaatagtgttttaccagtgataaaacattgggcaggtataggcaaaaacatggtgaaagagcttgtttacctgactgtcatctgttttgtaccacttcccatgcgtgtccttcacatagcatacataatgaccagaaaaggcggcattcataatatcatgatggacaaccactgcatacaggctgtaaacaggggaagtgtcatcagcttttgggctcatatagcgctgcaagttcaaggtctctggaaatctgatggctttgttgatctttccaaactttccagactgtatagatacagaagaaaagtattagtcaaacactaaatacaatttcaatgcttgttggacttattcaaaactaggataaatgaaacaatgaactcttgaataagtaaacaagttccttcagtgttgctattataagaaaagcaaaaaaaaaggtcttattgtagatgatacctgatatcttttcagcgcaatagtcaggacatttggtgcttccgatattgtcagcttctttttagcgcgctcatgcgatttgcatctgacattacatagtagagttaggagtatcagcattagggactaggcacaaaagcagtcaagttacacagaagtgattaaatatgtagttattacagctctaacacgatacatttattatagaactagattaacaggacacgtcttatgaca

SEQ ID NO: 58152 - DNA, 748 bp, Oryza sativa
atatggatatctgcaatggaaggaaagcatttaactacctcacatctggtaagtgtagcaagtccaaatccctcatctcatacgtttccctccacctcctccgcaggcctcataagcctcgtggccagtaggcaatctctgagttgaaatcgatcccagacatccatctctttcaaaaagttctaaaggccgacaactacagggtgcgtgcgctgggactgatcggacgacctcgtcgaacaaatatgagtagactagatctagtgtggtggtaccaaatacgaagttctccttctcattgaagacaaagagaatggaatgagtagtatagaaaaggggaaaatgaatcagcattcccaaaacaaaagtaagatagggttggcaattccactacttcaaaaggtttgtgccttcctcggtaagagaattctcaaaagctatccaaacaagaaaaagaaatacggcaccgacatttccaatggtagtcaagttcactggaataggttctttgagctatgatccaccactgtcgaatatatttttacaagtgtataaagtctagaagagggcaggggaacatactctcacgttctccgagtgggtactacactgagtaaaaagggtactggtcgacacgggtagcccatttcttgcataaagaagttctcgaacgagacgataaatcttgtcccagcttgaacttctctcataagctttaccggttaaaccttataatccttttggagtt

SEQ ID NO: 58153 - DNA, 5816 bp, Oryza sativa
cggaggatgggtttgggcgggtgggaggaagtgggaacctttggggggtttcggggtttctgtctcttccctctcccgtagaccgtagtggtgagggcatgttttttaaggatttaactttaaaaatttactctgaatttcgcaaagcccaatttaatttctctagtttattttataagaatatttcaacatgcttcactcttaccatttattttggtggagctgaagccatttggctgtactccagattacgaaaaagtggagctagacttgaagttgtgccaaactggtccatcttcgtggaacctccagctttagatgttaattaaggcttagaaattaacatgttagaatgaaaggaataaaaatctaacgttgtaatagttttacattaaaaagtataatttctataagaaaattatttttcaacattaggatcgctaagataacttttcttttaacctatgcctacttgttagctttataatatttagttcagtttttttttcccataaatcctcccgttagaaccgaccagaagttacccaaaaattgaaaaaaaatacaactctaagaacaaaatgatgtactccatccgtcccataaaaaaataaatctaaatcatagctatttttatgggatggagggagtatttgcttgaccctttagaagtgaatgccaattacacctctctccatctgcaacttttagctatatgtctggaaaagaatatatccgatacatagccaaaaagttattacttcattttactacctacctttgcccgtaaaagattttacttttgactatgcacctaatacctgcccaatatacacctaatacttgcccaaatgcatggctagaaatgaaatccttttgggacagtggtagtaccaaatctaattaccaccaatgcggtcttgggattagaattgctaaaatctcattacatgatgatatgaattgtacactactagttaactacaatggactaaactacctcaatggaattccactaaagtacactatacatgaacaaaatacatcacgatgagggtgagctaatgccattaatttcattgaacagctctgaacagctccttccatttctctgggtcgctcccaggtccttcgccctgaagtgataattgacacttcagtcaaaagataaataatttagtttgaacgtaactagacagcttttgtatatttagttttcaacgtaaccaaaggccatttttcaaaaagaacacacacacacacacgcacgaggaaatatcaaacaccaggcataaataccttcaccgagttgatctcgtatatttgtccttctgtgaattcaatatccaaagcttggatacaggcttctgccaccaccagtctgcttgcttctcccacaagcttgtcacctaataggggtagtgatgaagagttgcaagaataagatagcttaacagaaatccattaataacaactagtataagttaccttcgcccatgacaactgcccgtctttctccagcagtagcttgaagaagtgtgttaaggtcataagaagtgtagggtccatcggttaatctcccaggcctgcaatgcagctagtattgggtcataaaaatgtatccgttgtgagccatgaaaaggatttatgtgcacaataccttatgatggtgaaaggtatgcctgagttctggacaaagtcctctgccatcttcttgtacttaagcacaccaaacagattcatgatactgaaaaatgcatagcatgagtgaaggttaaaattgtgacgcaatagaagttgaggaagcagacactagacttaatgaactaaaattcaagattaagatgggttttggaagcataagcatgcaaatcttatacagcaagtacattgtctcacagtaaaccattgctaaattaaactcataagtatattgaggatataaattcttcattaaactctagtaaaatttcaggatagctcatggaatgcatgcaactttagactttggagactagtatgactgacaggaagttcaactgtaagataccaaagtttttcgttgaaattctgcagtatacctccatggtagttcattgtattttgtaacgccgatggatgacaccagaaccagtctcttgattgtccgtggcatggcgctcaccagattacgggtgccatcccaatctagaaagggaaaatggtgtgtgttcagaaaaaaaaaaacacaacaagacataggcacatagctgatgttgctagctcattatgcgtgacaaagatagaccaggttatatcagttataacttataagaaatatcattaacatcaatgcacagggaatgaatttaactgtagtgtgcatgatcatgatcaacaaaaggtacatattaaactctgtcaatgggaatgccaagatctggaaatatcataagcagcttattagcactccgcgactgccacagttgaattcttagtttgtccataggggattgaaagactttacccaaggatcatccatcccccaagatcaaccatcactgttccatttacgtacgtagaacaaacaaatagatggtttcaacaagaactgaagaactttactcagtacgtaccaacacgttcaggagtgttatccccatcccagcgctttgaagggaatgctgtagttccagtagtgcagatgacatgcgtaactccctgtgaaaagagatccctatattttgctttattcaatcatgcataaatagaaagcccataacgctctaccatttcagcttcaaaacaataaaacacaagaaaatgaacctcaaatatttctggatccaattctgcagcatttctcgtgtcagccttgtaagccttccatgaagtaacaatttacatgagcaaaatttacacagaaggaaatagaatgttcaagctctctggatgtaagatcacctgaaatacgctctcatcttgctcgccgaatagggtcactgcctttgcaggatctcttagcaacaaccttgtcttgatgttcctgctcagtaaagatgccaccaccaactgccctgcaaggatcttgtggagattatgggtatcccatatctacacggcgatggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttccagtatataaggggggtccgggcgcctctaggggcatatgctgatttttcccgaatcatacaatcaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagatctgctcaatcaatatctagacaactgcagaacatatatttatcacttaaaatgcagagcaaatgtacgcttaactaaaagaattaccagcatgatgagcttgacataatcagataatggcatagtaaaatgctacgaaatattttgtgaaaaaaaaaatatactcacacagtagtgacactccaatggagagaaggtgacactgaagctatggagagaagggctagagatgtgggtctccttacctacgccgccggtcccgccgacgacgagaactagcttggacgaggcgtcggccgccgcctccgcgccggcctcacccgacccctccgtccgctgctgctgctcctgctgccgcacggcctgcggctcctccgccaccgccgcgagccgccatctgcagcgacccgccgcggcgcgcgcggaggatgtgggcaccaccaccgagcagcagcgccgcggggccgctctaccgccgtaggccaggcgcggggagagcgcgagagggttgaggcaggccatcgccatcgccatcgcgggctcccggtcctcgggtgttcgacgcggggggtgcgcgttgcgcggcgaggttggggggagatattggtggcgaggcgaggcgaggcgggccgagcgacgcgacgcgacacgacgcggcggcggacacttggcggcagccgggccaggcggcaggcggggggtgggggggcgtgtggtccgcgaactgcggcgcggctcagccacagcacgccgcccccggcgtcgccgccgatcctgcaatgacgccgcatccgacgtccggttctcttccacgtagtgttagctctcaccgtagatttgaataagcacgatcgggaacaattttctcgtgccaaactactactatatggtattaacgtaaaatgatatagtattaacgtattattgattgagttttaattattacaaactttaaaaatatattaatatgatattttaaagcaactttcatatagaaaattttcgtgcaaacgtaccatttagcggtttgaaaaacgtgtcacaaaaatttttatcttcatccaactcttgaagaaatgaacgggaccagaatatacgctctagctcgcagcccacttaccaccctctaagtggcatatggctcactaagtagaggacccgtgtgatcataatccgggatgacacaggagacaaccaattgagcgacgcagccacccccgcacctctgccccttgccaccaccggagcaacccgtcagcaagccacgtggttgcaaggaagatgatgccgaactcttttcctcctcgagaacgtcgcgttaatatgggctctgaagcaaccgggaagaaggaggtggcactgtccatatctagcccttttcacggatctggcgaggtgaaggttagcgcacggcatggtggagaagggtgggggtactaggcggcatggcagagggtggcgagaagtggactcggaggtggcagcgggagctgccaaatccagcggcctccagcatagctccctctagcttcccccgacgaggtagctctcggtgatgacaaatgacggtggtgagggagaagcacatggtgatggcctctagtgacggtgtgtgtggaggagcagctgttactaggtgtggcagtggttgctcctcttcccggaggttgctgctgggagtggctacagcactaccgacaccactcgcgtggcaacagcgggaggtcatgtgtggccaatgcaggtgacaacagggaggctgacgaatgctggaggttgactctaacgatgataggaagaccagcaacacgggaggttgacacgggcaacggcgaggatgcatgcatgactagcggcgagaggctagtgatggcatgtgtgtcatgttagcatgtggaggcatgcggaggatggtcgacgggaggtgtcggtggcgcttatgatgggtgactggtggtggtgcaatggagcggtagcagtagatcgacaggggacaggaggtgggtgaaagcctagcccagtcttgtcgggtcagcaacgacacggtttaggcgtcgtattcactcttgggggagttgtcgagatgtccatcttctttcctagtgaaaaccttatcttagatctccttgaaactatcgacggggggatacccgccgaccgtattctaagggtattgaggtatgttgatacgacatcaagctcacaggaaacaaagattatactggtttaggccccctcgtaaggtaatagccttaatccattttatatgggattatgaaaaaaaaccatagagtggctgcaggaa

SEQ ID NO: 58154 - DNA, 5264 bp, Oryza sativa
cactgagatgtgatgatctgtaccctcggggggcctacatttataccacagatcaccttaatatccaagtagaactcggagacaacagacctcacacagtatgaaaaaatccttatgttctccgaataggactctgaccccttcaatttgtagagattatttcctgagaagcccaccgacttccttaacccaaaagtaaccttttcgtatacttgaaggtataccgtatccgtatatctctcgactccaagtatagaaggtatgccttattcataaccctgacagagaccacgagggacaatagtgtcgctcttctctatggagacgtcatctaggaggcccccttttgccaaaactggtcctagacagtctatgcgaagccgctggatggcagccgatcggtgggtctatccgagggagagggatctttcttctctcttgccctctccttctatatccttttcgtccggacaacatctagaaggctaggggctcgtctattagggtttgattttgaacggtttggctgtagctccttttttgtctagcaacggctggtctggtgctaactcttttcttgattttatgtagatgttgtcgatgtgtggtggtggttgtcagggttacgggtaaggtatactctctacccttcgatatacgtcacatatcgatatggtatgcttgcgcgtatacggacgttttcggcataagttaaggaattccattatggagtccacagatgtaaggagtcctactcggatagaactgggtcgtcattgtatcgtgtcgggtccgatgtctacgagtcctacttggagaccagtcgacctgcggtataaaagggaccctccgggaggacctaaggcatcgaatcttaccaccaacacatccaccacagcctacgaagccggagcttacaggagccaagtcgccgggagatctagtcaaatcaactcgactacgatctcgtcggtatcatcgagttccactattctctttgtaatctgtggttttcaccatataatcccatatcaactggattagggctattacctatcaaggggcctgaaccagtataatctttgttttctgcctgctcgatgtcgtattacgtagatcctcgtaccagcgtaccccaataccctctatatccggtctacgggtatcccccgtcgacagtggtgcgccaggtagggggacttagtgctcaaggttctactactatgacatccagcttcgtcgacaatagcgtcaataccaacctcaaccaaagagttcctacttcaacaatactggtgtggactcaagtcggcgaaatcgtctttccggtttacaccacagtgccgatctcagctagtccgccaatgaccggaaacgagaacgcagtggctacaacccggggcgactccatgtcgaaggatcctcctgccgaagcggagatcggaacatcgacaacatccgagttcgagatcctagtgcggctaagccttgtcttttcgacaggaatcatgagccgacgaggattacttccgaggtgacaaggtcctggtgtcctatccacaaaaccagaaaacacaccttgcaagcctgctgggttttcctcaacgtccatgctgaaattcgtgcctgcaaagagcatggaattcagcgtacctctccaactcgtgatgtctattgtcctattcacaagacaaagaatcacaacctctcgagctgcaaggtctttctcagcgccatgaagacgccacctcctaaggtccagcagtcacgcgttcccttcagggatgaggacaaggaacaaggagcgacgccgatttcagatcgatttgttggagtaatcgacatcgatccccacgaaccatcagtcttgcacctgctcgaagactatggttcatcgacaacgagtatgccgcgtgaggtattggctatcgacgatgtcggcacgtcagcatgcaccaatgcggaagcggagaatcaagtgattacaccggcccagcacattagagccgtcaacgcaatactgagggaaactccctacgaccccgttctgaacgacgatctcgcacgatggacaaagcggttatgggaatcagtgaccaacctcagcaacgcgttcgaagaggccgccactgcagcgcacccgaaacagccaccaactggcgatgctaatggtgaaaaccctgaacagcgggaatcgcctcatcgagccacccctccacctcgcggcaccggtgatctccgcgatcacctgaatggccgccgagaggcgcgacgcacacgagtcgacgagaaccgttcctgacatcgcgtctcttcacggcgtcacgataacgaagaacgaggaggccgttcgagcgaagaccgagactgagataaccgccacaaccgccgcgatcacgacgatcgcgagcggcgggtgctgggcgattctggtcgaggacgttgccataatgacgacgatgatggagatcagcgccgagacaacaacgagagacgacgacagagttctcgagaacctggccgacgtcctcgtaatcgcacgccggaaccaagcgatccatcgtcattgtcgtcatcttcctcatcctcatcatcagatagacatccgcgaaggacgtacgatcgccgacaacccaccgcccccagcgctgggtgtagagctttcggtcgttcacttcaagatgtccgatggcctgaaaggttccaaccaggagcaatagagaaatacgatgggagcaccgacctagaagaattccttcaggtctactccacggtactctacgctgccggagcggacgacaacgcattggcgaattacttgccaactgcattgaaaggctctgcacgttcatggctgatgcatctcccccttactcgatttctttgtgggcagacctgtggcagcagttcgttgccaacttccaaggaacgtacaagcgccacgcgatcgaagacgacctacatgcgttgacacagaacccgggtgaatccttgagggattatgtttggcgctttaacgagtgcagaaatacaatccctgaaatcaccgacgcttctgtaattcgcgctttcaagtccggtgtcagagatcgctatactacttaggagttggcaacgaggcgcgtcatgactactcggagattattcgaaattgtcgatcgatgcgctcatgcggacgacgcactgagacgcaagaacgacaaaccgaagaccggaggagagaagaaaccagcaaaggacgcacccgagtcaagcaagaagaaaaatcgcaagagtgggaaaaggaaagctcaagcggaagttctcgcagcagaatacgcggaccctcccaagcgcccagacccacaaggcagcgacgcgaagaaaatatggtgccctatacacaagtcagatagacactctctagaagattgcctcgtcttcaataagtcgctcgtaaaacatatggtatttgaaaaaggcaagcgaatacgtgtggtcgagaaggacgctgaggcggttactcaggaatcagactcagcatatccagactccgatctccatgtctcgcacatcttcggaggttccacgacatactcctcagagcgagaatacaagaaggtgaaacgtgaagtttgttcgatgtggcagggggctgcgcccaagatgaagtgatccgaacagaagatagtattctcagaagaggaacaccccaatactgccatcatcctagggcaatatctgatcgtggtcgaacccactattcggaatatcaaggtcacgcgagttctgatcgacgacggcagctcaatcaaccttttcttcgccagcgctttggacgcgatggggatcccacgaagagagttgacacccaccaatcaacccttccatggaatcactcctcagtcatcgtctaaaccattgggcaaaattacgttgcctgtgactttcggccaagcaaataacttccgaacggaacagatcacctttgatgtcgctgaattcgatacagcataaaatgccatcattgggagaactgcactcgcgaagttcatggccgcatctcactacgcgtatcaagtgctcaagataccgggaccgaagggaacattcactatttaagggaatgctaagctggcagtgcaatgcgacaagcggagccttgacatgctcgagcacacacccagcccactcgccacagctgagccacccaagaaagtgagcaaaacaaacaagacgccgaaatggacggcgcaatcaagatcgttccactctccagtgccaaccccaacaagaccgtcaagatcggggcatcactaggcgagaaataggaactcgcgctcatcaccttcctccgcgacaatgctgacgtgttcgcttggcagccgtccgacatgcccggggtacccagggaggtgattgagcacaaactcatggtgcgacccgatgccaagccagtaaaacaaaaactgcagagatttgcaccagatcgaaaacaagccatacgagaagaactcgacaaacttctcaaagccggtttcatcagagaggtactctatctagagtggctaaccaacctagtcatggtgcggaaggccaacgggaaatggagaatgtgtgtcgatttcaccgacctcaacaaggcgtgtcccaaggatcacttccctcttcctcgaatagaccaactggtggactcaacagccggttgtgagttgttgagctttctcgacgcttactccggttactaccaaatcagcatggcgaaagaggacgaggagaagacaacattcatcacgccgttcggggtattctgctacgttaagatgccgttcggactaataaccgcaggaaacactttccagcgcacggtccaaggtgcacttagcgaccagctcggaaataatgtcgaagcctacatcgataacattgttgtcaagaccaagacaagtgactcattgattgacgatctgcgggaaacgttcgacaacctccaacgatatcgcctcatgctcaatccagagaagtgcacgttcggagtaccatcgggcaagctactcggcttcctcgtctctggcagaggaatagaagcaaatcccgagaagatcaaggcaatcgagaacatgaagtcgcctacaagactcaaggaagtacagaagctaatcggatgcatggcggcactaagcaggttcgtcgctaggatgggagagcgaggacaacctttcttcgctctgctaaaaagcaagacaaattcgtatggacacaggaagtcgaagaggggctgcagg

SEQ ID NO: 58155 - DNA, 5505 bp, Oryza sativa
ttttcaggtacagactacgatcaaagtgttccttcccaatgatcccttacccaaatgacacatagtgttgaaacctatcctcatgtccctttacgtcgtcttgacaaggcctccgaggaacctaagggaacttcggctggggacgcccagagccgataaggccttgtcggatcctgtagagacgaaagaccatgtaagatctagtcgtgtaagagttctcgccgtgcgtattaaccaagccgtgtaatcagaaataaattttccaacttcatggctgggggctaggatcagtgcttgttcaaccgaggcaggtcaaaggtccaagagccttatcttccgagaagaattctccgatgacaaggctgggggctagggagagtgtataactcaaacgactgatcgaagtcgcgaactgggaagacactcatacacgctacatccagagtaagaaagcttagttagatagatttcttttctatttcacaagtacttcttacaattccataaaaatccaaaattatattacacttttcccctaagacatttgtcacaggacacgaagactaccaggaaggccaacgccagtccatagattggaagaccttttccgccagtggcgccatcgacttcgccaggccatctatctccgtaggagttctccaaaaacgagaaaacccttcgtggaggaactcgaggtgcagctacggacgatgatctcgtatacaagccaatacatgccccccggcatatcggctcgaccgacgacactcctgcttcagggcctcgtcgatacgctggctgatgccctcgagctgggcgcaggccccattcagccacgagatgtatccagccgccgattcctcgggatccccacggggtactcggagctctttacagactcttaacatggaggtacaacaactcttcagatacgagttgaaccacacctcgcgaccacagagcgtctccacggcctgatccttcctcatttccaacatagtcctctcgagttccgcgacctcaaacttcgtcctccaatactggatgcgacgatcctggtcagcaagcgcactctcgaggtctgctcagtacggaaacgactaagttagactgctcttctctcccgagaatacagcaaatcaagtcgatccagacggaagaataaaggagatgaaaacaaagataaccaacctaagggagtcgttgccatgctcattcccacaggcgaattttgagctacatcgccctccggcatgtgtggctcagacgcaagtaacggaacgaccactggcagctcaggctgcccgcgctgctggacatcctcgacatcaacatctctacaaacgacaacaaagtactcaagatcaaaatgctaaagaaagctaaggcgctgactgcacacacacaggtggttggaaccaacgaaagttttacaaagcatgactaaagagtacaagagagtcaaaatcctactcttcaacaagtgggagaatagactcccccagatcgccgacttcttccatcacatccttgcacgcgtcgctagccgccccctgatccaagatcttccgcagatcgagttttgggtgcgccagtctcacacatgcaaggacgtggcacgccccggtatagatcccgttggacgtctcctctccgatcctggccgcatgcttggaggggatctcctccattgccgccgccagctccgcaagagaagacgtcagcgagaactcatcgggattcgccgggatggtaaacttgataccgcactccccggcgagctggtgcagtccagtataggtgacccgcaacgagccacggatttccgacaagttgttctcgagctccgacatacggtgctcgagtccctgccgttgtcgctcattgccggccaccagttcccccatcttctggaggtcctcgcgaacctccgccaaatcgtgcgccagccggtcggcgcgctcattcgccgacaacgccgccgccgtcctcgcctccgcaatctcgcggccaatgtcgcgagcactagcctcgaggaggcgccccatctcaacctggagctcctcccaggtgagaatggcagccggcagaccccgaccagccgcaagatcgctagttgggccgctaggtgtcgcctcgcggctcctgggcgcgaccacgaaatccgtcgaggtccctctagacccgtcttgcgccgccttcgcccatgccgccctgcgaaaatccgcaactgaaacaggctgcaacagtttgacgaagagacaagacctcaaagtcatccacttacttctcgccaagcgtcactagcctctgccgtcgtggaggtgggggagacgcgtccgaggcctggagtacaaccgatatgatgtgaggtggaagttttccgactacgcgatcaaagggcaggagaacttaccgagggggtgggcgtcttccgacggtgtccgaccacagaggagaatttcctcccctttttcggagcgttgccgccactcgttgtggcagcggcggcagcagtgtcagacgcctccttggcgactttctccttcagcgacaccgccacctgatggtccacgagcagcccgatgatatcagtcaaagggagagcctacgcttcatgaagtcataatgtgatcttggaagaaaaatgcgaaaagaccgctgagtacacttacattgatggcagcgtcgcgctcggctgcctctttctcgcaaagggggacggggacgttgctcgccgttgtcgggccactgatcatcagttggctgacgcggcgctccacggtggcgctgtccaagcctgtagatcgagaccagaatccgataagttgggaaggacacacgcataagggagtcaatttaactaaaaaggaaaataccccgaggagaaacccgggttgcgttctctggcccagaataatcaaaggctggatgggctcgagcctaaagcggctggatccgcctaccgatgaagtcggcagcgacttcaaaccccgacaacccctgttctcggaggtcgtcaacgatatcgatgaaagattggagggatggggtctaggtgggtttggtggcccaagatggaatcttgtctggttgctcctcaggaacaacgaagactggatccgaatcctctatctgaagatagaaccacctcccccgccatttgctgcgtgatgaggggcactggaaggggatgtatcgcgacttcaggccatcccgaagtcggaaaccaacacacccggacacctttttaggttccatccagcgtaactcatagtaaaagtggaagaggtcaagaaacgactctaccaaaatgtaggccttacaaagatgcgtaaaaatactcgggaaggcgatggagttggggttcaaatggagcaaggaaagaccatagaaattcaagaccaaaaggagaaattcagaaggcggaggaaaaaaaccgcagagaataaagtcctcgatcgcaaccatgcgacccaggacaggctggggttcagtacctcctacttccctctccgcggtcccgcgaccgggaagggcgccatcctcctgcagtttcttcagtgatgcgttggtggaggtagacttgtcgagatccattgccaccggagattgccggaaaaaggaccgagatgagctagctagggtttttgcgggagcgaagaggacgaggaacgcttggaaactggagagttttttttcaacaggcggacttcaaattggatacttccgacggtgcgaattccaaggaaaggagagagatggctgccggaaatttatgggtccgttacgcgcagcagtttttcagacttcaatttaaattcactcatgaccgttgagcttcacccgacgttgtcgatcactcctcgtctctcggtcctcacatcgagaacgacgacaacttcgacatcagaagtcgcgatcggtctcacgagttcatttaagcagaagtcgggggctactgtcagggttacgggtaaggtataccctctacccttcgatatacgtcacatatagatatggtatgcttgcgcgtatacggacgttttcggcataagttaaggaattccattatggagtccacagatgtaaggagtcctactcggatagaactgggtcgtcattgtatcgtgtcgggtccaatgtctccgagtcctacttggagaccagttgacctgcggtataaaagggaccccccggaaggacctaaggcatcgaatcttaccgccaacacatccaccacagcctacgaagccggagcttacaggagccaagtcgccgggagatctagtcgaatcaactcgactatgatctcgtcggtatcatcgagttccactattctctttgtaatctgtggttttcaccatataatcccatatcaactggattagggttattacctatcaaggggcctgaaccagtataatctttgttttctgcctgctcgatgtcgtattacgtagatcctcgtaccagcgtaccccaataccctctatatccgatctacggttatcccccgtcgacaatgatgatttgtttttctgttttttttttctggctactatctttcagggttcatgcaaacatcatattgtctttgtgctgttcgtttcaaaatataacacgagaggcaacacgcattagagcatgtataacaggaggctcttagttttgttttgttatacgagatcacgatgaaaatttatcctggctcatatgctttcaactcaggtcccgtcccatacatactccatggtgcactggagcttggtctacacttgcatagtacaagcatgtggatttaaccgtgacgaatggataggtggaatccactcgtagcaccctatcatcaaacgcgtatagcatgaagcaatttaacaagttttagaatctaaatcttatttaaataatatgaagacctagatgatataatcacataagtttagagaccgactgtgcactttacttaatactttttagtgtcatatattccaataagtataagacatgaggtatattgttagcaaaagtatgcattaacggatttagcaaaccgtgggtgattttgggaaaatgaatttaatgtgacgcatgcatgtgtatgtactgatgtattaactatttataatgatgtaaataacaacaaaaatgtttatatacaattataattcagattaagatgtcaaactatatgttgatgggttcattaacctgctgtggatattaatcggtccaaactagacacattctacatatatatcaaataaccagttaactagttgtaacacatttagtgatacaacgaagtaactttcgttcatcgttaagaatattgatttcacatcattctcttgctatgtagatttgtgccaaacaacaaacaacttgcttctagtctgtaaaggtaatgaaaaaaattagctagcatcatataagtaaagaaataataatattttaaatgaagtttgaactcactatactgacctttggtagggctgcaggaat

SEQ ID NO: 58156 - DNA, 1281 bp, Oryza sativa
tcaaacccctttgacacacctacgatgatgttgtcagtcagggtcctgcattgaatatttgcagcagagtccttagaggaataggcatagagaaaggcacatcaagatcataaattcataatttcttatcggcatatcacacctttcatcactcgatcccataaaaaatgtactgagtacgccttaaccaagctgggtattctcccaattcagattatatgttgctaaacattcttatctactggaatttcttttcaaccctcaaggtttattcaattatgtttgatgcataccggttaagtgtatagcttacttttctaagatccagaacaaagcaagatcatcaccaatattgattacacgaacacgaggtcagagaacagcaaacattaaaggaaaaagctgcatattgcaatgtagagttcacatccttgaaggagctactgggagtatagggccgcggttatctatcccgatgtcaaaacatgttgagatgcaaacatgcaacttatttaaggcactggtaatatgacaatcaaaatacacatggcccatgtgaattctatgctcatggtgctctccactgcaagaagcaatggctcatatatgatgctttgtgacaaacgctgacagatcttaagtagctgacttctgaaataccaggaaaaatatatagaacacaaacaaaaagatacaccaggaaaatatatggaacacaaacagtaagatacaccaggaaaatgtatggaacacaaacaataaaatagtacagtacattatgaacagtgaaccagaggaaaatgaaagcaaaattgtcttacctgaaaaggccatgcatctggtttgcccttttggtctccacagtcttggaaactctcagcttaccagattcttctttcaccacttttacttcacctggatagtttagtgataattctcctaatggacccttagccttaataaactgctcctctaacgtgagggtcacatttgatggcacttcgatcggcttctttcctattctagattctttgcactccactgttgttctgacaaaaccaactctgccagcagggataacacgaagacgaatcccttgtgtctttccagcaaagccagtccttgaattgctgatttaattccgacaaataaacactcaatcaaaactttcatattaaattgcaaataaataattgccctttacaacaaaaaccaatgcattattttagtttgacagattagtaaaacattataattcaaatccatgaagtagttactagc

SEQ ID NO: 58157 - DNA, 1366 bp, Oryza sativa
caaaaatacatagctcacccaactctccctccccttcctctcgccggagtcgccgcggccctagccatcgaccggcggcggcggcggcggcggtagccgtgggatggacgaattcggcggcggatccgtcgggccgttctccaagaagccgaggcacctgtcccggtcgctgacgtaccaccaccaccaccacccctaccagggccaggggcgctcgccgtcgttcaacgcgcggcgccagcatcatccgcagcagcaggaccacgcggtggtgctgtacacgacgtcgctccgcggggtgcgccgcacgttcgcggactgcgccgcggtgcgcgccgtgctgcgcgggctccgggtggcggtggacgagcgggacgtgtccatggacgcctcgctgcggcgggagctccagtcgctgctcgcggcgcggggccgccccttctccctcccgcagctcctcgtcggggcccgcctcgtggggggagccgacgaggtgcggcagctgcacgaggccggcgagctgcgccgcctcctcgagggcgccgccgggcaggacccggccttcgtctgcggcggctgcgggggcgtccggttcgtgccatgccccgcctgcgacggatcccgcaaggtgtttgtccaggaggaaggatgcgcccgccgctgcggcgactgcaacgagaacggattggtacgctgccccaattgctgctcttgatcgcttagctttgtgcaacaataaatcttccatgttaatataaggattatagcttataggtaatagtagtagatagaggcaagaagggatgaacacttcttgatttcttggcctatggattgtatgtgattatgaccaatttgggtgcttagtgttcggcgtttggggattatagtgtatggatttgagcctatatgggtttgtatgtatcaaatgtaacaaatattctgcagtgcgtagtcctgctggtttgatcaatgtaaatagttgggtttggtatattcagaatacagttcatgtctcctactagtttgtcttttaacttcaaggatgatagatagatagctgcttcaaagcaatataatgcgagctgatttaacacatttttagctcctagttaatattaaaacattttttttggcaagaagtgatatgcgattcaatagcttcattctaagtaagccgttgtataatcatatggtagtgttatccccttttccccttcttctaagatggtagcattgttgtttgcaaatgcgcagttcacggaacattgtatcttcagcaataccagttcagttcctccagttgtttgatggaaacttcatgtagtggcattcagccagttttgacaatgctaatcctttgacc

SEQ ID NO: 58158 - DNA, 5896 bp, Oryza sativa
tccttattaaagaaaaactgtggtttgattatccaatgcagatattcgtgttaaggaaccaacgcttgagtctttatgcaggtaaattgcatgatttcctgtctagtgtcagtagtgtgcagtgcagaactacaatttcttcttagaattagctatgtgctagagatgcttcattgctatgttctttcttcaaagaattgatcaatattctgtgcggcacaagcagattcatctgttgaatttttatgttgccatttaggatatatctatcttttgccattatattttatttttatttctttcaggggaaagaaagtgtatgaaccaccaaggttcatgtctgtaaacaccgcaataagtcagcttttggaggtggaggaactgcgtgggggatctggtattctcatggaatctctgaattaatttcccaagttaaaatgctcttgaaaaacagctgttagtctgcctatctaagtttaatgtaccaatctaaaaagggatttcattatgccctgcagggtaactatagctagatttttggacgttgcttacatgttctacttttcataggccagtaggttttacttctagattagcacttaaaaatcacttgtttccagcatatggcgcagattcactatgcataggtgttgctcgccttggaagtgatgatcagaagatcgtcgctggacctatgaagaaactactagatgtcgatttcggcccaccccttcactgccttatcatagtgggagagacgcatcctgtggaagaagagatgatagaattccacatgatcaagtcatgatgaatgaaagtgcttttatgtgagtttcactcctttcttgcaatgaaaaaaaaaaagcaatacttgtatgctttcattcgttacaaagcaatttctacaccttatatcctgtggctaatgttgagtcaatactcatttgcctccacaattttgaatcagggccttgtagctggatacatgatcccaggcttatagctcccttgaaacgatacttcgatgcttccgcccgccgtgaaaggtccaccagtagtagtttactgctccaattgttgctcatttttaagttaaactgggatcagctgttgttctttttttggcctgataccgaatactctcaaaccagtattgaaccttgtttacattgtgtgagctcatatttgaatgtgttcgtgcataaatcaccttgagatcaatgttactcatcaagaaacggttaccggaacattagctacaattgtggagtataaactcgtatgaatgaattgtggtaacccgtagtacgatttcgtgtcgtccgatcttctgtgccgtgtttcagatccatcttttgttgtctcacagctcagtctgagtctgggaagccttccagagttccagttgaagaggatgaacagtcacagaaaaaaaaagcaggatttttttttttttgctttatcgttcgttgcaaattacatgcttgatgatgctaattctcttcaccggataggggtgtactgctccatctgcagctggtgcagcgcggcctcggagccgaagctgtggcgtcccggcgacctccgggaccgggacctcgtcggcgtcatgggccccttcacccgcggcgaccgctgcgccgccgccggccggctggacctcgcgaagacgatgtcgctggcgatggacgggatcggcgacatggaggggatcggcgacaggaggcggtcggcgaacgggaagcactgctccgagtaggcgtccgccgcgccggcgccggagcgctccttgggcgtgctcatggaccggaacttggccttggccgacgccgtcgacgccatgtaccccgggaacgccgccgcgccgccgccgtcgtcgtccctcgccggcgtgcgcctcccggcgcgggtgaatgaccgcctcgccgagtacccgagctgcctgtcggcgtcgtcgtcgtcgccgccgacgcaggcgagcctgtcggccctggacctggaccggagcaccggcggcggcggcgggcgttcgtcgtcgttcatggcggcgccggcggcgtccctgcttggagattggtgcgcgacggggatgtccttatcgaacggcggctgcgacccgacccattcctccagccagctccaccgctggttcagcgtctccatctcctcccggctcatcggctgcctcctgaccccgaccttctcctgcgccaaaaattaacagctctcgatcagtcaccgacgagtgggcccagacagccggatcgcgggggccccgcgctgtcagtggctgggggacgtgacgtcatgggggaggtgaggtgacgtacgctctggtggagcgaggcgtactggagcgcgcggacgcgcttgagggcggcctcctccctgctccggctcatggcgctcatctcctccttcgacagtgtgctgctgtcccaccccttgctcagctgctgttcctgcacaacaacaacaaccaccaatcgcccttcagattcttcagtaaaatgaaatccattcactggctcgcccaccgaaatatgccaagctctctctctctctctctctctctctcttttccctcttctttttactgttactatgagcattggcacttgcaggcatggatcgatggacagacaagtataggaaaagaagagccagattacagcagaaacagcagctgatggtgcaaagcaaaatgttgtgagtagtactactactacagtgctacactggacagtgctacattgggcgcaagaacagaagcaacgaaagaatcggggcatatgcatgtgcatgtgtcctggcgatggccgcgcacgacaccgacgtgacgcggccgggtcgccgtctgccgtgccgccaccccgcaccacatgccgcgcatgtgcccagcaaatcattcgcacgttcctactacctagctatagcagctagctggtgagagtgttcttttactactagtgttacttacgtggacggcggcggcggcggcgtagtacagctcccggcctcgccggagcagcgcgtccatgccgtcgggcgccggcgaattagcggcgttgtggtcgccgccggcggcggcggcggatgaggccctggcgcgctgccgcgcctggatcttcatgagcgactcgaggccgcgcagcgtcgccgccgtctgccgccgcaccgcctgcccccggatcagcgcctgcagccgcaccaaccccttcaacgctcgcaacgccctcctcgcctgtaaaaaaacaaaaagaaaaaaaaaaggattaaagcaacagaaaatgtattgatacgaagacatttttggtgagcgacatcaaattcactgaaaattggacgaattatcaaatcgctacgaaatccattgaaaatgggggctataaattttgaaggtttgaagcaaaaaattttagttgtttgttttacttacgaggtatccacggtagacggattggatcataagggcggcgtgttcgtggccgtacggcgtcggcgtcgtcgtcgtcgccggcgccggagccaatgcggccgtcttcccggtgaggcggaccacctcggcggcggcgtgcgcggcggcgacggcggcctctgcggccgccgcggtggcgagcgcgaccgccatcgcgtgcttgctctgctcgtcctccgcctgcctgatctgctcctcctccaccgccggcgccggcgccggcagcgcgaacgagtgctgcgtcttgagcttgcccgcgaacatccacctcttgctcttcaccttctgatcaataaatcaatcaacaacaccacctcctcgtcagctcaactcatcaatcaatcaaacgaattctcgcaaaaatttcggcaaaatttgtggcaagaatgaatcggtgcaaaccttgtccggcttgggcttctgcttcggctcggagacgaagagcctcttgatgcgctcgagccatcccctcctcttcctctccatgtcgcagctaagcttcgtgcaagcttagctactaactagccttactacacctcgtcagtgtctgaaccgagcaaaatctgaagcaagaaacgcatcgtcattaccagaaatgcagatgaaataatagaaatgaaaaacaagaattgggagtagtagctggcatgtctcaatcgtaagatccaaggaaatgttgactaaagcttcggcaggacgagggcactttgctgccagcacaagctactgttcgtcagtggtgacggtcacagtgtccgagcaaaacgaagaaatcaagaagcggaaaaaataaaattcagagcaggactgctgctgcattggattcggttgatgatttgccgttgcatttgtcagtaatctgaagttttaacagtttttaatcacgcagtgggagccatttagaggctaaagccaagtgagtgattagctgggtgctttcttgtgtcacctgctaaaattccaaatagtagtacaaatcaagcgaaaaacaccaaccggaatgcctagttttgatgcgacaaaccgcagctataagctgtaatgttcagagtgtgacgggtttctatctgaatcatctcatggcaactgaacaaagaaccaaccataacactactagacagctacatgcgtcgcatctgaatttactctgaaatgactgcaccaacgaaagaaggaagaagactgaagaggaaagtgaaaacaatatcgaatgaatcaaccacgagacccaaaagatgaactgaaaatcaagtgatccaagatgagagtaccttgcagagtaatggtagggatgctagctctgagtgatccaagaactctctcactttcagcagctgcttgtggaggaggtggtgatgacacagacaggaggctcatgtaaggcagatcatgctctgcctgccatatgagggaggaagaaccaatttccagtggaaagccagcaggtcatgcctcaccatctcagagagaaccccacatgatgacatgaatcaagagcgctctctctctctctctcaatttatacggagtacaagatgtacatttgcaaagagaccttcagatttggcaaggtgtgaaacgccctgcttcctctgccatgtctgattacctcaagacccctctcaacttaagtactcctacttaacatgtgagcttgccgctaaactgagttgttgacagtgagaaaagataatactccctctgtcccataatatatgtgatgttgaaggaaatagtactagaaaatgtcacatccctctaaaatcttttagattatgagacaggggagtactatcaaagtacatgtgtgatgtgtgtattccttttacattgtatacacaaagaaaccaaaaattaggtgatattttacagaaaccaagggctaaaagatgcactttttttttcagcccgttgatgcagcctgcagcgtgtggtacattggtactagaaaacaacaaacggaacgggatggtggccacttgagaagtaaacaaaaaacgaaattaaaagggggatcaggcaaggcaggctggtccgcagcagccgcagcaacgcatgaatgaaagtcgtttttgtgggcgcactgcactgccgccacagctgagcgctgtctgaatgaagaattgaagatccgatcaaagacccccaaaagccgaaaaacaacacttgcttaaggacacccatcagcagtggacctcccaaccacatgtctctctgcttaagcttaacactagtgcctgtgactgagagagagagagagagagagatttggaggaagtgacatctctccagtccaaacatcttttaaaaagaaattacgagcgtgttagaaattaaacataaaatcttaaagttgaaaccacacactctttgtcattgcactaccaagtgcatcttgtgactgtgatcaaacacaca

SEQ ID NO: 58159 - DNA, 1868 bp, Oryza sativa
tgagataaatgattaaattttatcatagcatttgaaattcctaggaaatgaacaactctataaagattttggagaaaacctagcaagagctccaccttttggaaaattcctttgaacatatctttctcatttgattattgtgttttctctacggtccaatcaaatggttattcttgtgtttgttctgcattttacaattctatgttttacgattgaattcctatcaggatcctgtgtttttttattcattcatttttttcattataaaattcaaaggggccctaaaaccagagaagggagagagatgagaaaaaaatggagaatgtgatcggtaaaatagaggaatgagaaagggggtgataagaacggggagtggtaatagaaaaaatagaaaatgggagggatgatagggagtgggaacgacgtgagaaacacgcgccacacatttattaccgccatcgccattttcatcttagagcaagtttaataatggagctatctacaagtttttaactcatattagagttaacatatataagagatgagctataaagttatctctatttctcttatcctctctctacctctcacgtatgcatttaatgttttatttttaaaaaaatatgtgaatagcaagctattgcatgagagattgagagccaaccctatttattttttttaaattctctctcctccatataaagccatgttctttccttcaactccaaacttcaattttctcatttttcgttagcacgtttttcaaactgttacatgatgtattttttcaaaaaaaaattctatatataagttgttttcaaaaattttataaattcatttttcaaattcataatagttactactacacctataatttttaatcatgtgctactaaatatttttctacttttgcgtacgcgaaaattctcccccctcagccttgccagttgcaacgaacgctagcagcagtcgatcagatctccaccgtccgtcgtcgtcgtcctcgccccctccctgatctctcaaatctcttcctcctcaacccctcctcctcctcgccgaccaagtgcgaccccatcgcgcgcgcgcccacgcccacgcctcccgcctcccgccccgccacccaccgccgccgccgcgcgcgcgcgcggagatcgccgagcaaccaccgcaagccggagggcgcgcggccggcgggcgaggcaggctaggctcgccggggcgagatgagcgggcacgactccaagtacttctccaccaccaagaagggggagatccccgagctcaaggaggagctcaactcccagtacaaggtcaaccaacgcaccccctcccccgtctctccggtctccgtagcttgctttccccgtgcctgtggggggtcggttcgttccggatccagatctgggctgggcgcggcgatcgctcgtagatctgcgggttttctgttggttttgtcgcggggttcggagggctcagatttcggtggcgtggcctggccgaagaatgaattgtggtttgcaagttatgccgctggattgggctgcctgtcgttgcttgcagcggcagatgaaaccgtgaatggactgaattcctgatccatttcgtagcttctactggaaggagttgatctgaatggctttgattgtttaatgcgtagtcagatgaacaagctggaccttcataagacagaaggattgccccaatgcgcatatgtttacctcatacgtcactagggaatataattacatgcttttagttgccaatacttatattaacactgaaaacaagaatgttgtggaacttacacatcttgctgtcgaaacatttgcatgggctttatccttcattcatattctgtgtgtgaa

SEQ ID NO: 58160 - DNA, 16100 bp, Oryza sativa
  unsure (1)..(16100): unsure at all n locations
catttacagtgataccaaaaaaatattgtacttgcatacaggaacaaaattatggttctaaagttttcacaccaagttcttgtttattttgacattcagcaagtaagttgccttttgcaatttccgatatctgatttattgttggaaatatgttctgcaggataagagaaaagatgctgtcaagaaagttatcgctgctatgactgttggaaaagatgtttcatctttgtttaccgacgttgtgaactgcatgcagactgagaacttggagctgaagaaactagtatatttatatctgattaactatgccaaaagtcaacctgaccttgccatacttgctgtaaacacatttgttaaggtaataaactatagccatacttgcaacaaactgttatgcggaaaaaaaatgctgatatggtacgttaaaacatgaccttttcatagaaactaataagatgattcatgaaatgaaacttttgcaggattcacaagatccaaatccactgattcgtgctttagctgtgaggacaatgggttgcatccgtgtggacaaaatcacagagtatctctgtgatcctcttcaaagatgcctcaaggttttttttctttttgttgtttctagaacttttcagtcaagttgacctcttctatctaagtctatatttggctcttgaattgcacacaggatgatgatccgtatgtacggaagactgcagctatttgtgttgctaagctttatgatataaatgctgagctagttgaggacagaggattcctagaggcccttaaagacttaatatctgacaataatcctatggtagttgccaatgctgttgctgcgcttgcagagattcaggacagcagtactcgtccaatctttgaaatcaccagtcatacgctgtcaaagcttctgactgctctgaatgaatgcacagagtacgatgcaacttttgatgtattgagttttgaacctatctggatattaaaaattcagtccacttaacatatttggtgtatttgcagatggggccaggtttttatttggattctctgtcaaggtacaaagcagcagatgccagggaagcagaaaatatagtggaacgggttacaccccgtctgcaacatgcaaattgtgctgttgttctctctgctgtaaaggtaaattattacctgattcgcttgcattagaaaagacagttgttttagacaggtttttgtgcagtctgtacagtttctatgtggtaaccatatatcgtaatatcatcatagtattgagtatttgaatacgtacctgtaaggcttttttagattattattggtattgtgaagtcctcagtacataggtagcagaatggatttatttttttttctgaggagcaaacaaattaaggaattaatgcatggcgaaatcatcagcagcatttactgtttgttttttatttaaatgtgttcttttccattcacgtgatgctttacctattgtagtgttgtctatctccttttacaccagatggaaacttttgttgatgctatactttttcctgtgtgtagataatccttttacaaatggagctcattactagcacagatgttgtccgtaatctctgtaagaaaatggcaccccctcttgttacgcttttgtcagcagaacctgagattcagtatgtagcgttaaggaacattaatctgattgttcagaaaaggcctactatacttgcacatgaaattaaggtgatatattttcttcctcatctgagccactcatttccagtaacgcaaatgtgttactgacccaacaggctgttcttgcaacaggtcttcttttgcaagtataatgacccaatatatgttaagatggaaaagctggagattatgataaagcttgcctctgacagaaacatagatcaggtaaaaaatctgctgttttatattattattgtgtccagcgcatgttagttgcagtgaaagatttccttaactaaatgtttttctgcttttgtatggtctcatgtctaccagaagtgcttttgtattgttggaagaaaggctaaacaattattatatcagtttcaaaaattggattaacttgccaaccatgttgaatgtcttactccttgtggagcagatggtttcttttctgtaaattttgttcaagaagctaacagagctccttctataggttctattggaattcaaagagtatgccacagaggtggatgttgactttgtccgcaaagctgttcgtgctattggaagatgtgcaattaagttggagagagctgctgaaaggtgtatcagtgttttgcttcagctgattaagataaaggttaattatgttgtgcaggaggctataattgttattaaggacatcttcaggcgctaccctaatacgtgagtactgtggcatgacagatcaatgttctatattatgtaacaaaggaactcttcaatttttttattgtttttgctcaagaattgcatctataaaactaactgttttcttgccaaaatgcaggtatgagtcgatcatcgcaacactctgtgaaagcctagacaccttagatgaaccagaggctaaggtattattctatgaaaactgtctaggtaatctattgcatttttgtgcaattacatgtttatttttctccaggcatcaatgatttggattattggagaatatgctgaaaggattgacaatgctgacgaacttcttgagagcttcttggaaacattcccagaagaaccagcattagttcaattgcagttactaacggcaactgttaagttgttccttaaaaagccaactgaggggcctcaacagatgatacaggttgcaattctcatctggttatttgtatgtttgtgcacgtggtaatgcttagaggttgccgagcgcggaatgatttttgtcttggtgtggatttgcctaaaaaatagtggttagactcacggttgtgtgttgatgaaaaggaataatttagacacatgttttgaactgattgatcaatttatgcaatgaacagtttcttcttccaataagcatgattagcctgccattagttctttatttgtttattgtaacaaagaatctgttcactgtctaatttgcaataactttatcatgtaggctgttctcaataatgcaacagttgaaacagacaatcctgatttgcgcgaccgagcttatatatactggcgacttctttctactgatcctgaggtatcatatcataacccctcacccttacccttattcaatgcttggttaaatagcactcttaccatttatatatgtttggcgtcctgcaggcagctaaagatgtagttttggcagagaaacctgtgatcagcgatgattccaaccagcttgattcttctctcctagatgatctgctagccaatatttctaccctttcatcagtttatcacaagcctccagaagcatttgttagccgcgttaaaacagctcctagggctgatgatgaggagtttgctgatacagctgaaacaggatattcggagtcaccatctcagggtgttgatggggcatcaccttcctctagtgctggcacttcttctaatgttccagtgaagcagccagcagcaccagctgctcctgctccaatgccagacctccttggtgatttgatgggtatggataactccattgttcctgttgatgaaccaacagcaccttcagggttagtatatttttgtggtttttgctaaggtgtctcgtggcatattcatttaatcattttgtatgactaggacaggtttttgatcatatcatcttttcttgttcttcccttttgcagccctccactacctgttttgttgccatcaaccactggccaaggactgcagatcagcgcacaactagtgcggcgtgatggccaaatattctatgatatatcttttgataatggcactcaaactgtgctagatggattcatgattcagtttaacaaaaatacctttggccttgcagccggtggtgcacttcaggtaccagctatatattataagtataaaacattctttttgaaattcaattacatgtactgaacgtggtgttattctatgaataaggtctctccactgcaacctgggacctcggccaggacgctgctacctatggtggcattccagaatctctctcctggagcgccaagctcactgctgcaggttgcggtgaagaataatcagcaacctgtgtggtacttcaatgacaaaatccctatgcatgccttctttggtgaagatggcaaaatggaacgaacaagttttcttgaggtaaaaacgctaacatgtattatattgcattattcacaacagtagtcaatttaattaactcaatgaatttctgtttcttggattgccccggattgtttagagtttctgaacaaatctcatgattctcttgcaggcctggaaatctttacctgatgacaacgaattttcgaaagagttcccctcttctgtcgtcagcagcatagatgcgaccgttgagcaccttgcagcatcaaatgtgttctttatcgccaagaggaaaaactcaaacaaggatgttctgtacatgtctgcaaagattccgcgtggaatccccttcctgatagagcttactgctgcagtcggtgttcctggcgtgaagtgtgcggtcaaaactccaaacaaggagatggtggctctcttcttcgaagccatggagtctcttctcaagtgatacaaaattgaaggatcattgttccttccaaattgatcagttcatgagctattgtaggtttggatgcggcgttgtttcacaggagctggtgtgaattgtatttgttgttctttgtattagattactgtatttaaactgctagtttcctggtttcaaagttttttcacgacgaacactcgacatggccattttgtctgcgtaatttgtatatctcggacctgaacctcttttcatgccatagcatatgaaatataagtagcttgcaaactcgtaattgatgaggtacagatatcatttttatcaactacattgttgtttcacttgtctactttagcaatgatttccttttatctgcttcctaaaagcagcagtgtggtgactgtgtgctctacatccaacctctcatgttcaataaattatcgatgtgctatgtctaatcgatttccatttttttaaagaaagaaaagtttgatcaaagttttgcatgtgtaaatgaattgggtcaattgattgagtatggcttacatttacacatcgaatctttagcactaaataaccttcccttgcttcattatacaaaatatttgaatttgtggtcttgaaaatgcattgcaagcatggtcaatattcgtaatgaacaatgtttggaagcgcttgacatagatttgaattattgaacctgaacaaggcttgcgtatttgcttacaaccaactgaaattcctacaaccaactcaaatatagtagatctgacgaaatcagagctctcgcaatacaatagtagattgactcagcctgacccccaaaaaattgggacagtaacattcaaaaccaaaactagttggcgtcgcatcgctcgcgcctcatcccgggcggtggatcgatcgatcgatcggcgtcagaatcccgtgtgcatccggcgaaccacgccgccgtctcgcgtcgtgttctggcagttctgctgctgctgcggcggctgctggcgcacggactgcagcgctggtcgagcatcgcggcgagcgattccggcgacacaggcgtgccgccgtcgagcgcccgctggtaggcctcgtcgcgctccacgttcttgcccttcagcgccatgcgcaccaggcggcggatgtcccgcggcgtcagctcgagctggtcgtcgagctccggcccgtcggagcgcgtcgcgaaccccgacagcagcagcgtgccgtcgctcggcccgccctcccgcagcatggcgccgccgtacgggcgcgccgcgaactgcgccccctcgtcgtcatcgtcgtcgctgaggaaggcgtcggcgtcgtcgccgtcgccccagtcgccccttctgccgcacacgtcgctgaaatccatgtcgctgccgctctcgtcgtcctcgccgtcaccctcctcccgcggcgcgtcgtgcgcgatgagcacgacgtgcatgcggatctcgagctcggcgacctcctcctccgcgcggccctcgcaccgcgccaggacgcgcgccgccgccctggggacctccgtctcgacctccgggcgcagcgtcgggtgctcgaggccggccaccagctccccgaacgcccgctccgccgccgccgcccgcacagcgccaacatcgtcgccgtcgccgccacgcgccatcgtcaggtcgcggagcggcacgcggcaggaaacgtcctccatcgtgtccacgtcgccgccgccgtcgtcgtcgtcgtcgtcaccgtacgacgagcggtaggccatcaggacaagcagccggagcgtgacggccggcgcggcggatgacggcggcgaggccacgatctcggagaagaagaccagcttgtgtgggccaagcgcttgagaatcgtagacgtttgccatgatggctccagagcttttgatgtgaattagagaggtgatgatgacgatgacgacgactcgcgaacctaatataggcggaggcgggtgggggaaggtttgaggcaggggtaatcgcatcggagtcggattaggatttcgaattaaccccgtcccgtacgcaatccttttgcgtattaaaaaaaaaaaaactccgtcccgagtccgacttggagaccgacatccacggctctgtcatcttatgttaatctcatctgatgcagtttttacggaagctttgcccagcagtgggcgacgattttgctccaacacgacaatacctatacctagatagattcatatttcgtgtagaggtcaggtttaatataatccattatctaaaaaaaagataaattcatatttcgtccaaagatataccccctccattctataatataaaggattttagattcgtattaagatatactctctctgtcccataatataagagattttggatggatgttacataactagtataataaatctagtcacatccatccaaaatatattatcagaattatattgcttgaccatacatgactagttgagtattgctagtcggaattgttaagagtggttaacgtaaagaccttgtgagattattatcttgattagaacgtaaatgcatctagcctgttgcaattccaaggattgattccacaagtgtgggaatgtataacctacgtcctgatgtgaagcaatactggcataaaaaaaaaactagggttaattagatccatgccattgtaacttcaaaaccagggatgcaaacccaggacaggggtaatcgcccctaagccgttcgatcgtaaattttctacaacgtcaagtagaagagttacatatgaaacatttcacaggctaagggctatgaggtgctacaactacaagatggcttcatgtagatgctgacaacttctaacaagttaattcagtgcctcagtccagctccatggcattatcttgtgccctgcttctgcaggaccaaatcttgatcgttctatcatgtgacacagtcacaatctgctgtccatctgcacaagatttacacaaaccaccaattagaaattcagatatgacatgtttgaatcttgtggcaagtggatggcatgataatacggcacaatcttgaaaaggaaaatgaagaatgagacaacaacgccacctaatgtaccgatccctagagtttactagggcatctgttaggaataaggatcaaaagctgatacattttgcaagaaacaagttgagggagaatagagatggaaagaacaatcagaacgtacaactggcagataccattttcaacaaaggattaaagaaacaagatgggtatgccattaaggacaaacaaacaaatggtgggaaatgcatgatatgcaattttatacgatgaaagtgcaccatagaatagcatagatctataaggttctaaaagtaatacagacaaataggtttggtttgaaccgtttttagcagcatcactgctctaacaactgcagttagttcagagatgagagtgttgatattggctaagaaaatccaagtgcactatacatgggaatttgttttagcataaccaaatggtggatgtccaacttgatatgaggaatggacagataaaaagggctaaaactattgatctcaattctcacaagaaaaggatatccaaatataatttcacatacagcaaagataaaaggcacttaagcaagtggttacctccactaatatccaaactagtaacctttgactcatgggccaccaaactcttgattggtttgtaatcacgagctgaccacagctgcaaaaggaaggaagaatatcagaaatgagacaataaaagaaataaaataaatggcgcattattattaggcatactgctgctttggtgtcataggacgaagttgccaaataatagccttcctggggttcaaacttgacatgtgagataagactcttatgtgctggtatagaatataacattcttttagtcctcaaatcccatattcgagagaaattgtcttcacttccagttgcaaccacataaccattaggggagaagctcactcctaagacctgaaaaaaaagtaaaatcatgttacaatataaaaaagcaatagcatgtccacaactaaataaatgtaaccacaaaccaagcaataaagagccgtaacagcttgaaatgaatggtacagtactttagaaaaagattgganaattgatgctatgaacttacaggcttcacatgtcccatgagtgtgccccacaatcttcctgatcttaaatcccaaactcgagcatacgcatcaagaccacaagatgcagctaaagaaccatctgggtgaaagctaactccatagacacttctgctgtgcccttcttggagtagaagttcctttccagtgctaacgtcccacaatctccagnnnnnnnnnnnnnnnnnnnnnnnnnnnnnnnnnccagatggatgaaaagcaaggcgagcaagccgatcgaggtgaccatcaaaggacaataagagtgacccatcggtcttccatagtttggcagttttatcagctgaagctgttgctaagcagtcgtcaactggtgaaaacgcaacatcagttgcacgttctgtgtgacctttcagagttgcaattttagttacttgtggcatactccacactttgatcatcccactccatgaactaaaaaacacagaaataaagtcattatttactgacaaggaagcaagaacaagaaaacataagttaaggccaagaacaagagaacataagctaattgaggctcaagattaaggaaaaaggtatccaacaacatgacatcaacaattagtttaccaaaattactaaggctatgttcttttcagctactagcaccagattaacgcgggcacgcttcccaagccgctaaacggtgtgatttttgaaagaaactttctatatagaagtttatttaaaaattcaaataaatctattttcaagtttataataggtaatacttaattaatcatgatctaatcgagtgtcttttcaggttaggaaattggccaatctgatgaaatgttgaagcaaatgcagcctaagcgtgcatgaacttcccttccaaaaacaatgtgtatatgaactcctatgaaattcaattagcatcacaattgaaaatcatcagggatactccactattgtgaagataccctgtatgcgagaaggagccagatgctaccatgccacccacctagtgtattttggaacaccgcaatagttctgttacaggcaatcctgcaaatgtgaagaccagcctgctcaaaatagtgctagccgataagcatgataccatcctccatctgctcaatggaaggaaattctagctgcccaaacatgagccgctagctagttctataaatcatacagccataaaaaaatttgttgattcatccagccgatatcacgccatgatgaactattgtgattgcaattttgaacgagtgctagctgcacctggttcaacgcaaagcaatcatgacagaaatgctgaagcagaacagcatggttctatgcagcagcagtgtaaatgtgaagaaacacggccatctgccatatatagcagcaattcagagtgttttcagtcattgccaatcccaaacttagaacagcttttactcaattgatatgctaaactgggacaagttaagcaagttaccaaacccatattaacaattgacctaataagacgattgcaacacttcggcgagcaaatcattccactattttaagacatacaaagataaaaccctacgctattccgtttgattaagtggccgtaccttgtagcgagcattgaaaaatctcgagagaaggagcagccggtgagggggcggtcatctccaatctcgctgcactcaagcacgaaatcctccgcctgcttaacgacaaggttggcctctgcctcagggtcctcgtcggggtcgtcatggcagcgcttggcccgctctatcctggccttggctcggggcagcgagtactgcgcgatgtcgacgcgcgccttgagaagctcctgcgtgccctcggtgaagaaggggtactggatctgctcctcctcctcttcggcgcccgcggcgccctgctcctcctcctgcgcgcggaggaggcggtcgaggtggccgtcggcctcgaggcggaccatgagagcgcggaggcggtcccggcgctccatctcgcgctcgccgaagagcgtgacgggctcgccgaggcggcggaggcgcgcccgcacggcggagtcgttggtgggcacggccatggcgaaggcgcggcggcgctggagcagctcctgcaccgcgcgctcgtggcgctcccgcgcggcgcggtggtcatcggagacctcgtagtcagcctcaccgccgcccccgccgcctcctcccgccgcggaggtcgaggcgacggcggcggcggcggccggggcgggtgctggggctcgcggaggcggggcagggatgggggcgatgggcgggggcacggggaggggagccatgggaggggtccccgcaggagcctgtggcctggggttctccatggaggagagctcgcgcgaaggcggcgagctagggttagggttttggaggcggaggcggtggtggcgacggatactgaggcggaggcgtcgcgggctgcagcgcgaaggctcttttgatttaattcccctttctatgttggttaattacggtaggagtatatgatttggggtaattgcaatttgccgttttttttgaatcgccattgcaattgtaaaattgccataaaaactgttgttcgaataacactcgtttaaaatgtaaaaactactccagcggaaaatttacaaatgttcatttgaatctagatagaacacaaaagatgcgaacaattcatgacacatgcatttcggtctatttgaaattggggatttttttactttagttgaattaatctctatctctacttatatatacttttaaaaaaaataagagatgcttccttcgtccgtcaaaaaaaataacgaaaaaattaaaaaaaaggtccgactcaaagatagcgaaaaaataataaaaaaaggtccgactcctattcctctcataaaaaaaaagtccgactctatatccgattcccccttaaaaagaaaaaataaaaggcaccattcctctcggtttaagtccgagatcccaaaataagagatgcttccttcgcccatcaaaaaatagcgaaaaaataaaaaaaaagtccgactcaaaaatagagaaaaaataataataaaaaaaggtccgactcctattcctctggcctgactcatattcctctcattaaaaaaaagtccgactctatatccgattcccccttaaaaagaaaaaaaaaggcactattcctctcggtttgagtccgagatcccaggcacgtttcaatctatatcatgatatcctatacatcttggtaaaaaaaattgatgtgccggattgaagatttatttgcaaaaatggaatctacaggtcgagagcattccatttttatataattttaatttttggatttgtacttttgcattcgagtccctgtaatttttatatttacatttgagtccctataatctttgcaataaggttcttgaggttgtttttgttaaaaaaatgataaaagtgagagaacaaaggcagaaaggtgcataaaaagaaaaataaaagccgcacaaaaaaagaaaaacaataacaacaaaagtctgtttccctaagtgaaaaaaaagcgtagatccgaatggaaaaaaatcgattactataaaaggcaaaaaaaagtggtgaaaaaaaaacgctagatctaattcctttaaaaaagaaaaaagagaaaaaaagtgattcctttaaaggcgaaaaaaatccaaaaaaaacatctaaaaaagtctgtccgattcccttaaagaagtggcgaaaaaaatggttcgtaaaaaataagaagctggtttgtataaaataaaaaatgcacgtgagaaaaaaaatggaaagggcgaaacaaagtccgatttctaatcagtatatatctcttctctatctctaatctaatctaaaaatagaaaatgcatgagaaaataaaaactgttcaaaaaacgcgtgagaaaaaagttagaaaaaagcgcaaaaaaacacgctaaaaaggttttacatcttccataaaacaaaaaaacgcgcgagaataattatttccatcgccggtaaaattttttttttaaaaaaaacatgcgaggaaaaagctgtaaaaaagcgcgccatttctaaaaaaatagtttgaaaaaaccgcgcaagaaaaaaaagcaccatctattaaaaacaaatcgctctgaaaaaactgtcagaaaaaacactaaattgatggacgcttgagtcagatagaatccatcgattttttgccatctactacacggctattatttcgtcacatattgtcatgtattgaaaaaaaaagcaaaaaagaacatttaacaaaaagacaagaaaaaagcgcgcgagaaaatgattgttagaaaaaacatgcaaaaaacacacgagaaaataaaagcaaaaaaaaggggagaaaaatatggttttcatcgtcattaaaaaaagaaaaaaaacatgctaggaaaaaactattagaaagaaatgcgccatttctgaaaaatagtttgagaaaatcgcgcaagaagaaaaacactgtttataaaaaaacaagccgctcatcaaaatacaaacattgtcattaacatgattatgcatgaaaaacgtatattattattagaattttttcacccgttgtaacgcatgggcatttttgctagttcttataatatttctaagattaggttcttacagtataaattatacttttgagaattacacttattgtatcgtttgatttcgtctattcacccaatccattcaatttcattcatatgacatttatccatctagcttttgcttattagacttaaaatgttgctttcggcccatctccacccacacccgtatcgtctctttatctccacaaggaaaacacgatggagtgacgaaacacctcttttagtgagcagatgcagtgcgtctctggttcacgggtgatcgtatatcatgatgcagcagcagcaggccaggagattcccacccccatcttcttgacatgaaactattagtcatccacaatgttgcataaaaaatatgatattaagaaataagccatagtccatattaaaagcatagtgcaccgagtcccggggtcattctcccgttgtgtttgttggtgctagacatcagacgttggatgaagccacgatccgagtcgccatgcaactaacgaatctatgttatctttctcttccaagccccaaactatagatggccaaatggcccacctgtcctagcttggcccggcccgggcacgactaggcttgagcccaagatcagtcgggccggcacggcccaacctacacaccgtgttgggtcgtgcctgcccataggctgcatcaacggtctaggcacgacctaataagactcgggctgaccagaagataagatagtccatcgtgctccttctttgggttgtagtattttatatggttgaaataagtctactttgtatcctcaactgttttgcctcctgatcgttgaaccgtatcgtgccgggccgacccaccttacgtaggcagaggcccagacacaactcaacggtcagacggatcagcacaggcttgacaccagtcgagccgagccgaaaccccgtactgtgggccgggtcatcggccccgcgcctgttttggccatctatacctacaacacgcgagtatcgttcgctcagaagaagtcatatccccggagccttcgaatcaaaaagagaaaaaaagaaaagaaaagaaaagaaaaatcccctccgcctcctcccccaatccttaacctaaactccgatcccctccgccttccatggctgccatgggaagaactgtactaccttcctatgttcttctggatcgcatcgttcgatcggaggaggaagccgtcgaggaggagtcggagtgggcggccatggagtgcgcggactggaagtcgtacgggtgccaccccggtgacgaacgctaccccaggaacgccgctagggtgaagggcatgctgctcctggcgcgcctcgcggagcccccgggtctctccgagctctccatccgcctctccgccgccgccgccgtgcccaggccgccgccggccagcttcccccccggcgccgccgtcccgcccatccccaacttgcccgacgcgtcaccgtacgacgacccgccgctcacctacgtcgaggcggcaggcgacggcctcatcgccctcacctcgtgcttccgggatggctgcagctgctacctcgtctacgacgtcgtcggcaagtcgctctccatgatcccgggcctgcccgagtcctgcctcacctactgcagcatgcggcctctccccctgcgcaccgccgccgccggtggctacgcgctgcgcagcagctactcgctggccatcgtggctaaggacatgcggtttgacatggaagcggggcgagacgtctaccgggatgttctctgcctgtgcccaccgcggccatcatcatcctcaagttccagggggggcatcacgccatggcaattcaaggacgccatcttcccatcacagatgccgggttccttccacggtgacaaggtgttctcgttcggaggccacgcgttctgggccgacctcgcaaagggcgtcctcttctgtaggtgcgacgatgctctctccggccgcaatgatgatgccgtgcaattccgctacatcccgctgcctgtagagtgccatcttaaaatcagtttcgccatgaggggtgacctccagctatgccgcacaatgagctgtgtcgacggctgcggtgactctatcaagttcgtctgcatcagtgacggcggatccagctctgcgcacaccggcgatcgtgcgataacgatgtggacactgaccctcgcaaccggggagtggctgaaagatgcacaactcatggtggcagatctgtgggagctggagggcttcgacaaggcgaggttgcccaaggccataccaattagccctgtcctgaaccctcaggaagatggtgtccttagtttcatgctcaacgatgccgatgcagagctgtacatggtcagccttaacatgcacagcaagaagctcctctcgtccttgaccctctcatcctgccctgatgacattgttcctcctttgggtttggatctttccaaagaccttcagaatctgtctcttcgccctattgctgctgagtctgttccagccaagacacagggacgcccaattgcaaccaagaggaggaggtcgtcattaccgtagtgacatctttgtcaggtaattctaccgctataagcttctgcagtctgtcgatgagatgatgaggtcaggtaattctaccg

SEQ ID NO: 58161 - DNA, 1924 bp, Oryza sativa
caaatgctattattgtgctgtaaagcagacaaagtttttttttttttttttggaaatggaagcagatggatattctgatgcatagtttcttcataggtgagagattattttagaccaataactatgctgcatgatcagcatcctcagttgacatgaaaagtacagagtgcaatcatactgtacaagtgaaccaatgtttatttttacagaaaggctcataaaactcagtacagaaatatggactatcttagcagacaagtgaaccaatctttgcataagtaaacatcagtgatatacttcacaataactaacatggtggagttaacgaggggataccgtaagcatccaggtggcattctcaacttcatgaggattcgacttgacatagcgatggttgaaggtgcagccattatgcatgtcaaccttgtggtcatctttcaagtgattcaccaagtatggaatgtcaccagcaactgtgcattcagatccagcatatggacagctataaggcctatattggcactgtgactcatgcttcagcttgcagtagtaaggataaatgcctacacacccgaagttctggtacttgcatggaagttcaagcgacgcagccaccttctcgagagcaagacatctaatattacccagttcatgcctacaagttggacagcgattgtgaacccttggtttgcatccagagcacaatgtatgaccattagagcactgcattagcagaaaaagagttggggttacaacttacaacatagtacaacaatgtgcatattgtacatactatcttagctaacttcttttttggtgcttaaatacatgggtaacaatttggtagtggaacagaacatatgtgaaaaagcagctcagaacgaccgttttaaaccaggaaatcatctagataagttcaaatagatcaggccagactacaaatatgatagcaggattcaagatagtaaaagcaatgcaattaaatgaaacacgcattttgtttcccaagtgacttccatacaagaaaatatcctttttaagtgcaaaaaagattcaataagtggtatatgtgcacctgatgaatgggaggatacattgcgctcaggcagactggacattcaagcagttcacgcacactgctagaaactaccacatttggttttggtgaatgcggaacaggatcaccagcaagttcggtaacatccagcacctcagtctttggaggatcaattacctcagaaccggagtcatcaatataagtaactgaggccataaatacactagatattgtaaggggtcctgctaggaaagagaactatctgtgttattagtgagtcaaaataaatgacaaattcaatgcttaaatacttccttttaaaaaaccaattcaacacttcctattaacactattattaacaaaaaaaatcattgcctcatcaaaagtatagccatatgcccatatccatacagtctcatagtatgattggacactgttgaagtgtttaagggctttgaaggagatagggccataaaggagcagaaatcaagaaagcacatggatagggcctcacatgtgcatcggaagttttgaccagccaggtcttcatactgcatattgtcctatgcaacagatatgtcatgaatgtctatagtgcttgtgatgttttgtatatgctttgtattaagaaaatttagcatacctgttataagaaaagtgtaaattttgagaaagagattggtgtgtgaactgcatttttctttcatttgtggattttattaaaaggtttatatttgtggaaatttgtagttcgtgcatttacatcaattaatgcttcactttttctttataaccgtggcttcttttgacgaagaaaaaggtggcatttattaaaatgtaacatagaaaaccttgccaataaaccct

SEQ ID NO: 58162 - DNA, 10446 bp, Oryza sativa
  unsure (1)..(10446): unsure at all n locations
aactgagtactgaaattaattaaccgaagtggttaacacaccatttcgggcttgttcactttgctaccatttttaaccttatcaagttttggcattaccaaattttagctaagttgtcaaaattttggcaaggttgccaaaatttggcaagatttcataattacttgctaaaatttggcaataaacttaaggtagttaaaatttttggtaactttatctaaaaatagtatggatgaaaataacatcaaagtgaacattattacgtattgagaaaagtatcacataccataattaattaattacttaactgcagacttagtataccgtaaccagatacaggtgctgggccttgggccggcccatgtcaaggaggggtgtgctgtgttcggaaaggaactgatttgagctcctcatgtcttgctcccgaaaataatgtatcccctcaaagtctcaaaccgcaaaattaggtgtaacacctccttccctcatctctgaaaactgatggaaaccaactccttcaagccttattcggttacacccggatttaatccggactggaatgacaagtataataaaaaatttataatagatacaatgagagaccggaatttattccgggccggaaaccaatttacatgatagggacaacaaaacattcgaattagttcaacacctcttaaccagtggattgattcccggtctcttattatccctatcataagtaaatttgttcctgacccagaataaatcccggtctcttattgtatatacataaattttttactatacttgttattcccggctcggattgaatccggacataactgaacaaggcctcaacggtttgggaggcggtttccgctaatgtgacaggttgaccaagttaactagctaagtcggtaggtaggaccacgggcgccgcgcacgcgagacgccgtagtcatcgacgccgatgccgacgagccgcgtccctgacgactggcgatcgaggggcgcggttggcatagaaaagttgcaggagcagagctgggaggacggccccacctaattcaggagatcgacgtagttgggcttccactcacaattcgaggccgatcgacgacgaggccgccggcccgcgacgtcgctggtgaccgtcgtgtcgatcgttgcggagagccaaattaaagcggaccgtgcggcgcgttgtcgtcagctctaggctctagctagctagtgactgacagcactgggggtgttgtacttaatttactggtgtgcatgcacttgatcgttgttatgcctcgtatttgtagtgtaaaaatgagctgatccattggatggctacagtaatgggggctcttagctagcgcgtacgcgccgctagcgcggggctgtttggcacagctacaactccagctccacccctccgggagctggagctcagccaaacagtctcagctccaccaaaactgggagtggagttgggtggagctctctcacaaaataaactagagttgtggagctgggtttaggcagctccacaactccacttcagacccaactcctggagctaaatttaggagttggagctgtaccaaacatgccaacactaatgatagtaattaggtaagattctgaagatatttttggatatttttttactaacagattgaaaattttttaagttagatttgaaaactttcgatttaagtttcaaattttaaagtcaaattttgaaaactttcaactcagatttgaaaactttcaactcgagattcgaaaacttttaacttgagaatcgatattcgaaatctttctaagtccagatttgaaaaatttgaaaactttcgactcgagattcgaaaaatttcaaaactttcaacttacgatttgaaaatttttaactcaagatttgaaagctttcaactccaaatttaaaatgtttaagttaagatttaaaagctttcaacacaaaacatttgaaaaatacgtgttgttggaagattaagaaaaaatcatggaaaaatatttaaaaagtaatcgaaaaaagaaaaggagaaaaatcacagaaaaaagaaagcgaaaaaagaaagagaagaaacggcgatagcaaactgcgaaaaaaaaagaagaaacgcgcgcgtgctgggccatgtgggccggaagtgtgcaccggcaatgcgagcgctcaagttagcattctcgacagtaatgacactctacttttcgaggttggaacgacgagtcaacgaaatcctaatcgcaaagagccgtcctttccttcgaatcctaaccccaaagaaggtgatattagctaggatgacatgtggatcctacatgtaactcatatagtcaaccacgatcaacttgtcacgtcaacagaagccaactcccaaaccgccaaaaaagtttttggagatggcggtgagagaggcgattcaataagaagcaaacaatgagaaaagcaagatatgtttatttcgtccgaaaactgagcacggtcctgatatcttattaatacatgactaaataagtattaactattataaactcatcgatgaattagtttttgttacgagagtagagaaggataagattgtctctgtctatatcacagacgggaacgcaccactctcagtggattagttcctcgagggaaagcctggtagtagttaccattcgtcaattcaatcaaagcaagggaaactgtcattgcggattagaatcaaaagggatctctctcttaaaccaaggcatactctactggctttccctttgccaggatttcttttacgagcgctagagggacgagctagataccttttctatatgacgagagctagagaatagaaatatcatactttttgtgttggatcatccgaatttggaagtggatgcatacatgtacctccagtggcattttccttgacaatttccctcttcctcctcaaagcagttatataattaccactaccatattctatagaatacgatttgtttttctcgccgatcttcagagggcgtatgcgtgtgaacgcttggttcaagctcttcacatagacatgatcttggaagactcgttttagaccgaagcgattctttgaaccgagttctttctctttcttgcgaatgctgatgcgtttcatgagtgggggggctaagcgcagttctttgaatcaaaggttttatgaaatcaaaatcgattcttttttagatatctggatagatggatggatctatcttgatattcagatatcttttgcaatcagccccaaatccttgatttggccaggaaacaaagcactgctttgagcccaggaagcgaagggaatgagctcggctgcttctcctccacacttctttatttctccgtgccccttccgcatgcgcttcgcgcgccattggcgctttgctctcctcttatttcttcattggagggttcggatggacttcgccgttctttcccaacgaaaatggaaagggctgtatcacatcgagatgtcgattcgttttccgccccaaatgagatggggaattagtcacctctgtcccttcatctttatgaaaggaatcaaggggttatttttcctttacggcaataagagctgactcccttgcttgtagtttttgatcgatggagtgtatttaacatatttaagagtggttaggagagagaatcaatgtttagtagtaggcctggttcaccaggttctaccactgttcggcccaatcagagtcaaaatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttttcggggagctgggcagaaggaaaagaggctcctagctaaagtagtctcgccctgcttcaaaactagggaggaatacgtggtacaggctgctctataaataggaaatgaatgcactttaggatctcggtggaaagacctttttccacaacaaaaagaagtaggcatgtggctcgtccgtgataacttcttcggatttgcgtgaactagcggaccgatcactaagtggttagtacctccagcatgagcgaaccttttcagaactggttaggaatgggcgccactatcccaggccggatccagccaggaaccaaaaagaagaaatgacaagaaagttgtatatagatggaggataaaattatgatgtggaaaacaagacaggggttttgtacaatgacactgtacaacaatttggaaaagggatgtagcgcagcttggtagcgcgtttgttttgggtacaaaatgtcacgggttcaccttctttcatcaataatttatctgttgttgataacggtgtattgatctccttgcagccatgcatgccaacacgttttaacagatcagtagcatacttctcttgagtcaagataattccatcatgaactttattaacttctatgcccaagaaatagtgcaacgcaccaagatccttaagggcaaattcttctttcaaatcttgaagtaatgccgaagttgctttttcacaagaactagcaacaatgatgtcatcaacatatatcaacacaaatatggagatagtacctttcttgtaaaagaagagcgaagcatttgcttttgacggagctttcaaaaagaaaagcaaggaccactacgggaggtcgaaccacggaccggaggaacagtattgtccgctcacttccttcaatcaaagcaagggttatctttccaggaactagcaaaccaaacaagcaggctataaaaagaaaaagaaaaagaccgaaccagtaagactaatgtatacttatttatacctttgagaggtccacttagactattatgattttctctttagctacgtaggttatataagattcaattcaatctaacaagcggactggactaccttcgactactacaagatatttagaaaccaaagaagttgagcctactttacgcacttaaggcagcagcagacaaggaagaaatgggcgatgataaagggcgccccttggcatttcctgtggggaagtctgattgatccaatcacgacgactttcaggaattagttcacttgccattcaatctcttttccgagttcatgtcttagaaggagtacgcaatctccttttctatccccatgagaagctgaacactgcctccctctcaacgatgtcactagatagggacacgcatttctgccaggccataaaatcgaaatgaaaacaatctctccctcctacgctatgaaggtacttttcttcaccggattcgagtgattgtgatagctgtggttgggcatccgagtgcttcaaatggcatgttgtttcttagtgcttccctgcgatttagggactccgcaatattattatatcctgtcattctttccctattgaaggtggattaacaacctttatttggttgtattctcattcatcttaaccaatcataacaccaattaggtgtggtagttggccactacttatgaaatatctcaaacccacgagtgatttatcataacaaaactgtgaggcaaacttagtaagggggtcgtgttattaagtatatttcttagctacaagcctggcctttcacttttcttagttcccccttttccaacctttcttttcctgcatgcctaaaagaaagagttagctttgggacaagacaagcaagggcgaaagcttcacaggccgtcccaactgctttacctgctgtccctactattcattcttcgccaagagagctatcacttgggtcggggcccctatttgacaagggaactgaacccatttcattgaccttcgaactgctcttgccctcccctttcacttccatagtggtcttctttggccggcccactcatttcacactcaagctctctgagaagattcaagatgtttcgaattctccttcatgttcgtgctttaagtcagttcgtacttttcagtatataagagaatgactgaactcgcgttgaaagctactaaacaacggctgacagagactcataagaggggagcggtagcaaaaatgagatctttcgtctagacagaagagagatcatttccttcctttctataagaaatgactgatgttgctaagtcaccttccgctgctcttgcgtcatcccttttccaattctttttgaaaccacttgatgatgaacgagaagtagctcgaccgtaaaggaaaggaaaggaaccctggtgaacggattgagcgagcgccagcgaggaaatctcaaagagatattttttattttatatagttattctctaatatttcaccatagaaaagtttctatttcactgccaatctgttgacaaagctcaaccaaataaaatatttttgatcctggaagaaatagtagaaattagaagaaaaaacttgatgcttgaaagaacagactcatagggtcactagccaactttcataaagaaaaggcctcactgtatggtttatgtggatgcatgatgctttctcagcgatgacctgtaaaggaattactcaggtccctctcttttgtataaccctcttctagcgatcatgtatcccgacgtaggtacaaacgtgttcgcgaacaaattcgtggagaagggtccaatagccctcgaatggaccggctacactgaaagagggaagcgaatagcctgaagattctttcctttgttgtctcactatcagagcttgcggcacttgaataagccgccgccccccagctgcgtctttacccctatccaatttttgggccaattcccccttcgtactaccaaaaaatgagattcaggaaagtagttgggagtatgtatgccggcaaaaaagtacccacaccttcttaggtggtaaaagatctttttatgaaaaaaaatacatacattcttataggtcaatttatctcaatcgatgatattgtttctgaatagttgacctaaccaatcaaagctcccttgactagctttccagcatgcgctactactgcctacctagcagtcacctcttcctcctctattccatttctagtgcaatatctgacttcagtagaagaagagtactccccttcataatgcttccttcttcaagtcttttgctagtgaagtttgggaaagctagtagagaactgcaaccagagagagagttctagtgagtccagactctttctttcgttcatcaaagcgaagcatggctgcaatcccaaactcatccttttttcttcttatcattcgcaatgctactatggttttgatgtcttcttgtgtcgctatctgaggtttgagatcaagtggactagccattgcttctccacgaggctcataccaggcgctacggcgctgaagtatgtaacccatgccatactcccaggaaaagctcgaacgaccttcaacaaaggcatatcgaaagaagaattcgaaggaaatgaagcataagctgtcaccactaggataaatcaaattgaatcctaggctgtttcgatagacaaaagaaaatagaaaaaagtagtgagtgagaaagaaataagtagcggcgctttgcttgcttggaaacgaagtagcagatttttgagtagtcttttcttggctggtaactattcaaacagagctagccctctttcttgatacctatgtactgaccacatatagtactgtttcgtgaaaaaccaataggcattctacacagagaacaattcaaagctgactaccatatactactgtccctgctttccaagtaagtactaatttcgaatgcgaggttgcgtagcaaagctacaagccgaaattcaagaatgaactgagttatttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcattcgcccatcgcattattgaactaattgtgccacagtcgagcatttttgtccaatcgcaacatagacacaatacaatgtctcactctcatttgtgccccttgagttcatttgcttttggtttaatatagtatcgatagctattgctgtttttccagtttatctgtccccgattataagttttcattgaccacggcctataggaaccagactaaagcatgttatctctcatttttcgtcggtaagatacttgtacataacagactagcagtaccataagcagcaggcttttggactgagctacaagtcacagtattttgagtaaaatagggtaataccccataccagcatgaagccatttacacaaagcccataatttggtatcatgccggtaccagagtcatacataaaggtccgtcttctccttctgctcgaaagagtctaatgctacatcctttcactcatgtagattgtccagcatttcatttgacaaaactccttctgatctgaggacgacgaagtttatgaagctgccaagcaagatattgatggaatctcgacaacgggttcttatgtatgatgtgtccattaggtctcaaattatcaacacggagtgtacacagagttatggaacaagaaatgattctttcttattttgaaacagaattcaaaataaaggaggatttaattcggttgctttatgaaagccgacgccgtgccgtctggcgaaaacgccgcaggcgcgaagcgtggtgggcctgcgccgggggagcatagggaggaaagggagccagtaaaaaaatgagttccttgaaaaatcaaggggacaaggagcctaccaagtacggcaacaaaagaaagaaatcggcacagttgcgatgcgctcactcaagcttaggcaccgaagatgcattccatttcctttcaagtaacgagagggctatcagttaaaaattaaaaagagaggaaacttgcttagcaagcgtacgagaccaaatcttgttttgcttatgggctgtagctaccgggtccgaaggaggctgatcgtgaatcaattccatctgttagggcgggcaagttgcggtgaaagagagtccatctttatcataaagttttgtgaagaaagtatggctgccgaaagctctgggggaggctcgctcctcctacatcgaactcttcttttctttattcaacaaatgcaagttcgtcttcgtctgatgggatgagaagtagtaggattggttctcataattaaaaaaaggaatttatcgaaatttttcttttattcttgttgaataatgccaaatcaacaccaaaaaaatatccaaaaatccaacaaaagtcaaaagtaaatgaattagttaattcaataagagagaaaaggggaccagcacttgattccgttgcccaaacgaatcccattcaatcttttactcatcccatgagtccgtcggaaagttcaatcaatctttttttcatatccatttcgccttttgtgaaggatccctccccccattctatgctgacccgggccggggctctttttttgggaagcccgttcccaccgcgctcacggcccggctggcctgccagcggtagtgggaattctcccgttccctggtcaaaaaagggttgagtcgttagagcacatatctccgtgatcccttccacagctaaacgtagatctctatcttgtagaggagtgtagagtaaagatataccggagtggagtgcaagaaggttataggggagtgtggcgcccgcttgcccgcctttcttctcggttgaaaaacaaaactgttgcttgctttgttcattcaagtagtggtttagccctcgaatctgggattgaaggagttgctaatgcccgacccttctcgactagaaactcttccgctcctccggacctttggaaaaccaagaagtagactgcagtgtcccgctcgagtacgatgtctgtttaaattctttctttgatttgcaaaagtagtaagtctactcttcttccacctctcctcagatgtctacaacaggaattgacagaccgcactcagagaccatttggaaagaatagcagcactctccaaactctataggttgcattagctatacgagcgaattggttgtttcgagcacgtagcaatgcgagatagaagattatagcgaaagagttagctcaacctatctactactacccttggaaagggggtgtgcgtggtatacctgttacgactcccctcgaactgagccattttcatgattttgcaatcaaagaaagttccatacttttttattcccagtatggagccaacgtcgcttcgctttcgcaggacaatttccttctggaaaaatatccagtggcatatcccatctagctctgggaatcaaaccacaaccagcgccttcttgtccgatgaagttcaagtctctaacatgttcttcgcttatccatttagcccgcccgccca

SEQ ID NO: 58163 - DNA, 5835 bp, Oryza sativa
tctttttccgctgcatagcccgaacaacaccaatattgggacacccattatagagtattgatacgtcaatcaaaaccgactccacaaactttggtaactccaacttcaacctcgattttattaataactacttacgagaccttctttggtacatatcccttatctcaagtttttgatcaaaccaatccattgacacaaatggttcatgggcgaaaagtgagttgtttgggtcctggaggattgacgggggtttgatttgacagaaagttcgaagaagaatagatagaagacagacttatcgacaattgatttatttgacttttttaaaaaatcttctatagaaattttttgtaatgaagtgacccttaggggctgttctttttcaccggtttagacacgttagtcgtcaatgtaatttcatatgagaagccaaaaattaaaaggggaataacgatcttattaattcctaatagttaccataaatatatgctcgactaaaatccatacaaactcgatggtggtgataagcatttataattccgtagactcgaaagaatgtcccgcttgattgccacgcccaattgagggtctgccagacagaaaatgtgttccttcatactgcaataaaaaacatttgaatccaggatagtaagggttcctaggcaatcaaggatagaaaggaatattttaaatatttagtcaagatcacttgcgacttactatatccactcgcctgtttcttttgaactcgactcaacacctctgtaaaatctataaatgctgtacaataatagtccaagcgaacattgtgcctcttccttctgtaaaggaaataaagtagatcctcagggaataatcgtagttataatataaattctggatcttaatagactaattttagatatagataaattaccattcccttgtccatacagtactgaaactctgcaagcatttcctgtactccagagagaagctgacatcgcttaagatgtgcaattctatctcttctctgtgtaacctgaccctgttgtatagataaccagaggtcaacagttatatgttaagcctggtaacacttgtactcctttcacaacagatgccaggcacacagataatagagtagaacatactgaggcctgtctcaaaataaacaaatctcaaagataatataatacatcctaatacaataaatatagatagctagactatgatatgttacatcgtcgtctaggttagtttattttgggacggagataatacactacttaggcaagtgatattgagaagaaggtaaacattggaataaacgtacatggacaacccttgctggctttagaagtaccggcagaagaagccatcgaccaaatgcaagagtaacctgctgtaccctaagaacatgttctaattccggcattaccctgtgcaagaacaatccaacaaactcagctggtgaatacttatactagataagagttttctgtgtgtttttaccaatatatatttgtcagacatgaatagtttaacttactctttaaaatcccgtaaaaacttcttagtctgaaatttcaaagttggtgagaaaaaagcgacctgaatttattaaatgcaaatatatgtacacaaggaaggaaaataacctgattaatcatgagacatgctaattcttcaggagatcctggttccatctcatacctgcacttaatatgcatagaatatagctgaatgatcaaacatactcacattttcaattgagcacgatagagagaacaattgttcgaggatcacccaaaatagagtaattcggaatagctaaataacgtgtacatatcataattattctccggcagatggtattgcaattgaatgccatcctaattagtgattagatagtgacattatttggatcaaaatttgacatatagcttcatggacgtacgatacgagatacgctataaaggtctattcctaactgccttgtgtacattattagaaagtggattcagcaaccatgacactcaatggttcaaacaggttctcaaataactcaaaactgtaatgtcaaataagaattctacaagatgaaactgcaaattgctatgcacgataaagaaagattgattttgaattgattttcggcaaatattgacatcaagtccatttggaaattttctactttaaatattgagttgaatcgattttgaaatttaacttctataaagataaccaattctagaaatgggactctattgactacaaagtgactaccagggactctattgaccaccagaaaaccttttcaagtcttatgtattaatatgccattacacatagggacaggggcggatccaacgtgggtgtaggggggactccctacacccacaagacccatggataccccccgagcacctcctttaattttttcaccatgaatggtaatctaaaggtccttaaatggctggaggttgaagaaactgtgtaattgagtcccccccaatttttttgatcctggatccgcccctgcatagggatttctcataaccccttaagggaacattttattattttattttcaatcagaaactcaaatgtaaaccaggtattacctttcgcagagagaagacgatatgttcctgcatttgcttaatgtatcttcagggaattggatatattgttttcctgttacacctttgctttgatggagtgtattggtgagataccttatagaactgacctaaagatccataatagaaaaaacgtgtcatgcgtgcggtcagtgacacaacagaaagtactaatttccaaattcgaacaactagacagatcattatgttcatcttgatagtggataaatatatggaaacttggacgagcttgttgtagcaacacttccaaaatttagtggttacacatgaaaattaaatgaaccgtttgagataactagagaatgatctttttttttctttcagtaaaaagtgcatgacattgacatttttctttcatggtcttcgaggtgtgacttagacacaatttatttttagaaatttagaactgtgattgtgaaaatacttttgaagacaaatctacacaaatcaatcttatgttttaaaactaattactattttaaaaggtttcaaggtttgaccagatcttgtccaaaaaacatcaagtattggttaccggagagagtagttggattcacaatcagttactccctccgttttttaatacacggcgctattgatttttggacaaacgtttgatcgtcatttatcaaaaaaacgaagggagtaactgactgcgaatccaaccaaccactctctccggtcacaaacacttgatttttggacaagatccagttaaacctttgaaagtttgaatatttaaaaacaaagggagtaatttgcactaccattgtgcacaaaataaataaaaaaaatagaatatagatagagtatcttactggtttctgaacattctcatcccaacaccaaaccagcaactttttagcaccatgaagccagttgtcaatgtcagaacttcccatcaagctactgtggcgtaaaagccatagggtaaatgcagagaggcccaatgctccaaatgtgtagggtaaccaatatttggtcatttttctcggctttttatggcttgaaagctatcattgcataaaattacttgcttcagaattcagataaataagcaacacatttcttggcataatgaaattataagcaacatatagatatcttctaagaactgcaccggaagatctacttttgtgagatgaacaagagtacaagacccacatatagttttctaacataaaaaataaaataaataggtgaattatgtaaaaaggattgctagactactaaatctgatattgatgtacaagatttaacactttgtcaattatccacatgattaattagttgattttgatgcctcaagtgggagattttccgtaatcacccaaaaatgtttttggtactttagaataattagcagtagcactgatttctcatttgaaaccattcatgtatggaacagtttttggtttacttgcatatgcctaaaaatacttttttgagtttcgactaaaagcacaaactagtagccaaaaaaacttgggtacaacattgaatccttagggtgcgttcatttctcccccttaccaactttggctttcttattttccgtacacacgcttctcaaactgttaaataatatactttttgcaacaaaaaaaactataggaaagttgcttgaaataatcatattaatccaaatgaacacagccttaatgtcccaattaaaatacaggtaacagtaatctgggaactgcgaggctgacaagtgaaaaaaaaatcacgtgtgaaagtgtagtagggggggagttgcaaacccgagaggaaagaaaaatatctaacttctgaaggttttcatagatcaaacttatagcagctgaactctgaacatcagcttctggcaatctttggaagagttcgaatgagttattatcatgattcgctaatacagccccctgctggaaaagaaaaaccgagaccatattagaaaacaacaaagaaagatttacacctagaatctcgaattaagttaaaaagaaaaaaacatttcatacctcaccagcatttctaagttctacctccaaattggagaagatgttattcagagcaacgaagagactatgcagcgattgttctgatcttctaattaatacacttctgcgtttgtcagtttcattgtaaacctatggaaaaaagcaaaggtagaatttaagttcatatatgccataccaacagctggctttgaagctgaccatgcctcagtttttgggaagagaccaggactttgaaaaaagctttttaatattggtattttagtaaacaaacctcagcaagaaaagaagccaagcagtgttgcatccttgttaggatggcaagttttgttgagaacatagaagatgcagagtccaaaaggccctggactggactccctttgttctgaagtttagccagcgtttgacatgttgttgcaacaaaggcccttggacctctttgaaagatcataaaatacgctttctgcgaatttgttctctgaaaagaaaagagaaacaattccaagtataggtaaatggcagatagataaatgcaagaatcatatctaaatactgggagtctaggaaaagaaagggtttgcggcgtaaaaataccagagcattggactgccagaacagtatgctttcctggatactgtgcatattagacagggtgtgttgcagaatatcttctagtatgacgaaacttttgggaatctcaaccctacgcctgcaaataacataataattaaaaagaaaaaagaaaaggcatcgatgccacagaaacagattaattaatatataaaggccctaatctcatcaaggcctgatcatcacatcaatgccacatataaacagatagatcgatcaatcaaataaattcgctaacatataattttcggagggggtttctcactcggcgtagctatcggcgagactgccgccggcgagagggacatcggggcgccggtggcctccgtagaggcggcgctggaagccggcgatggcggcggaggggtcgccggcgcggcgggcgaagagggaggaggtccatgtgcgagcaggtccaaggctcgcgttgtgggccgggccgccggagctaggaaggcccatagaggatagaaccgaagactgtacaagtacaactagattgatcttcctgtagtcaattgtgtaatataggagtatatactttctccgtctgaaataaatca

SEQ ID NO: 58164 - DNA, 14134 bp, Oryza sativa
agcgagacagtgagcaatggaagaggagtctgtgacgtcccctcaagcgagacaagaaacagaaagtgaaactaactcagatatcagataaaaagggataaaaattgatagatattagacaaaaaaaaaagatacaaattgatcgatactagtgccaacagatcaattgccatgttaaaaccgaatcgattaaagagagataagaaagaagaacatatataatatatttctggagctcgtcctcccaagccatgtaagacatgctccatctattgtgagaggggatggcatggagtagatgggacgacatgctcctcctctcatctctgatccactacggaagagtgtgaatcctctcctggtctcctagcgttcaaagtttttcagtgaaaattcaatctagagaacacaaacaatcttgagccgtggaagaaacaaccaaaactctgaaaaaggaaattcgaataagaaactgtaaaagagatactctaagttgaatcgaaatccggtagctcaccactcatccctagcacggtgaaggaaggccctgctgccgctgcccctatcactcgctctaccaaaaggcatcgcttgctcggagtcatgctaacgcgggaacgagcggattcggcgaggctagccaggggggtcaacgcgtcccgtcaccgccttccctcatttgcttggcacccgattaggacgtaggagaggacaatgcagatctggaagcttgagggtgttgtccttcccgccgccatcatcttcctctcttcactgtcgtcggcgccgtcttccttgccggatgctgactcccttcataaagcttcaacgcaccagatccaccgatgactaacagaccccaaccgcagcatcacgccgccctctccttccatcagccttccttgccattgccggcgccgccttccttctcagttgccggcaccgcctcccttctctgttaccgccaccgccttctcctctctcctccaactgctaggcagcggaaagatgcggggaatttaactatttgccacttttagatttttcacttatccaaatacccgtatgaggtttgtatttaataattgagagaatatattctatgccactgaatttgttcgagttcaacaatttgccatcgacattctctttctataatataccggcgactttatcaattgttctacaatacgccattaggttgggcattcttttcaaaaaaatacctaaaatacccttatggacatacaaggttaataattgatttatctaattagaagttccaaaaaaaatatgaacatttttatgtggcctcgttacacaacgtgaaagtttgtttatatgtttcaagttttttttctggtatatttattgttagaaaaaaaaattatgtagtatacgagagaaaatttgcttatacgagagataatagcacaaaaatatcttatgtagtgtatgaaagatgatttatattcaaaacataaataaaaaagtgttttgtatagcatataacagataagttacatcttttttttaaaaatataaattaaaaaacttgaaacttttatacgaactttcatgttgtgtaaggaggccacatcaaagtttttatttttttgaaaacttctaatgggataaatcaattgttaactttatatgtccataagggtattttgggtattcttgaaaagaatatccagcccaatggcgtattgtagaacattgataatgtcgcctgtatatcgtagaaagagacaatatcaatggtaaatcgttgaactcgaacaaactcagtggtatagaataaattctctcttaataatttatcattggagagaggtgatttcttaactatttgcctattttgcctacgtggtgagccatcatggcatgcccgcgtggaaagtgacgtggaccccacctgtcaacctcttcgctctccttcttctccacctccggccgccgtatctcctccacctcggctcgcctcaccgcgtacagctcctcatgagggacggagtttggcaagtcatttggctattggagtgaaatttatttttttgaattgccaaaatttggctcggagagtctatttaagaggctcttaaaaatgctcttatccataccacactcacttatataaaggagattagccaggctagggaaatacgagtaatcaaacatgccctccaaacaataaaactggtaagagtctcagagatgctctcttactttttttccctacctctctgagtctttggagacctcccggctcccactatagttttaatttgttgagataaaagtacatcagtcctccttaatagtattgcgtgatgttgaaactaatataaaccaatgtgaaaaaaaatatacagaagtttcataagccacaccaccttctcggcctcatcgtcgccaccttcctcctccctctccctctcaatcatcccccggcacggcggattgggatctggcccctgagctcgggatctccacggtggcgaagcggcaaggagcagcggcagcctcccgcttgccactccctctcctctcatctctcatctcctgtgtgatttccgcctctcctcctatttcttgtgtgatttattttgcgatttctgattggatttatgatgataccaattggactaggatttagtttttttagatttataatgattgggattggttgtgggatcttcagagcgaatgcgcgttaacacgggcgaacggcagatgaagtggagaggaggtgcgcatgatgcggacgacggactaagacgaacgaaaatcctcagagaagtcttatgtattttttaattaggtatagatatagatatggtgttgaaatagtacattattaaaataattttaactattttatttagatcgactccaaaccaaggttataaatacttgtgactaatatatgaccggcggaggttaacggttgtttttaacaaatgtttgaattagaaaaaaaaactaattatatgcatgttgctgtcaatttaaatccaaactagatacttctgacactatcggtcatcaatgattacatgctaaaaaatttgccacgacaaaagcgtaattcttcaaaaacccaacatgattaatgtatttatacatcataaatagataaaaaaaatcaaaatacaaccaaccgtgaaaaacatgtctccactctcaactccaactcttgtattcacatgaaacaatgaggactcgtaatctttaatctgttttagtctttttgcagttattttttccatgttaactaggatcattaatttcatatttttcttgtttaccaaggttctctttctaaaatgacaagataacttttgtggacaaagaaaaaagaacaaaatgaaaccatctctcccgatcccctctctcacttgaactgacggttgtcaccaatgttcattcagttcaccatctatatgtcatcttacggttaaatttctaccgttcgggaggaaactaaaagatgcctctcatctatacctaccattataacccactaaactcctaaaactcaacatacatcaacccactaaggtcaacatacataatccgtaatcacctaaaactcaacatgtaagtatgcatatagtaattacatctacaatttatttcattctaaaactcaatatacacatgctaaatcatcgttctcaaatcattttcacaatatttcaattcaaatcattttatcatttctataatatttaacatatatcctgtaacaaagcacgagacattatctagttaattaaaattttactccacaatttaaggtagtagccatcagttcaagtactgaaggattgcaaccaggtttaccaaaccattttgagcggggttacaaccaccccacggtaagatggttatcgtggtaaccgtgcggccaccgcgaggtttaccgtggtttcaaaaactgagaaaattactgcacatgataaccatgataaccacaaggttacgtaaatcctgattgcaactcataacaggagcctcctcatcttccatgatgtttaacatgcaggcatgtgatgtctcctgtttgaactcatggtaaaaggactgaaaaatggagacgtgagtatacggttgcaacaagtatgacagcaagatgcgcatatttacatcgatttcttgcccatcttgacatcttattcacttgatatgggttcctcatttcttcctagatgatgaggatgaagaagaagcggcagcgatgattccaccagcaacaagtcccacaagtccgaaggcaccagtgacaatagccatgccaatcataccgtctgcatttaaaaagcagtcagtaatgcccatccttcaatcgatccgagttgcaaaaaccattgtactcctacgaattagattagtacggaaatattttactaaaattcattggaattagattatttcctacacagatcttctagaatttctttgttccgatctccaaaggacacaagagggtgctgagctgctccgatacttctttctttataatgtgaagtgcagacataactaagataccctttgttaatatcaactttcatgcgtgccctgctgataactacagttcccctaaccaatatatttgacaattatactaacagtatgaaatgaaaattgagtgcaaattcattttccagtctgaagaaggcttggatgttaaataatataccctacctcttctggttttgtcctcaacaagcctttgtaaagtgagagcttgcctccagtcaggttgaatctgcaaaaggtgataaatgtgcattcattaacatcaaattcaggataatctcaaaaaagttagaatctaaacgtacaaaaataagatatctcagatgtctatctgattaaagagacaaacacattatgttaagcaaaaattggcaccaatccaatctaaacagcgtaattctacaaagcagcctgtttctcttatagcagcttcaagtcttgagtgaacatgatggcaggtcatacacttgttctactttgtcatttttaaactaacagatgcttcgttgataaaaatgcaatattatgataatcaattaaaatcagttaattgtcttgcaagctgaggttaccaccatgaccatttacaacagtatctatagatctcatatccatacaacaataatggtaccagcgaccatgggctcatggaaacagcaaataaaatgattagaaatatattcagtaatcaaacctctaagcatctttccaaaagctgccgactccttgtataatcaccagttctgtagtgtccaacagccagtaagtagagcttctcccttgtctgcagtggactggtagacctgtccaaagaagctgccaggtgccaagagaaaaacatgagtcccccccaaccacaagtgaaagcaggaaggtcagatacaatatctgattgccaaccgatcaaaaaagtgttaaagaaaattgaaaaatggttgacatacaagaaaatgtggacaatggattggaatatcactttataggtgacacaatgtaatgaagtgacattttattcagcattagagtgccatattaacggcactattaataaagtttgttcagaagagtgcatacaggaagtttaataggagcgtcagaatgggtaatcatgtgggaggacacttataacatatgttaaaagctatttgattcgattaaaaaggggtccccctagataaattgttagacaatgtgtggctcatctgttgaaacttaaatatataagtctgaaacagcgtcagaattaaaatcatgatttccagatagatttgtattccaggttaacaatatctgacttatatactccctttggtcatgaaaacatcttcatttggacatacatcgagactttgagcagaaatgtcttttaaatatttagattagatacacaaaaattatgtgtagatttgtccccaaagtactttcattataccataataatatcggccctacagacacattatagataattcgtggtcaagcaagttgcattctggagaactgataaatgttttcatgaccaaaaataatatataaatagttcacatggggagacacatattatcatggtcgtataaattttcagaaagtgatggggtaaacattcatatgttagaaacagtaaactactactctattcattcagcttttgaattgattaacaaattccaaatgctaaaaaaaattaaaggatgtatgtggcttcattaccttgaagcattccaatgccgcggttcacatcctcaggctgtctggagtgaacaagcgcccacgaaagcctcataaggctctcattcttctgttcttcattcgcagcctccgcaacctcgttctcacaaccctggtcaacaagacaaaaagtgcacatggcatgacatagattaggacagagaacatgatacgcgaggcaagtgaatataggcatatagcagcttgcaactgaacatatagttcgtttaggcctacgaccacggtagctcgagggtaaaatgggggctaattttgtgattcaaccgcagatgtcgacaatagcacatgatatcaaaatgtttgatcaccgagcgacaatagctaaaacaaacgcaaactcggagcagatggtagcacaaacacagcaatagctagggatttagcggtcaccgaacacctaaaacctccaattcgcgagagcgcgtacattccacagaaaattcgcagccacaacgaaacatccactcacgaagcgggggaaaagaaatggccatactagagccaaacacggatcaacccggagggcggagccaagggttcatgaggaggagggggaggaggatggggtggggaagcttacagcgatgatgtcgcggtcgcaccaggggagggtgtcgctgccgcggaagatcgagcccaccgaatcgaataacttgcctacgtgcgaatccatgccgcgagagcttttttctctgcttcttttttttttctttttcggttggttttttagggggtcgcttgatccgtgggacgccgggcgccgttttgtaggcggtttctgagccttggtggctaaggaaaaagagaggcgcgccgcgtaaacaaagcgaagcatcgatgcgtctggcatgtggggcccggtctacaagtggcgcaatccacgcaccccgccgatgacctgacccccgaggagtactccctggtccctccgtcccataagaccattctatgtttacggtcacgtatggatagcatatagccatccatattttattgaatatgacgatttattttttttatttggtttgtatggatatggcgatctaatttcttgtttggttggagagatatagcatggatgaaaacaaccaaaagttagtgagacccatttatcatataatttttttatcaagatataatcatccgagatcttgttttaaagatttaattgtaacaaatataatggtgtaatcaaatcataaattagataaaacggtttaggagaaaaagtcatttggagcttgcttaacagaaaatcaaaccaaccacagccaatcagaacatgacacatcacccagaccaaaactggatggcttcatccagccaaatcggccggatgcactcatccagtatattgagggaatattccctattttgggctgccccatccaccctgacctccaaccaaacaccacaaaaaaatcgggtggccatctcccatccgagttcatccacccaaccaaacacacctacaatgcggtgtctcacacccgtggttttaagttacacttagattcagataccacgctaaaggtttggagtggtctcacagggtgacagaggttcatgcagagaaaacagtggttgaatggtggttctaggagagagagaagacgatttgtatggtccgggaagttgtagaggagaaaaaggaggaactggaggctaccgacgagacaacgagctagaggttgtcgtcgccatagccagcccacacctcgctgtggcccacgctgccagggagggaggagagggagcccggcggcggtagccaaggaggaagccaactcgattcgcattgatgacaacagctctgaacatatcgacgccatctccgggaagatgccgacgacagcggcagctcggctagatccgacgagcatgatgccagatctgtggacctgtttggcgctcgagctctgctagatccagcaagcatgatgtcggatccacgccagagagctcaagcgccgccgatcccgtcgccctctgccacatggagctcgacgtcggagatctcttcaccaccatgaactgggcgggccacgcctcgtcgacaatgtgaccgaagaaggggaggcggcggcgagctcgagcgggcagagaggagggagaaggggacggaaaattaaatttaattgcactttatttcatttattattatcaaaattaaaaacacgaatattaaggaataacctaatatggtactggtagagtggtagcagaccaaaagatacagaaaattaaatgtaattgcactttaaatccatcttttattatcaaaaataaaaaaggtgaatattagggaagaacctaatatcaaataaatagaaggggtgaggctccgaacccatgttggctagctcacaacctttcggagttaaccggaagacgcttaggtgtttctctttattatcaaaattcactttggactactctctaactagtaatatttttattttagattagatagattacctttgttgtactttggattaccccaaattacttgtctagccacatctactttctaatcttgcaatgaatacttatgtgtaagttgtgaagacatgccggtttatgggtgtcgatgtgcttaaagtaattgtaattgatgtgcttgagaaaagttgttttaggtgatccaaaataaaacaaagtcaaagtaactttgttcaaagtgaaaagataagatgaaaggtgatccaaagtgaaactttgatactaaaatataatcataaacttaatttactcaaattaatttaagccctaccgaaaatttcaatatttaatcatatatttgtctcctataactatataatatattttggcactgatctaaacatagcactctattcgttccaaaatataagaaactttaactagatatgacacattctagtatgatgagcaacaacgtaatgtctcacagaaccatttttgatgtgagtgcttttgtgttctccctttgttttgaaagggaataatgcgagattggtttaatggccacacatggttgcaagcgaacaatgctaaacaaatttgatagtagtttggtccaacaataccttattaatttaagaatcatatcggaagcgtcaataccatcgcacatgttttcggtttacgggtttctaatacaaatatagtactcatatgaactactttcttcttatctatagcaatatattcgtgacttcaaagttattttgctcacttttgaccaagacgcctcaaacttcaaggttgctagactcatggcataattgaattttttatttctaaaaaaaacatatatccctgccgttccaacataactttatttttaacatcttatttgtcccaaaatatgttgcaaacgttgcttagaccatttcaaatgatatttttcttataattaaacaatattaggcatacgtccaatagagttaggtatgaacaatatatggaaacttatcaatcatacggtgactatatatgaaaatttatcagaagaaatgatcctggctagaagctatcctatggaaccaatgacgtggtctatcattataacatagtgggccactgggccataggaaagcaaatgtccaaaccaatcctaaccataactcaattccatgcagcatgcaactatcattatccttctttcctgccatcctccaaattccaatggagtaatctagaaattgtgctgcaatgtctctttattattcacacacatgtttatttttcttagaatatgaccacacacatattttcacaaaaccaaaccacatttaaataaggcattattgatatttatttcttggttttcaaaagaaaaattaaaaaccgttgactgccagtggaatttgattatttttcattttaaaaagtaaaatttaatattttaaagttaaccaatttaccgagcaattaaccttagaattttgcaaggccaaaagcggagaggtttagcatcacatcaccaagagattacgtataatctcccaaaaaagttgtttttgggtttcctaatctgaaaatagatagccaaaaaactgatcccgccaagataaagcctaaattttatccctaaattagaagtggactcttctgctaaactaataaattttcacgttttcctccctttcacacgctttcctgcccccccccccccccagaaaaaacacgcggaatgacagattggagatggcaaacgcgctgtccttctccctcaaatgaagagagcgaaggatgcggggaagggatttcaaaaaaaaaaatcagatatgagaccggttggagcctttttttaccaaaatcctaaaaaaataaagtggactctaacagtttttcctgttttcctccctctagcgtgctctcctagcactccccctgagaaaaaaaaacacgcggaatgagagattggggacggcaaacgccccgtcgctctccctcaaatgaagagagcaaaggatgcatggaagggacttaaaaaaaaatcaaatataagatctgttggagctatttttttcaccaaaatccttaaaaaaataggattgtggatagaataaggagactattggtgatgcttttataaataccgataacaaaattttatttcacagcttgatattcagacagttagaattcgtagcttttataaaaacatatgcttcttccgttctataaaaatgatctaatatatgatataccatattgcaatgttactaatttagatatcatattagtctgtgttttatggaattgagggagtcctcctattttgataaattaaacttatcttggctgtcttcatacaaactcactttttttttctttttaccctttcaggcttcctaaaaaattaaaggaatgtgttctagaaggtccgataccaacagaagtccatctccaagaagaaaggaaacgaaagcagcaacagtgcagcacacggccgccaccctctccccccatctccgccaccaccgcgcacgacaaccggagccccgcattccccggcggctctccggagagagagagagagagagagagagagagccttccaccaccatcgacggagccagccggcgtcatcccccaccgtgatcgagatggcggcggcggcgacggcgacgctgcggtccgcgactgccgcggccgcggccgccgcgggggcgcgcaagggtggcgggctgcggtggctggggacggcggcgtaggcggaggcggagagggagggcggggccggggcgaggtgggagctctcggcggcgcgggagtactacgactaccgcaagtccgtctacggcgacgtcacccaccgcgccctcctcgtcgacgccgtcggcaccctcgtcgtccccgcgcagcccaccgctaaggtcagttagctcctggccctcgtctcctcagtgcgcactgcgatgtgtgggtctcggggtctgatcaatggagttcagccggaattgttggggtgcagagtttgcagtgcgatgtcgctcctgcgatgaattgatctctgaccgtttgagctttgaaccgtggtttttttccccttttgtttaggtgtataagagcattggtgagaagtatggagtgaagtactccgaagatgagatccttgcgagataccggcgtgcgtatgagcaaccgtggggcggatcacggctcaggtgcgaatctgtggtatatacacgcgaaattattgactgccaaagtgccaattcattcatctcatcatctgatctgatacttgtgtaattgctgctgtttatgaactgtaatctgtttaaatcttattctgttgaatgcggtatatatattgcatacaaattgattattatattgatgcaatctgtaccttgattgagtaacaataagttgaacttgctggtattgactattgttctgctgacttttaatgtcatgaaaacctacgctggaagcatcttttgaagtcattgtgaaatgtttagaatttttctaagctggaagcagcttcattcacgtaaacctgcataaattggcaattacatgctttgccagagcacaagcacaaacatcattttacacatgtcagcttataaggttaagggatctgtgtgaactcactgtctttctatctacaaataatgaatcatgataaaagatttaaactgggtattcattgactctgtgtatgtagttcgagttctctttcctatgtaaccttcttccttaacatgttgaagggtcagcacatattcattgtaattcacaatcattcttattggacagcaagcgccccatcacttaattagtagtaactactttcagttcagctgttacttgtttcttattagcatccctagattttgcagataacgacaaaaaggatatgatggtatgcaccttaacaatgatgtacactgaatttctaccaaataaaaaaaattgtggataactaccattctgttgcctcctgaaatgccctttttggataaacaaacaatgggatgttgtatatttggttcaaaaattgtatagacagtggggaattcaacattcttgtgcttagatcaagaacatgctgttgttcatgatgttttcttttcagttgaattccaatttgactgatgtttcctttgtttgttatgttccatgtactgcactactgcgtattttctgttgacggtagttagacagctttaagattgatctcacttcgtatatttccaacttggttaaggtatgtggatgatggtagacccttttggcagcatatagtcacttcttctactggctgttcagatttgcagtactttgaggaactatatcagtactatatgacagagaaggtaagattaactgtgccttcaacgtatgaaaatagttcagcttccattttgtgggcctaatgagaatcctttttgcttgataggcttggaagctttgtgatcctgatgctgaaaacgtatttaaagctttaagaaaggcaggtgtcaaaactgctgttgtctccaattttgatacccgtctacggcctctgttacatgttctgaagtgtgatcactggtttgatgcggttgcggtctctgctgaggtatgtcgacttatattgtcatttcttcagcattatatgcttttccatgcataccatgctcgtgtcatatactcttatctattctgttgaagtcagttttatatataattctcttattcccattaataatctacaacaggttgctgcagaaaagccaaacccaacaatatttctgaaggcatgtgagtctttaggtgtcaaacctgaagaggccgtgcatgtcggcgatgatcgtagaatgatatatggggagctagagatgcaggctgcgatgcctggctatggggaagtgatgttcactctttcaaggaggtatttcttctgtacaccccccaacattagtcattttcttctcttgcaaattgtttcctggcagagttgccatcctctttacaacttgtaaataatttaataacactatgccatctgcatggtttgtagcaatcattcaggagatttatgttagttgctcttacatttatttaataatcaaattgcatcatcaaagtctttgactatgtgaggttcgtttactggctatgtgtgcaactgtgcattgtgttgtcaggggttgccttgacgactgttaatgaaggtacaacagatctttcatgcattactggcacagtgatgtctggcatgagagtagcgcattaaacactactagctgtcaacttgtcattgtttagaagaacctgctgcatttgaggttcaattcaaagccctagaatcatgtgggagatttatcgtttgaagtttaaatcgaagctc

SEQ ID NO: 58165 - DNA, 1132 bp, Oryza sativa
ggcacggcattttggcctggcccaagcatagcacggcccgacggaggtctggtccatgccggctcggcttgaccaccgggccgtgcctgggcccctccaccagcacgttggaccggcctggcacgacacgatgggtcggcagccaggcctgatacaccaaaaaaaaataggggagtaaaaatagatatattatatgccatggacgaaagaatagggatataaaatagacttattttatctatacatatgtcaacccaaagaggaggaaaggaaaatagacttattttatctatacatgttagcccaaagaggagggatgaaaaatagacttattttagctatacatatgtaacagtccaacgaggagggaggaaaataggcttattttaaaaaagaccgccacccgtgccttcgggccggcacggcccgacaactggtgagccgtgcctaggcgggaggtgcagcccatgggccggcacgaagtgccgatcaggccgtgccggtccgatggctgctgggccgtgccggggccgagccaggccgggcgggccttttggccatctacaaatttatccatgttatactttatactactatacatcttctaacaaatggcgttgactttttggcactcgtttaactatttgccttattaaaaaaactacataattatcatttatttgctgtgagttgttttatcactaagtactttcaccattatttatatcttatgtatttgtaaattttttttaataagacgaatagtcatatgttaaaaaattaataacgtcgtatattaaaaaacgaagagagtattaatagcaacaataacaacacaatttcaaactgtattagagcaagtttaatagtgtagcccgttgctggctataaacttttaccatgtcatgaagagttaactttgtaggtaaaatgtacaatagatagctactaccacagtagttaagatgagtagtagtttatcaatatatttatcgtcagtctgtggttgtgttgactgccgaccagctcctctccgctctgctagtgggccccgttttcttgaaatgcgtgtgtagctcagcgactataaatagtcgcccgcttgcgctaactctccatcggggtgcaggaa

SEQ ID NO: 58166 - DNA, 4986 bp, Oryza sativa
  unsure (1)..(4986): unsure at all n locations
ttaaataagagaggtacatggagaaatagttttattttaagataattttaacacttataaatagttatattttgagatagatgaagtaaacattattgtttagtgaaaaaaatatgtatcagcctcccaaaagaagttgattttgtcgagttaagataaagaaaccgaaagatttacagaggaagaaaaaacatatcgccatgggctcctacctattctggtatcagtctcatcttcgtccactttaaaaaaaacttttaaattagtacattttgatgaacgcaagtagtatatgtagttatatatatttaacgtgcaaagaactttgatagtgtaagtatacttttaaatacttataatctgtttttcgaaagaaaaacagtctaaggttgtacattaaaagtatattagtctgatattatccagtacccgatcaatcgatcattcactttccccggtggagaggaagaccagaaaaattttgccccagattgtgggtgatacacattccgttcttattcatacacgccactaatttggattttggtgtagatcccatgactttacgttcatcaaaagtctaaacatacatgcaaaaagagtcatgtgcaactcaataatgcatattaaataatcatacacactgtcccttgtatacagacacatgtactgtacacatagctgtgtgagaattgattgaagcaaacgaaaaataaaaaaaaaacagagaagatcttggatggaatatttgattgagttggcttaataaacgtgtcaacgcaacaattcaactatttctcttgctaatttttctcttagaaaattagatacatctatttatgccccatatttgatatttccttttctgccccaccttaattactccttaccctatttttcattttcctgtccaagtggcttactccaatttcacctaaattgcactaatttagccatcctcttcagacacatgcatcaattttacaggtgtcattatttatgcatgaacttggaaataatatccgagggtgtgtttagttttttgggtgtaaaatttttgaagtatatggacgtacatttaaagtattaaacgtaaattaataacaaaacaaattacagatttcgcctgtaaactgctcgatgaatttattaagcctaattaatccatcattagtaattatttactgtagcatcacattgtcaaatcataacataattaggctcaaaagattcgtctcacaatttacatgcaaactgtgcaattggtttcttttcacgtttttaggcaaaaatttttggatccaaacaaggcccgagtataccaaaatatatctgacttaggttttgttaaaaactttcgacacatttattttccaccgtcaaatgttctttaagattcatgctaccgagataaatataataattgtgcatgcgcgaatagagaatcgaatccttgacttgctgctttgcaagtccactgccctagccacttatgatgctgggtgtttttggaaaaaaaaatcacgttacgtgttagttacatactagttgcattgtgattatatactagttacatttgtaagtttttcttctacaaaactatcgaatgttctacgcgtactcccaaaacttgtctgagtcaaaccaagtagatctgaaaatataacaagtagaagtactccatattgatattattcaaaatgaagaaatagaacatgagaaaaaataatagaaaaaacacacgtctttgcacgttgttgtggccctcctctcctcgtccactccctctccccaagccttcggaattgggaatggtctgaaaaaaaaaaaggagagaaaattatcatcccaccctggcgcctcctctccacccaccgactcccgagacaatgccgccgcggcgcgcgcgggcgcgcggcggcagcagcagccggcgccgctgctagatcccacgttcgccgcgcgcgcgcgcgggcgggctcgccgtggggctcgaggcgacgcgaccaatgcgcgagcacgaacggcgtgggcgagggagaggaggaggaggaggaggacgcgtgtcaccgatgccccccggcgaggacgccgacacggcgtcgtcctgcagcggtgccgacgaaggcgaggcgcaggcgcaggcgcangggaatgagcagcagcgcgcggagcgggtgctccccaatggggacctgtacacggggcagtggcgcgacggctcgccgcacggcccaggaaagtacctgtgggcggacgggtgcatgtacaagggggagtggcggcggggcaaggcgaccgggcgggggaggttctcgtggccgtcgggcgccacctacgagggggagttcctcgacggcttcatgcacggcgccggcgcctacgtgggcgccgcgggggacacctaccgcggcgcctgggccaagaacctcgagcacggcgccggcgagaagcgctacgccaacggcgactgctacgacggcgagtggcgcgcgggcctcccggagggctgcggccgctacgcgtggcgcgacggcaccgagtacgccggcggctggcgcgcgggcctcatccacggccgcggcgccctcgtctgggccaacggcaaccgctacgacggcgggtgggagggcggccgcccccgcggccagggcaccttccgctggtccgacggcagcctctacgtcggcttctggggccgcgaggcccccggcggcgccgtccaccagaagggcgtctactacccgtccccggcggcggcgggcgagtcccgcgaccccagggaggtgttcgcgcgggagctccccgagtgcgtccgctccagcacggaagggcagtcggcgctgccgtcgctgcgttcgctgaggggctggcgcggtcgatcagcggccgcgggagctcgtcgtcgggccggagcatcggctccgtggtgggcgtgccgcacctctggggctccgacggcgaggtcaagcccgacattgccgacgactggaggcgccggagcagcgtcagggaggggaggggaccgccgccgccttcgctggcggcgccgccgccgccgccgcacgtcgacaagggggcggcgccgccgcgggtgatgaagcggcagggggtgaccatcgccaagggccacaagaactacgagctcatgctcaacctgcagctcgggatcaggtgcgtgtgtttctttcccgcgattttctgtctctttgattgcactcgcaatacttcaatttgtttccatgcgaggaatttaaaaatgtgaaattaggaaatctcgcatgaacaatcatgttgtcatctcgtcggtaaacaacgaaatgggaattttgggcgaaatattaggggtgtgcattgaagcatttatctagaatggacaaacattttcagcgacaaaattcatatgcgttggtagtgtggacatcaagaaagaatccgaggccttgcatgtaaagtagtaatgatttgagcacaattcgatgacttggctgaggcatttttgtggactcttatggcattcttatcatcttaacactgcctcactagtccttctatcagtagtttgaaatcctgaaaatgaaatcatatatcatagactccatagacagtactcttacaaagttataaaatgaaattcttatagttcattatcaacgattaatcatgtaaggattatcattgaattttctccattaccaatctttgtgtttacaacatattttactttagaaaccaagattgttattgttttttcagaacttgtagcacttccatatcttttgagaagatgtaattattcgacagtaagattgccatatttctttgtaagctcagaaagtaacttattatcactgagtatgcttattgtacataggcatgcagtaggaaggcaaggccaggttatattagacctgaagtcatcagcatttgacgcaaaagaaaaagtatggactaaattccctccagaaggctcaaaatacacccctccacacaattcttctgatttcagatggaaggattactgcccaaaggtgttccggttggttatcactcccatgatagatacattatagattagtgactgttttatggcttcatccatgtcaacatgcacatttgttctttacaaaatcacaggacattgcgcaagctgtttaaggttgatccagctgactatatgctatccctttgtggagatgatgctctccgtgaactctcgtcccctggtaaaagtggaagcttcttttacttgacaaatgacgaccgctacatgataaagacaatgaagaaatctgaagtaaaggttgtcctttgctgtctttgttcaaatagcaccatttaagcttctatatttagaagttctattctgaatacatggacaaactttgccacacagatgcttctgaagatgcttccagcttactacaatcatgttcgggcattcgaggataccctggtgacaaagttttttggcctacattgtgtaaagttggctggagcaaatcagaagaaggttagaacaatatatgattatccactccgccctcatgaatatgctatttttcaagcataatatgcctgattgtttgctgctgtactactacctaggttcgtttcgtcataatgggaaatcttttctgctctgatcacactattcataggcgatttgatctgaaaggatcatctcttggccgtacaactaacaagccactggcagaaattgatgagtatacaactctgaaagatcttgatcttaatttcatctttcggttgaaaaaacaatggtttcaagagttccaaaggtgctaagtgatacccatacaccttagtgcctaatttctgtataaccatgctatctatcccttgtgctaatgaatttttaaatattttgaagcaggaaagtagacaaggactgtgaatttcttgagcatgagaagatcatggattacagtcttttagtgggtgtacattttagaggtaagaaag

SEQ ID NO: 58167 - DNA, 733 bp, Oryza sativa
cttagtttggtaactaatgatttttaccagtaattttgttatgaaaaggctttaggtaaccttctgcttatccattttaaatatacaagttcactgtagtattctgttgggggtattcattctccggagtagaaagtattttaggtatattatctcactttctgtaatttcttggtaaattgtatttgttatgtaaatgccaagaaatgtaaatcctccaagtatcaaacagatggtgcaactgttcattgcaattgtccaaatggaattttttatgccctatgtatatttgaaaatgctacattataaagtaattcaacaaatctgacttcaggtggtcgaagattaaacttggggcaaacatgctgtcaagggctgaactgacaatcagaaagaatgacactgatgtcgttggacagccaaccgggcagtactgcgacgtgatattatattttgggataatagacatacttcaagactatgatatcggcaaaaagatcgagcatgcttacaagtcttttcaatacgactcgacatccatctcagcagtagacccaagacagtattccaggcgcttcagagatttcatatacaacgcgttccaagaagatcgagcagagagctgaaagtttatctgacaaaatgtagctccaaagtgaggactttgcaaaggccaaagatcaagcacagcgcaggacagcacggcgctacacaagctcgcatattcgattgc

SEQ ID NO: 58168 - DNA, 1539 bp, Oryza sativa
  unsure (1)..(1539): unsure at all n locations
aattcctgcagccctgaacattaaagtttttgtaatactccctctaaccattttatatttgacattggcggtacttaattattcttagggtgtgtttagatccaagggtataaagttttatcgtgtcacatcggatattatatagggtgttgcatggggtgttcgggcactaataaaaaaactaattacaaaatttgtcaataaaccgcgagacaaatttattaagcctaattaatttgtcattagcaaatgttgactgtagcaccacattgttaaatcatggagcaattaggctcaaaagattcgtctcgcaaattagtcgcaatctgtataattagttattttttagccaatatttaatacttcatgcaggtgttcaaacgttcgatgtgacagagtgtaaaatttttgcgtgggatctaaacaggaccttagtagaaagcaagattttccttactatttttgacggggttaccgttatccgatggtggtatcacgattacaacgacaacccagaggttacttaaaaaatttaagatgtttccaaaatcaagaagattacctcacgatgctattttctccgtcccataatataagggattttgagtttttgtttgtattgtttgactactcgtcttattcaaaaaatttatgcaaatataaaaaatgaaaagttgtgcttaaagtactttggataataaagtaagtcaaaaaaaataaataataattctaatttttttaataagacgagtgatcaaacagtgcaaataaaaactcaaaatcccttgtattatgggacggagggagtaccactttagttaaaaaggggtaacggtacaaaattgcaacaaaaggaaaaatacgcagtgcaattaatataggtatagacacatctcttatctcaagttttgcggcgatagtttcttatatactctctccttccctaaatgtttaacgccgttgactttttaaaacatatttgaccattgattttattcaaaaacttttgtgaaatatgtaaaactatatgtatacataaaagtatatttaacaatgaatcaaatgatagaaaaagaattaataattacttaaattttttttagtaaggcgaatggtcaaacatgtttaaaaaaaccaacggcgtcaacggagggaggatttttttaacattgtaaaatcatatggatccatttggtgcatctgtgtgcatgtgctggctgcggctggctgcggctaaaggagaaagtgagctaggagggggtgacgtgggacgccctggaggcggcacgtggcggggggagcaggggaggccatggttgaagcgagcgagcgggcgcgcgagctcggcgtccgcgcggggagcaaaactcccgggtgggaggagagagaagaggaggcggaaaagctttgaagagatccgagtttgcggggggagggggtgctctggatgggggcaccacgtgcggcattgcggtggtggtggtggtggtggcggaggaggccgangtgcgggtgcgggggaggaggaggaggaggtgg

SEQ ID NO: 58169 - DNA, 11283 bp, Oryza sativa
tttgcaaaaaaaaaaaaggttagaaggtgatgtttattacatgattttaattagattattctggtctcatggtaagcaaaacttttcaatggctagctacaaatgccgaatgattttacctccccctcctgacggggatgtggcaattttacaagaagtcattgtttgcacgtagaggaagcgacgcgttgaaaaattcaacaaaaaattctatgcctaacatgtgcatttgtttattgactcgaagctgaaatggtggcaaattgtgattaattggaattttacgacaagaagaggggattctttttattgaaaaatttaatatgaagtcaagcataataacagcagggcatactgtgggccaaaagcatacttgcatattttcatttaagcagatattatatcttcttacactagaatagtaaaatgcatgtatttgcaacatttcagaatgaatttgtctatgctctaataactttgtctgggcaatagacatgcagtaggaaaacaagggccgattacgcttgatttgaagtcatcagctttttgacccaaaggagaaagtatggacaaggtttcctccagaaggatcaaagtacacccctcctcacagttcttgcgatttcaaatggaaagattactgcccgcaagtgttccggttggtcatcactccaatgacttatttgtgtgttatgcctgcatttagcttaattcattctcatcagcggtacaacttgtcctggattgaatcacaggacactacgcaagttattcaaggttgatgcggcagattatatgttgtccctttgtggtgatcaggctctccgggagctctcatcccccggtaagagtggaagcttcttttatctcacgagcaatgatcagtacatgataaagacgatgaagaaatctgaagtaaaggttggtgcatcatgtttagtttgtccagatgctttctgaattcacatctggcacttctgtactaaatctacaaagaacttgccatcatgtagatatttcttaagatgcttcgagcttactacaatcatgttcggtcatttgagaacactctagtcaccaaattttttggtctacattgtgtaaagttagctggagctaaccaaaagaaggtcagtacttaatatatatctgtatatcatgctaaagctaatttattagccaatagattcttattaagcttataaatcaatatgtcatgtctgctcatctgtttgctatattattaccaggttcgtttcgtcatcatgggaaacttgttttgttctgattattccattcatagacgatttgatctgaaaggctcatcacttggacgtacaactgacaagccacaaacagaaattgacgaatacactactttgaaagacctcgatcttaactttatctttcgattgcaaaaacactggcaccaagagttcctaaggtaagtgaggctagtgcaagagtgagtggtcatcacatttttactcgttgtgttaatgtagaagttaaatgtgttcaagcagacaagtcgataaggactgcgactttcttgagcaagagaacatcatggactacagtcttttggtgggtgtacatttcagagacaaaagaaatctattagcaagtgaaggtaagatgaaaaatataatcaatttaagtttttgacatggttgttctataccttacgaagtgcatgggttgaaggttcctttgatagtgatagtagcagagcgtcatcgcctcacctgtctagaggagatactgatccaaacaggtaaaataagatacttgattactcttgctcttgttgtcaatacttttcaggcatacacatgctatacgatcttccatattgagatgccccatatatatgcttccttgatgttcgccttgattctaatgttatgttcaacgggcttcattgcagtagagatatacgatacttgtcatcaagaactaataggcagcattcgttgccaccaccattttacctccttttccttgcacttctatatgataagaaataatttggctgtattgatgtctccaagttctaattttaacatcactaagattctttgggtggacaggttttcgaagataaaacttgggtccaacatgccaacaagagctgagctaacagtacgaaagagtgagtgcgagcctcagatcatcggagagcctactggggagttctacgatgttatactatattttgggattatagacatccttcaagactacgatatcagcaaaaagcttgagcatgcatacaagtcctttcagtatgacccaacatctatttcagcagtagatccgaaacagtattccagacgcttcaaagattttgtgtacaaagcgttccaagaagagaagatagacatctgaaaacacattgggactccagagctaccgcagctgccgacatagatgctggtcatatttcagcaggtttgatgcctctacttgtatatgatcaagcagaagccatcaggctgatcaaggccctgcttgcagacccccaaggaattcagatggctccgattgggacaatggtgcttttcaataatctcagattcaacagtcttttcttcccctgaaaaatagacacagcttcctatctacagctactttgttacaatggccagtctagcatagcacatcaatgccaagctatgcctaaatatagctatatacatgcatatagaatccactaatgttagtgtagatgctgacttgaagattcattcttttttttggcacacttgaagattcaacttacagagagaagtttgtagtgacaaagttcagagatgtaaatgttttatgagataacatgtcgctatcctcttgtttatgtgtgttattaacgagggcatattcgccttatgtaactcatatgaatcattctaaagtccataactttaggagattcttcactgttgaagtcaatggcatgcaggaatatctgagactgacaccatttttgctaccacctctgaaatcaatgaaacgtattgctcagggtattttcttagcattcctgaacctgatatcaacggtaagatggtgtattttagctatgtcacttaggtcaaagtaagcacatactgttgtttttgccgggttgtcagatttcttccaagataatggggaaaattaacttaatgatttgccactcggacccatatgtccgacatatgagtgttagaaatataggatcattaggtgcggatctaggggtgatatgctattttttcgcgaatgcgcaaaaggattgcacgtcaatataggggggggggggttgagatgctagctcatagcaataatgggttgatgttcttgaggggtgagcggagggagagagagagagagagaggcgtcggacttggagcttgatgcggccacggcgacggtgtagcggagtggtgtggtgttggtgtagatgacgatggcggcggcagtgagaacgtgagtaatcccctcacttcaacgccttcccagattggagggacttagggtttgtggggagcacatgtgcatgggaaaaactcacttcgcgtgtgccggtgactccccttttattgtggcgctgcgtgagaggggctcacagccatggaacggctagcgcccccgatcagggcgcttacgtgcgtggagtggggaatcgggaaacaatgagggctcacacgtaattgatacataggtgccaaatagttaaacacttaaatgccaaatctaagagtggcaaatagatattggagatgcaacattttgtgagatgcatcttgtttgcgctaaaattgggagcattcttcattcttcggttttcagttacacagaaactcttcccaattcaaatgctattcattgtcaaattatacatgaggaattaccggccagacgctcttgaagtggacgacatttacttagcatgactagctatttatattcacagtaacataacaaatattacttcatgttgacttgcaacaactgactcactaacaacaacaaaaaaaaaagattgtgtttaaaactctacaaaaattcatgctgaactccctaatttcataagaagaaggaaataataaaaaattacatgggattgggatcaccagaatcctctacatgttgacaacaacatctttgctatcaatcgcagcgaaccagcggtcagtgatccgtcgatgccttgccggcagtcgtccgaacagcttgcataccatcaagcaaattaacaatgtcccagaggaccagcatatgccagtcgcggctgctccgtgtcaagggtatagggctcacgcggcgcttcatgatcaagctccgcctaagaccagtcctaacccaagacattagacatagttttcataaactccacatcatcaataaactactactagacactactctttcaatataaacaccattcttccatacttaaatttaattctacttatctctcatgatatgttggatattgtgtagaaactaccccctccatactcgtaaaggaagtcgttttagacagcgacacggtctccaaaatacaactttaacttcttgtttctataaaaatatttattaaaaagtgatatatgtatacttttatgaaagtatttttcaaagacaaatctattcatataatttttacattttcaaattcaacaacttaagagttattcatgatttatattcctaaggcttgacttaagcattgtcctaaacgacttcctttacgagtacagagggagtatgtcttatgcaagatctgattttattctcttttctcatttttttcgcttgccacatcatctttcatcataggtggtagcttatttaatactatggacaccatcctgatcattgagttggaactggcctaaaagccgcgcaacctctcgatccagcgctgtggccggccgccgccgccattgctcacctcccgctctgctggccgaagccgcagagtcgtttcttctctccgtttggatttttcgtcgacatccaacggtaaaaaatatatttttttgccgtaacagtattgagagacccatcatactttcggcccggaacgacactgcggcccacatgaagcctattgtgtttttggtccggaatgggattgccgcccacatgaggcccattaaattctggtccgaaaggaattacggcctacgcgaggtttctttttggaataagttcaccggaggtccctcaacttaacagcgagatttttcgagaactcttaaccacaaaaccagaaatcttcaccccaaaactatacaaaaccgttcactcaaggtccctaggcagtatatatgagtggtttcgctgacgtggcatcctagttagccaaaaaaaaattaaaaaatacgtggggcccacatgtcagctgcacttttttttcctctcttttcttctccttatcttctcttttctctcttctctatttctcttcttcagtgagggaggccggcggcaggcggagcagcgcgcgcagatgcgggtggcgcagcagagggcaagcgccagcggagcggcggcgggcgcaatcgtggcgggccgagcagtggagcgcaagcacggccgcgggcagagaagcggagggcgagcgcggcggcgggtggagcggcggagggcgagcgtggcagtggagcggaggtgggcgagcgcggaggcgcatccagcccaccccaatcgaccaaagcacgccctttgccctcggccataagccccgccgccaagtcgccgtcgccgtcctcctcgtcgtcgtcgagcggcagcgatgacttcgcggtgctcctcgacgcggagctcgagctcaccttcgccgatgactcggcctctgccggagacaacgacttcgaggaagacccctcccagccttccctccttcctcctcgagctccctcacgccggcgccggcgccggcgcctacagggatgggaagccgacagtgctggccgtcgtggtcagctcgcttgccgcggcaacgctggtcccggcgctaaccggctgatgcgtctgcggatcgatgccctggctcatgagcttgcgcttgatgtgctgttccacctgcagaaccaatcaatcagcaccaagaacacaagaagagctaaccggagcagatgacaacacgttgaaatttgttttgcttacttgttgccgagaagggcgtggagcttgatggtgagctcgtcgtcgtcgtcggtgaaagttgctgcacttgaggtcggggataaggtagttcatcgagtggaggcagcagctctttcggcagcggagcagccccatcgccttggggagggagagagggtcgacagggagagcgcgccgctcatcgggcggcggcggggcccgtggtcgagcacccggcacgttcgaacatctccgccgccgagctcgccgtcgcaccggccgccacctctcctccgctcccgccgccgccgtcgcatcgactgcctctctctccctctccgctgccgccgtccccgctccgccgccggccacttctctccccccggtcgccgcgcctgctcgacactcgagagaactcggagagaagagaagagaaaaagaaaaaaaacagagaaatgtggaacccacaccattgtctcacttacatgtgggccacacattaattttatttttttttctggctaggatgccacgtcagcaaaaccacctgtatatactgcctagggaccttgagtgaacggttttatatagtttaggggtggagatttctggttttatggttaagggacctcaaaaaatctcggtgtaaagttaagggacagccggtgaacttattcctttccttttttccggtccatttttctcggtccaagtgagccttacggttcggtttgtccctcgctgtgttctaatttccactacgtacggtacgacacagcatggcatcagaatggacaagggaaaattacttgcaatggtaataaagctaagcttcaaacacagattgtttatgcaccaacagggttctcatttaatcattttctttctcaccttcatcaaaccaagtgttataaaccaaacaaccgtacaaacgcgtaactctattccttccttttgagtagccacacaaaaatacaaatatatactgttatagcgctggaaatttttgttttgaatggcaccccaccttgacacattacatacaggagactataacatcacactcaagttgctaactcgtgcaaagcgatacgataaaacccgtattggagaacaaaaataaatttacattctcaacagcaattcctacaaatgattaacatggatgggaaaagaataactaccaagaatatacaatcgtggaactgaatgaacatcctaccttggactgtcccaaggagagggcggtttgttgtatggaaaaccctgagaagcggatccatgtcctaaatcgagactgtggagttgttccatcagttgcgacctccgctctttgaagaagtctagcctagttgtcagttctaccaaagtggaggaggccaccattggttgcctcccataatcaacaccctgccatacgataaaaataagaacaatcttcctttggaggatattagtagtgctaaatagagtggctgtgatttccctaacctcagtaaactttggggcattgatagccatagcagtgttatctgttggcatgctcgtcgatgcctccatgcctcttgaatcgcttgaagatgcgtccaaagagagcttgcgggtgagtggccttgaagaaccataaggtagcacatgctgcttgatatttctccactgtgatgagtccaccgaactctcctgccatgccaaaatatgatccgatgttagtcagggatacgatgccaatatcagattaaagcgagtgtgtttccttcagtccttctggtggaaactcctaacaatattatcgtgcaagaaattgtttgggtaccacaacccacacatcaaaatagagcaattattatttgtttaggagacatgatcaatagcagtaatatccgtttccaaaactgaaaatgagtaaaaactaataaaacagtataatagagcattcttgttatgctgatgtgcacaggggtcaagttggacctgaaattcaacacacctctgtgttgttattaagctcacaatgtgtagagtaaatagttcttaacaaacctcatttctctgcttctcttggttgcagaaggcaaggttcatgtcgaatcctggctgaacaaagttcctggcaccaataaaatagtcaaaataagatagaaatcattaagctcagtaaagcatatccaatatgtctcgatacattgagctatcaattagtactgcacagattgttttccagtgaaatgttgtccacaatcagatttcaagtaagcaccagttgcagcataattctgtggctgcatacctgcagccactctttacagaaatggggccacttggatgaaacagaacaataaacacaattacagaaaatcaaaaggtgccaaacctactgaactagcaacatccatccgtataaatagcagtagtaaaaaagaaaacaacaaagttgattacttactgctgcgaaaaatggccaggaatacggtggtaacgatcatttgcatctaccatagggccatactggtgttggcgctgttggttgagttggagatgaagctctgcaaccttctgctttaaccttgcaacatcagcttcagcaagagcaatctcctcaagttcagctctcgtcttgagaaaaacaatgagtgaaaatgagactccgtaaagtaattccataaagtagagcggtcactagaggtaccttcgtgtccatagcacgtgaactagaaaactgactggaagacatgctcaatccaacctccaatgcagctctaagatctctctctgcctgtagttgctcttgcaacctagacacctatcaatatcacacttgtagaaattactatctgaatgtttcagtcaccatcaaatatatcacaagtgttcagccaaaaccaaatgtaagggaaagtatcgttttggttcctcagtctatgggctatgggtaaaagtgacttttgtgcaggcattatttcattttagtccctcaattttacagcatttccaatgcaagggatgaaggcaacctcagcaacaaattaatcaaacttatcgagcctctgggtcagggttaaaaaaaactggtggtaagcagtccaggtcctgggactggttaggggatgctcaccaacaggaatgatgttgagattatatttataatttataattattctgacagttatcagtgcagtaaaatccagtaaccagaaggttactgtatttcactgatgaacgataataccaggattactgatattaggaaccctgatctgattcaacgataagcaaggcccaaggagctatcagttcaaatgtcaacgaggggatccaagtctctgcctggacctcattctgaattgctggaaatccaggcaagaaccaggatttctgtgttttgcatgtaactagtgaacagtgaggtttgtgattgctattttcaaggaatatagacagcgctgatgattcaacgtgtagaaaaagaagagacaagcttcaagaaacacacaaaataaaagacaaatgaaaagaacgctagatgcacaatgtcaataaaactaggcattttccagcaaaccagtgggatgttggatttgaaagaattctaagattcagaacctgcctaagggacaaaaaaaaagggtatctttccccaatatactatagtaaaacatatgcacttgacgaccaagcaaatttgatggtacaagggaatgcaacatacatcctgttccagggccaaacgacgttcatgcagtgcttgtttccttctttccaaacttgcctgtagaattgcattacccctagcctgaagccactccttgttagatggcaagcataaaatagaatattcttatgtgcattttcttcacatacctctttggcaattctgttctgcagatcattctttgctatttcgagcctttgaatagcaagcctggaagtttttatttgcaaagcaaaattacaatcaattaatctatggtatgcatattcaacaaatgaacagcagcggcgtacagtagcaatatcagcaaccagggagtgtccttagcaagttattgatcctttaacttctctggattaggttaggcttagttagcaagttatgaatcagcaagttaaaggattaggttaggggttagttaacaaacaagttattgatcgatataggaaggtttgggtgttcaaggtattccattatgacgactactaagacttctgtttcagcctcattcaaaacaatgttagaccctaggttaatccaacgtttctccatttggataggggaattcctattaatctatcgacagcttattagttgggaatattaaattgagttgttaggggcattatcatccttttcagcaggcaactaggcaagaaatgaaaatagaagtccgtagactctcccttctcagccagaggcctcagtgccttggcagcagcaatggagggggtcaaggaagggcaagtgctagagcattggcaaacatttccacagtcaatatagaatggcctaatgcaatacaactgctcagattcacaactattaacaactaaactcaacgaaacagcactgtaaagtgtaaacaaaaatgatttgttggtgctttagtggcaaagggcttactcttcttcaccagatgagtcgactgattcagagtgttgactctttcttgcctgcataaaacatgcatatagaactcagaacagaataaggtttctaataattccagaaacaacttcaggaacaatatggagccaactaaaccataattcgatggagtaggaaggtggaacagcaatgcactattaatacccagtagctccaaaaaaaaggcagaaaagaaataaacatagctaggtttttcttacattattcctcccccagaagttactgcgtttcacatgtgggtgagatccattgattttggctggctgtctgctttctacagaatattcaccactgtgattagctaaagatattccaggatccaaagaagaaagtatttctcccatagacagtggagtctcatggctagatattgggttagaaggattcttttcactcagcaatgtttccatatatgctgaaccgttttcagctgaatgactttttggacctttgcttaactcaatctgggctgcaggaat

SEQ ID NO: 58170 - DNA, 1411 bp, Oryza sativa
cagggttatattaccatcaatataaccataatagatccatgccgcaagctctaatccataaaatacatggaagtggaaatttacaagcataacccagactggcatgattaaataatactgcaagatgacaaaaacaataagcaagggttctcaaaatattgtttattagtttttctgaacccaggcagtttatcgcttggcgggacattgctgggttctaagtttgcatgcattcaaactcattggctgaccaggtcaaatggttttgagaaaccatatttgttcagacctagcaacaaagatttcacccgagtctttcgtatctgcaatgatatctactggcaggggtcaaaatgggtcatcctatcatatcctttggtcctccaaaaaaactacaataattacatttaaattacatattcacagtttgcagctgaaaatgtactggtgtccaaaaaacaagctcctcatagatgtacaacaactcaacaggaagtcaggaactacttttaatgccctactagtttttatcttcattcttaagaccataaaaaggcatacttatacatgtacaacaataaataacagcagtaataaccagattagagatttaaaaagtaggaagcatatcaaaaccttgtagtcatagaggtcactgccagcgtatccactgctctcactcagttttccactaagtatacgttctgcgccattctcatcatccatttcctgatctacatcattttcagcatcatgaaatccattacccttgacatccaaatttacatcatctgttgatgcctcgctaccgctatcttcaatttgagactctggcgacagggagcatctaaggttgtgttcaccctgtaagatatataaatatgaatgatcaatagattagtgttgtctttatttctagttcacatttcaaaatatgttctacacagaaaagaaaaaggcatagcttccagcagacagattccaatgaaaaagaattagcgcaactgttgatgtgaagtattgttagcttttcgatggataatggtaatatcaacagattgttcacagaaaaggtgaatccacaaaaggagttgagaatcttacatcaaatatactctcgtattcctctaagagagttgtgacaatgccttgagcactgttagcggcatttgcagcagcaagaagctgtgcagaatcatcgccatccatatcaaatacctcatccatttcacattcaccagcaagaagtggacgcaacaacagaggagccatacaggcagcaactgctgatgctgtcattcggttctcggaagtatgagaagcgatagtatacatcattttcaaaattctgcaaataaaatctcaattagaaaaaggagtttttgacatatgattattatccaaattctaa

SEQ ID NO: 58171 - DNA, 1000 bp, Oryza sativa
aggaacctaggtgtgtttcctagtatcctatgcatatgtcaatactcaacagtgacggaatatactagagcaatatcacttagtttaaactgaatagaacacttacgaaaagcttccaataatgctgtacagcaggaagcaggaactggagaggatggtagctctcggagaacatgctgcagagatgtttacatgaacatacagttagtgatagaacggattattcaagctcccagcacaaaaaagaagaggtaccgtgacagagttacctttacacaatcaccaacaatgtgagaatcttcatccggtgcaaactccgtccttcctggtaggggatataaacaggcacaataatggaaccatatgcaaattaatcaataagcgaagacaaaaacaaaacagagctaccaataccatcaaattaacaatactagtcatagaataaactaagaaatggttcaaccttgctcgtattcctgcaatctcctgtcaacctcctctacatctgcagcctggcgtagaattccttccacctttatccctacaagaaaagattaacataactattgtacattgtacagatgctaaactagcagtactccaggttctaaagatggtgctagttaaaaattatttgtgcacccaccatatttctcaagaaaacgcagagctttttctagaaaagaagggcttccatcaatatcctcaagtgcgagaagaattggcctgccaacaactaacgacttgatcggcctcttctctctccctgcaaataattggaaaggcatgagttaacaacaaacaaggttgtaatgagtaggagaagaaaaaaaaatgaaatagcataagtagaccaacaatttgggatagctccatcatatgtgtcagtcgtttcattacgaaagatcccattatgtcccatcacaagagctgctttggagcctgcgcaagagcctcttctaatgctgttttccactcaaataaatcttcagaagtttct

SEQ ID NO: 58172 - DNA, 1601 bp, Oryza sativa
ccccatggcaacaggtttatctttcccacgtaagttggtgacaaaggcatgatacaagcatatctaactttgagaaaagttattctctagataattcctggattcgtatagttcctttgtgcgtacatgattgctagcaagatacttcaacctgattaacctatgttggaaattacagaacatatgttcctcccccttcgcttataatccaagaaaccaagaaataattaatatcacaaaaaagaagaatattatggcatcctctatataatcatggtgtcggcgttcatcaccaaaaatatgtgagtgcctcaattctttgaagaattcaaacagagacacaagagaaaatgggaatatttggactaactttacatgtttacatcacataaacggcctgaaacaacttatgatacatgtgacagaggtagagagcaagaatgtaccctttgatgaaatgaagagaggtccactcttgaaaacctggttagcacactagttgacatcagaaatgtgaacaggacaataatattaaatatactaagagattgcaatacctagcaagtacgtaatatgtatatagacaaacattcaaaattcatagtagatgaaatggaaaggaattgtatatgtatatccgatacatgaccacgttgttaattaactcttgtgtgttcaactctagtgctaactaaaagcatactgctttatgctcaacatgatgaataaaaacagttccaagaattcccaaattaattttctggagaaaatcactgtgcatggacctaacaaagtgaatatgattaggttttcattactaaaagttgcatcctgtgatggcatgataacaaaattagtgttgaaggtaatgtcatagtagtattggaatttgatcttctaaatatagacgaggtgagcgcagcaagtagaatgtagattgatgctaagatgtctatttctatctagctttatcaagagttagggcttggggaactgaactactgaagtcgatcaatttaccatgtcatctgatctgagtttacatgcatgcttatttacaatttactaatgtaatgggaagccacgcagaaagcttaagcacattcatgaaatgcatatgctagacatcaaaccatttagaattccccaaatctagtttcacgaaataatagatgtatctgcatgtgtgagcttcctaaattctactccctccttgtgctgacagctgatcatcttccaaccagatattatttcttcctttcttacctgtgcaccgctccaccctgctcttatcatttttgctccaaattatccttcacggttaccatgccacaaatctcccgccctcaaattctctctccactcggccccaattcacgcgtgtcaccatcacgtcaaaccccacgcaacatctgacacaccattcagccgtaatcagagccaatctcaggtcaaaaccaggcaagcttcacgatgcccccatcgacattcggcaagcatcaaaacctccacaaatgtagttacatttccttatccattgcatgttccggtgattatcctaagctgcattgccagcaccccgccaatatgaccatcggtat

SEQ ID NO: 58173 - DNA, 2092 bp, Oryza sativa
  unsure (1)..(2092): unsure at all n locations
tcagactacggttagatgttttggttggttgtattgaatatactggacgtgtaagattttgtttggttgattgcgtggactttgagtgtggttacctctttatttagtggtagagtgaagttaccactgcaatatcgtatataaaataaaatcatattaattagtatctgatttgacaagttgtattaatttgtataacatnnnnnnnnnnnnnnnnnnnnnnnnnnnnaaatcactgtagaaactgcgattatctctatattaataagctcaactttgtttgacagtatattggtgtaaaaaaagagaaaaagtaaaacaagatggaggagaacggtgtcctcgtcgtagtcaacgacgggcgtccgccgctcaccagccatggaaacgccacatccggtggccacgagttcgccaccgccggatctagtggcggcgagctcgtggccgccgaatccggtggtcctgtggcagaagatggttgctgacgacggcgagaaagaagtggaggcagcagcagcggcaaggaaggagcggaggtagcggcggtggcaatggagaggtgagaagcgttggcagtagcggagcggtggcgctcttctcgccggatttggcggcgggcttcgagtggccatatccggcatcggggagcttgtggctgacggagctggcgaggcgagtggcgatgtcgatgacgacagccgtgcgcggggtggaggcgaatgacggtggccgtgcgcggcgtggaggcgacgacggcggccttgcgccgtgcagaggcgatgacgactcggaaggtactgagcgggtaaatggtggaaaagaggtgatgagatgcgcgattccctctcgcctcctgcacgcacgtgaccccgttctacacgcgctcgtccccgtgcctgcacgcgctccactccgacgaggagggaagctcgattcgggcgtttccctttggcctggttgggaaggtgattttgtatgcgatgagccaagccctggaggctatggcaggtatccaaacatccctccactgcacgcgcggatgcgagccatgcaacatgcaggtaaccaaacgagccccaaatgaatccatacttgctgaaatgagaaggcctgaaacttcttaagttagtccctgatatttattgggacattttatataacattcgatagaaacccgcttaaaactctgttaaatgtaactataatacgactgcaatgtaattacaacgtataattaacttgtaattataatgtaaatagaatatatataagtgacttacattatgaaacggaggaagtaactattaaggacatgtttggtagtactctaacttctaaatttaactttaaaaattaggtctagagtaaagttgtgaaactatataaatttagctatatatctagtttactttaggagaacactctaatcaaattcactttttctggttgagcgaaaagatggagctaaaggtgaagccatgccagacgggctccacgctagctcagctgctcagtcagcatagatggaaaatgtctaatgcagtagaaccgaaccaactaaatacaaagatatgataattaacagcacttaagagttactccatccgctccataatgtaagactttctaacattatccatatttatataaatgttaatgaatctaaacatacatatatgtctaaattcattaatatttatatgaatgtgggtaatactagaaagtcttacattatgaaatggaggaagtattatactaagatcatacaagatcacagtagacagtagcttattgagaccctgtttagatgagataactttttaagtccctatcacatcggatgtttggacactaattataaatattaaacgtagactattaataaaacccttctataatcttggactaattcgcgagacgaatttattaagcctaattaatctatgattagtctatgtgatactgcaataaacattatctaattatgaattaattaggcttaaaaaatttacctcgcgaattagctttcatttatgtaattagttttataaatagtctatatttaatactctaaattagtgtcagagaa

SEQ ID NO: 58174 - DNA, 823 bp, Oryza sativa
gtccaaaggagtcccattaggcaattggtgcggggcaggccagtccaacgaccatggcaaggagtgccatggctgagatggttattgcatgactgcatgctatccatcgtgtccagcgggacgacttcggtcctgatgatgatgaagacaatggtactgaatcccaccatacagcattggttcgaagacctcatgcattactttggccattgtcttaatagtgctaagggtccaccaaagggcaaatcagtggcgacgactaatgagggagggagatcggtagatcgaggcggcggcgttgtagggagaatcggagtaccaattggctcggcttttctgcttgtggttctggttctgggagccacgcccacaagtgaagcacgagttgagccaagcgaggcacagttgtggataccggccagcgtgaggtacgcttggagtcacgaccatcgtatgggcaaaattgctatttagtgatcagccacgcgcgtcccaatcacgttttaggcctgctttttttctgggttgttgagccccctgacattccaatttaagatttttaagccatccatcatttctgaaacaacatgtatctcctatgcatgatcacaagaacatcgaacattctccaatggcaattcattaaaacaagagataccaccttacacaatacatatggggtggtgtagttccttacaattttcccaaaataactactcctgtcgtgcacgaaccatcatgaactactaaagcctagctgaagactaggcatcattggacatgctaagcatccaaacatcaacaccgacagcactaatatctg

SEQ ID NO: 58175 - DNA, 1302 bp, Oryza sativa
atgccattgcaattgaacatggcatgctactacatactactccctccgtcccaaaaaaatataaaaacttaggatcaaatggaacattttctaatactacgaactacgaatctgtacataatgttctatatggttttagatttttatattaattatattctgagatgatgggagtagctaggtgcggcctgttaggttgcaccattgctagctacccacctcccacccactaagtcctccccctccacccacctctcccttcactccctcacctcactacctctcctcacctcctccatccagtcgggcatcaatagtaggcggaggcggcgcccctctcctctcctcccctccctcctagatccgactggaggaggagagggcggcggccacagcaaccggcggcgcataggcagcgctcccctcctccctctctccccgctcctagaaccggccggaggaggaaagcggtggcggtgcccctctcctctcctcccctccctcctagatccgactggaggaggagagggccgcagccacagcaaccggcggcacgtaggcagcgctcccctcctccctctctccccgctcctagaaccggccggaggaggaaagcggtgccggtggcagtggcggtggagatggaggctagctgcactcccctccctctctcctagatttggccggaggagcaacgacgcaggcccctcccctccctcccagatccgaccgcaagaggggagccgtcagcgacggtggaggcgatgctccccctcccctcccccctccctccctcccgcacagatttggctgaaagagggaagccgacggtggcggcggagtcggctctcccctccttcccagatccaaccggaggaggggagccagggagccggccggcggtagcggcagaggcaacgctcccatcgggtggtggcggcggatggaggaaaagagccggaggtcagagggggagggcagcagcgggggacggagaaggagaaccggtggctggaggggggaagggtggcagcgggggattctttttgttccgtgagattgttttttgcaggcgagtggatgtagcagcctacgaaagtgactttttgcaggcggggataacgatcggatgcaaaaatcgtctatttttgcaggttttgaagtgcaagcggggctaatggccgcctataaaaatctttttttcccgtctgaaagaaatcagtcttctagtagggaaatatgggttgattttttttaagacaaatggcctatggtcaggccggtcataagggctgcaggaat

SEQ ID NO: 58176 - DNA, 1586 bp, Oryza sativa
ccgccagtatcgtctcgtccccccacgcgcgcgcgcgcgcgtgcacaacgatcgacttcgaacgccgcgccgcggccgcaccgatcgatcgatggcgccggcatcgacgacggcgacggcgacgtctgccgcggcggccgccagagccatctgcgtgctgctgctgctgctggtagcggtcgtcgtggtggcggggcaggcgccagagccggagggcgacgatcaggccgcggcgatcgaccaggcgggtggcggcggcggcggcggcggcaacaacaacggcacggccggccgcgcgagaggcggcggcggcaacaacaacggcaccgggcgcgcgagggacggcggcggcgaccgcgaccgtggcgcagacggaggcggaggcgggcggagcaagctggcgagcagcatcgactgccagatctgcgaggcgacgtgccgggtgaagtgcctcgtcaacagcctcttccagtggggcggatgctaccagcgctgcaggtccgacaactgcaacgactggtgcaccagaggctaacgtaacctagctgatgaacggatccatccttcggatcggacggcttgcgatcgtttagccctcgatctgacggttacagctgcagtactaatttttttggacaaagatgatggtatataccagcttgttttttttttcaaaagatagaaaatggtattacttatgtgctcaggatagatccagcatgggtgtgccagagggacttgagtcctccgtgcccactagatcatcattgataaaaggagagagagtcgaaagaaaaagagagataggaggaagagtaggggttgaaggaggagatgaatttcctctctagttttattctagattcgcccctgatactcataatgttggaattaatgaatgggccttagcccactagaagattaattctttggaaatcacaaaagcccacctcatggaatggcatgcatgtggagtttagtaccaccctgcttattctaggagagggggacctccttaaaagggatgatgcccttctagccacttgaagcatgtgtggtggagagaagagggggaacacacgcgcgcgctcgctcgcctggcctggtaggcgcgcgtgcacgacgtacgcgtcgaatggtccgccaaaattggttcctcgccttgcgcagatgcagcctccttttgcagttttattttgctgcaaattcggattcgtttttgttttggaaacgttccgaaaaatccggtgcgtgcaaacggcgtggagtccggataagttacgcgcgacttatccggttcggttacgcgcagtggagatcatgcgggcgccctgatcaagcgacccttctctatataaaccgacccgccgtcttcacgcaacacacgcgaaatcaatctagggtttgcctcctactctgtgctgcgccgtcgctcgtagattactccatcccgctcgccgacgtgcacctacgatcgggagagtagatctccggaacctctgccttcgacgtcctgcaccgggagaaggcggcaataaagttttttgggaagcgctttgcgcgactgctccctgttcgtccgcgac

SEQ ID NO: 58177 - DNA, 1533 bp, Oryza sativa
  unsure (1)..(1533): unsure at all n locations
gcaccctatcgaacaaccgcggttcgacagggatacctatcgaacaaccacagttcgacaggtacatgtcgaactacgtgagttcgacagggtaggtggtccaaaaacaaataaaaaattacatgaacagtatcactacaatactaggcagggacatatcgaacagccaaagttcgatagggttgcgtgaacagcgcgctacagtgatgctacagtgctcgcaggcacatatcgaactgccatagttcgatagggtattgtgaacagtgtgcaacagtgatttttctgattttttaattattttaatcacctgtcgaactaccgtagttcgacaggtaccctatcgaactgtggttgttcgataggtaccttgtcgaaccacggttgttcgatagggtgataaacttgcgatttcgcctaantgacctatagtnnngngattntccattaaaatcatattacttttaaaaaaaattctgggtacacacatctagtctgagctccacctctccacacaaaaaagtattatctattaacacatgattaattaaatattaattaaaaattaaaaataaattaatatgcttattaaaacaaatattttttagaaaacttaaaaaagatcatttagaggttaaaagtgtgcaagaaaaaaaaaagagagatgtgagctagaaatgaaggggaagaacatagccgtagacactccttaacttcaagctggctgcttagagaaaggatacgatgacaatgtccaaaatatgtttcagtaaactacatcagcatgatatatttatttatatacatcgaaaataactactgtactaattacctcgtgagcgtatatgacattgttgattattattttacttcctccgtttcaggttataagacgttttaactttggttaaagttaaactgtttttaagtttgactaagtttatagacaaatatagtaatatttataatactaaattcagtgacggacgtagctttaaaatatagatggggcggagaacggagatgttcactcgataagagcattcgaacacaacagatatcatattaatagttcattcgcataactccctcaatttgttgggtgttcacaccttgttatatctaaatttgatggcccataactactataagggggtaaggggggtcttgagggttgacccaccccacctaatgagtagatccgcctgacggagcgtggggctcctcaccgggagaccgcgcaggcccccctttgccgattcggccgggggccctgggtgagattctaagctcctagtctgtggaaagttcgcgagaatggaaaaagcacaagacacgggcgatgtatacaggttcgggccgctgagaagcgtaataccctactcctgtgttctggtggatctgtgtatgaagaagctacaaagagctggagagccagagagctcttattctaaaaaccctcttctcctttttttttctctcgtgggatctcctctctagatcctcccccctcaaacccccctcttaagtggg

SEQ ID NO: 58178 - DNA, 14073 bp, Oryza sativa
attcctgcagccgtgggaacacggttgtcttccggcaacataaccagtgtcagaccagtcacagaccggtcacctttgtccaccacgtgtcagtttagcaatctgcatgttcgcccttcttcatacaacgtcttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccgagggggttaggccacgtgggtgatcgtgtctgcctcaagtctctaagtcatgatactcccggtcccatgtcaccgacagtagcccccggcgttatgccagggcgattgccctcctcgagggaagcggtcgggcgtgacgccacttcctaaggcctggtgacaggtggggccggtctaaaaatcgggacaagccggttcgtttttcctggagatatggtgatggcgctttggtcggcgagcgtaattaacgcgcgcacgatatgttccatctcgactgccacagccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgtcctaccttcgccacacgcgctcgctctcaaacatctcttcttccggcgtcatggcacggggctccgctccgcttgacggtagcgtgctgccgccttcccgcatcgtgagcgagagacaggccgggctgccgcgccgcttcatgccagaatctgccaccggccgggagatagtctcactgggcgagggatgccctgcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggctacgacgccgtcctcgaccgcctggcgggcctgcgatcccaggggctcacaggggccatggtgttcggcgactatcttcgtcgccggatcgcgccactccagcggcgcgcccggggcgcctgggagtacaccgggtccgaggactgtatgaggacccaccggggggtcaaatgggactgggtccccgaagacttcaaggtaatgatccaacgggtgctgaatctcagctccgcggaggcatccctcatcccccaaggagtcctccccctctgcagcgatccagatcgcgccaacatcctgtccatcataatggcggcggggcctcagaggaacgagctcctaagggccatgacggtgcgagcgggagccacaagggagatcaatctaccccaggagggggttgtgcttccgggccccgtgatgggggctcggggggcagccgccctgccgacgcccgagggaagaggaagcaagagggtacttcctccccatctcctccccgagggggcggggcggcgcgtgtcagcagcaggcgcccggagggggccgcgccgacgccgcagcccgagggggagcggaagaagaaacggctccgcaagatgggggggacagaaccatcccggggaaacctcatttcccctccaaggtggtcgtttaaccgaccccctcgcaggttcgtcccacgcccattgtggctgtattcattcttccaacacaagttttcattcacccatcttgtttgtcttctggcttttcttctgcttcagcgagatcccgtcgcgtccttcttgccaattcaagtccggccaatctgaggccgagaatgcggcgaccacggaggctcggaggcgggaatctgaccggcgagaagccgcggatcgcctacgggaagccgaggaggccgcccaggtggccgtccgaactcgccaagctgaagaagccgctcgggaggaggccagacttcgccaggccgaggcggcgacgacttccgaggcagctcgcgacgaggccgcgggcgcatcgcttgggcccactccctcgggcgacgctcaggacaagccaggtccgggggacatccctgaatccggcacgtccatcggcgggccgagccgcgcgacatcctcaccgaggcggctctcccccacgccttccgctgccccactgagcgcagagcctcttctgcaggccttggccgtcgctaacaccacggtgttggacgggttaagtgcccagatggaggccttgcaagcagagcgggtggagctcgacgccgcatgggcacgtgtcgaagaggggcgtcgctcggtggaggccatggtggaggtgggccgcaaggcacaccgccggcacgtctcagagctcgaagcccgtcggaagatgctgggggagatcgccagggaggtggaggaggagaggggggctgccctcatcgccactaccgtgatgaacgaggcgcaggacgacctccgccttcaatacgggagctgggaggcggagctagggaagaagctcgacgccgcccggggggtccttgacgctgccgctgcccgagaacggcgggcggcggagaccgaggtggcatcccggcggcgcgaagaaacccttgaggcccgtgccatggcgctggaatagcgtgcctgcgtcgtggagagggacctggcggaccgcgaggccgccgttgctattcgggaggtcacactggcggtgcacgaagccgcctgtgccgaagaagagtccgcactccgcctccgcgaggatacgctcaccgagcgggagcgagccctcgaggaggccgaggccgcagcacagaggctagcggagagcgcgtccctccgcgaagctgcgcaagaggaacaagcgcgtcgcaatctggaaagtgcccgcgccgagagggccgcactgaaccagcgggccgctgaactcgaggcgcaggcaaggaagctggatgcaagggcgcgtagcggcggggcggccacgggcgacagcgacttagccgcccgcctcgcagctgccgaacacaccatcgcggatctgcagggcgcgctggattcgtccaccggggaggtcgaggcccttcgcctggcaggcgagatagggcccagcatgcttcgcgacgccgtgtcccgtttagaccgcgccgggcggcaggcgagtctctggggcgggcggactgtgaagtacgccgccaaccaagggggcctcgcccagcgcctctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatcctcagttttttcttcttttctttcttccaaggccttcgggcctcctttttgtatagattaacttaatctgcaatcaaaataaagaaatttatgtgtcaatttcattttgctatgtgtatgagatgaggatgatctgtgccgtggtccttttatgtcttaacttgattaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgattcccccccggagttcaccacgccccggggcacggctcggttctgggccccttttgacgattttagccgacccgagcccccgagggcaggattgagcacaagtgacctatttcaagtcaagattcttcaaaaggaaacaacagcacagatacagcctttaggaaatcgaaaatgcttttattgaaatacagatagaagaaaaaatatgcatatgtggtagcccccggccaaccctgcacgcctgaagggggtgcggggttggcccgagcccgaaacctgacacccgaactccattaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgtgcccggacgtggcgctgatggtagcgccgcaggctctgctggtagcgtgcggctcggagggccgcgcgccgccttcgctcttccaagtagtcgaggtcatctctgcgaagctgatcttgatcaacctcgcagtacatggtggcccgaggggacttcagggtgagctcggatgggagaaccgcctccgcgccgtagacgaggaagaaaggcgtttccccggttgctcggcttggtgtggttcggtttgcccagagcactgctggcaactcctcgatccacgaatcgccgtgcttcttgaggatgttgaaggtcttggttttaaggcctttgaggatttccgcattggcgcgctccacttggccattgcttctggggtgggcgggtgaggcgaagcagagtttaatgcccatgtcttcgcagtagtcaccgaaaagctcactagtgaattgggtgccgttatccgtaataatacggttaggcaccccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaacggccatgaaagtggtatgatctgcagtgcctgggccggctgatggatttgcttggcatggaactgacacgctctgcatcgccggaccaggtcgaccgcatcattgagagctgttggccaatagaaaccttgacgaaaggctttgccaaccaaggtgcgcgaggcggagtgggctccgcattcgccttcatggatatcagcaagaagctcgacgccttgttcccgaggaatgcacttcaggaggattccgttagccgcgcgccgatagagggtcccttctatcagcacgtagcgtttggagatgcgctggacgcgttcacttccttcgcggtcctcgggtagagtcttatctgtgaggtatgcttggatctcaacgatccaagcaatcaatctaagggagctgggagcgctcccctcgggtcccgaggcctggactccgacgggcctcgggggccggtcaggcgcgtccgtctcccctaaggggtcaggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgctgtacttggcgtacgtaagcatccatctgcgggtcagagcaccggtattccttacagacctggttaacctagctgggagtcgcctaacaccaggaggcggcggatccccagtccagctgccaccctgagtcccgcaaggagtccctcgtactctgccatattattggtcgcccgaaagtcaaggcgaaccaggtatctaaggacgtctccgctcggcgaggtcaatatgacccccgcaccggcgccctgaagagacagggagccgtcgaactgcttcacccagtgggcggtgtgaggcagctgcgaggggcccgagctggcctcggggactgagacgggctcgggagccggggtccactctgccacaaaatcggcgagggcctggctcttgatagcgtgacgtggttcaaagtgcaaatcgaactcagaaagttcaattgtccatttcaccacccgtcctgtaccctctcgattatgcaagatttgggcgagggggtaagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcgatggggccgatcctcttcgccaggggccgcatccctggggcgctcttcgtccaagcggcctcgcggggcgcacttgtcttctgtgctgacgacctcggggtcggaggacgacaggtgcggccttcccacagtggcctcagggccgtcctgggggtcgggggctcctggcgtcgtcggacaagcgggcaaagggtcaaccccggtcatcgggagccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggagcctctcctccctgctctctcccgggccaagccaacacagggtggggattcgcggaatgagggttgtcctcatcgcgctccacaactaacgccgcactaactacctgcggggtcgccgctaagtagagtagcaagggttcacctggctccggggcgaccagaactaggggagagctaagatacgccttcaactgagcgagggcacgttcagcttcctccgtccaggtaaacggcccgaagcgtttgaggagcttaaataagggtagcgccttctctcccagcctcgatatgaaccgacttagggcggccatgcaaccggtgacgcattgcacatccctaagcttgctgggggggcgcatccgttctatagctcgtatcttctcggggttggcctcaatgcctcgggcagagaccaagaacccgagaagcttgcccgcaggtacaccgaacacgcacttatcggggttcagctttatgcaggtggagcggagactctcgaaagtttccgccagatctgaaagtaaagtttctcggtcgcgggtcttcacaaccaagtcatcgacataagcctcaacattacgtcctatttggctacccaaagaaattcgagtagtacgttgaaaagtaggacctgcattctttaacccgaatggcattgtcgtataacaataagttcctatgggggtaatgaacgtagttttttcctcatcctccctagccatgcgaatctgatggtaaccagagtatgcatctagaaaacacaaaaggtcgcaccccgctgtggagtcgacaatctgatctatgcgaggaagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaagcttgacgttccggggcctgccggcgcactttctgccggaccggctttgcgcccggccgcacggcgagacggtgctcaatcacctccctggggaccccgggcatatccgccggtctccatgcgaagacgtcagcgtttgctcgcaggaaggagacgagcgcgtcttcctatttgccatccagaagaccaccgattcgtgtggtcttggacgggccgtcgcccagggcaacctccttgaccgggacctcgtcgcacgtgactatccgctgcctcggggcggcggggacggaggtgccaagcctctcgtcgccaccctcgggcttggacgcagcggcgaggtggtccgcgcgctgctccatacaagcgagcgcgactttgaggtcgctatggacagagatggggccaccggggcccggcatcttcatctggaggtagacgtaatggaccgccgccatgaacttcaccaacgcgggcctccctaggaccgcgttgtagggcagactgaggtccgccacatcaaagttcacccgttccgtgcggaagttggcgcatccaccgaaggtgaccgggaggtcgatatgacctagcggccaagtgtgccccggcgtcacaccgataatcggctgggacggccggagcaccatccccgaggccttgatggcgtcaaaggctgcgggggaaaggatgttgagggctgctcccccatcaatgaggacacgccccagcttcacgttgcaaacagtgggggaaaccaccattgcgacctgtcctccccgggcaatgcacggtgggtggtcggtctggtcgaaggtgagggcaacctccgaccaccgcgcccggcgcatcgcctcatgagtaggggccgcggccagaagctctcgcttcatcgccttgaggctccggcgagaaacgtgagcacacgctcccccatcgacagtggcaatggtggccccaggctcttggaaacccaggtcatcatcgccgtcatcgatgtcctcggcgggggccttctgtttggcctctcttcgccgattgccggaaggaaccgccggggacttgccctctcggcgctcctgcctcctctcctcctcccacttcctcgtccgctcagccaaacttttgactgcacggcagtccgcgaggtcgtgaagggaggtgttgtggacggtgcaccacttgccggttgggcgctccctgctgggagcgctggcctcctttttgtcgctcgcaggcctcccctttcgggtggcccgtgaagcaccctcgacggcgaggacatgaccctcgtcgtcggaatgggctgaccttttcttcctcctcctgtcacgccgccctgtccgagcagcggatccgggggcggccgaagctgccacaccggaaccggaggggttccaggtccatgactcctccttacgagccactcggtccgcgagctgaaaaagctccgcggtagtctggggctccttggaggcgatcttttcgagcatgcggttgtgccgcacaccccccctaaacgcgtagatcaccgcgtgtgcagggatgcatggtatggtgttgcggacttgacagaaccgctgaatgtatgagcgaagtgactcatcatcccttcgctgtactgcgtgcaagtccgcttcctcacctggacgcggatatgtgccttgaaagttcatggtgaactgttggcacaagtcctcccaagagtggacggacgcgggtggcaagttcattagccaaccccgcgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcaccacaaaggctctacagccgacaccaccaaccgggggcacggagggctgatccccgcgtccgtgttgaggtgacactccggacgaggaggcgccctccgttgcgtgggcagcacgtcggccattacgccggcgctcgatactgatgcgggcatccggctccccacgcagatcttcccgggtcggaggcgctgacgaaggagtggcggccgaatggcgaacagcggccgccgctcgccgcgccctccgtcttgacgacgcggagccggtggtagcagtaccagaggtcttggtggcggaggaccgcccaccagcatttaggcgctgccgcgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcctcccgcctaggactttggcgtggaggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttagaaaaacacacgcagacccccctacctggcgcgccagatgacggagcgtggggctcctcaccgggagaccacgcaggcccccctttgccggttcggccgggggccctgggtgagattctaagctcctagtctgtggaaagttcgcgagaatggaaaaagcacaagacacgggcgatgtatacaggttcgggccgctgagaagcgtaatagcctactcctgtgttctggtggatctgtgtatgaagaagctacaaagagctggagagccagagagctcttattctaaaaaccctcttctcttttttttttctctcgtgggatctcctctctagatcctccccccttccaaccccccctcttaagtgggcaaggtcctccttttatatctcaaggggataccacatgcaccacttctccctctctctctttttgggtgggggcccatcctatctatagtaaaacttggcttgccttctcttggaagctgaaacactgcctgtttttgagtgtggccacgcgtcctcgttcgtctgacctcggagatcaccctgtcatctcttcataaatgggcggagatttgcaacggctgctgcccgagtgacccttctgatgggacggcccatatctacctccactccgccggaagcaggtgcaacgtgggaacacggttgtcttccggcgacataaccagtgtcagaccagtcacagaccggtcacctttgtccaccacgtgtcagtttagcatctgcatgttcgcccttcttcatacaacgttttgcttataatggttgggataaagcctggcatatatctgaccaggaccaacgtgccatctccaggagctagcacgctggctccggctagggacgagtgcctagagactctcatcctgacgggacggggcgaggcgtgtgtcagatcgcctgttgcctcctaacccgcaatctgaccgatctgtgaccggtcacagaccggataaacgagcgtgccatactgcgctacatgtggcgtgacgcgctcgtccaaaccgcaataaatgcggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgaccctcccgagggggttaggccacgtgggtgatcgtgtctgcctcaagtctctaagtcatgatactcccggtcccatgttaccgacaccgcccctgactaaattagtgtcatcaaatcaataattgaatgtattttcataataaatttatcttgggttgaaaatgttactttttttctataaacttaatcaaacttaaagctgtttgattttgatcaaagttaaaacgtcttataacttgaaacgaatgaagtatttcataagcttctctacgtgcaccatgtttttttttagggagtgcatcatgtttactctaattttgtagatcatatactatttcatctcaaaataataggataagtctccgaaatctcaaatcccaccgcattatatatttattactcgcgttcatcctcatgagcgcaaaaccctaattatccccccccccccccacctttcaaatttgttcgcagtcttaattaacatgttctctctaaccactggaagagaactcgatcggtcaggtaccagagccgcaatctgttcttttaatgacgctagaggtgcaccttttcagcaatatttcgtaacgtcactgaccgtgatgtttaacccaactatacatgtgctaattattggaattacgaaaatgagtaattggtgtgacgaataatcagcgttgactggtctatttaattaatgctctggctctacaaattgaattagacttagcgctcatatagtcgtatggagtactccctctttttgtaaaaagaaataatctaattccaaatatataatctgaacatgttcagatttatctttagaattaattttttttatagagggagtatgttatttttggatttgcttaattaaagcacaagctactattattttcgacaaaatcccagctcaaattatatttttcatatcattaattttacggttgagcctatagtttgttcgtgttaaattaactcatttttcaagtattttaacatcgtgtgtgactgtacaattaatcaactattaatgcacatgtacagaagtggcatactggcatatgtagatctcgatccctccccacgcccttgtatatcatgcattaattaattatatcatgcaaaagcattaaaattctagatctgacagaggttcaataataattttttaatgctttgtatggttttatggaaaacaaatactagccggtggataggacattaatatgcatgggtaaataaagatggaggaaaaaatcaaagtatagttccctagctactcggatcctactataatgatatggaattttaattaagaatattaattattagctgagtaatatataccactcgtcctaatatttaatggttgccaagctaattgaattgctggagctgaattgattagctggtaatattttctatagataggacgttgttaaattctgccatttgggctaagacatagtacattcaagcacaattaatggtttagccagaaaacacaacagaattgtaaacatctgtaaaattatatatacgtgatgggtttaccggcctgtcggaaaccattgttaatttgttagtaaataaatccctttatctcctcaaaagtatcatttcagtactagtaaatttattcatgaaattacttactaattcctaatgtgcacgatatacgaattctgctatagttaattaattaggtcgatcgatccaacatgaaatctcctttttgcttcattaatagaaatagtatatttatttatggtatcattgttttcttataattttcagagggctgcaggaa

SEQ ID NO: 58179 - DNA, 6259 bp, Oryza sativa
aaaaaaaactgtatttcaataagtttagtacttccctgcaaataatggacatcattttagagtgtcttataatccaggattttgattgagtaaccccaagcgaataatgccaatactttatagtgttgacaatcttgttaccaaaataatcatgttagctccaacccagtagtggtcttgccgtggtgactggtaattgcctcgctagaagatgggctagctagcaacataatgcccatacctgtacggcgtctacaaatacatttacgtactctattcgtccaaataattttatcttttatatagaaatagactattcccagatataatattaatttataagttacggagagagtgcatttgttggcatatggtctacactctctctgcattgccatacaagctatgccaggcaagcactgaacaattaactcatggtgttgttcggcagacggacgcgcgctgcggccgcaacggtactgttcaagctgactgtggtgcagccatgcacaaacttaggctgtgttcgggaggcgaggttgggaaccttgcctcctgacacggaaaacgaagcacgtgattatagtgagactaattaagtattagcctaaaaaacttgaaaaatggatcaatatgatttttttaaagcaactttcatatagaaaactttttaaaaaaatgcatcgtttagcagtttgaaaagcgtgcatgcggaaaacgagagaagtgagctgggaaagaggggtaaagaacacagccttaatagcccttatgggtgtctttaggccatgttcaccctcaactttcaactttccatcacatcacatcacatctaaaactttcctacacacataaacttttaacttttttttcaaactaccaactttccctaaacttttaactttttttcaggaattaaacacatccaatatactaaaactctatatttaaataatactactatatgatattattgagtttattggatcttgatatactttagtgattatctttctataagaatgtgatgatagtatctaacacaattatgttattgtaaaaatacttataaagaaaatatagattttatgttttcaaactaaatattttgagagttaggatggtcagagttttaaaattttacttatctaaaattaacagtggcatacatttatcaataggcggagtaccgataatataattactttgagagaacagaatgtacattaattaagtagcattagtaataaccattttaatttgccggcaccaacctcttaattactgtaaagtgagagtagtttaattggttaggtttcttgtggtggaatcagcccattcgagttaggacctggacttagacatcgatgctcgtatttatggctaaacctgttagccgtcgacgataagacaccatatggtgatttcatcaatctgaagatataccgatccaatctcttaaaggtgttcatagatataagatatgcaattgttcattaatagagatgaatgagcatctgctttatattctctccgtcccattataagtgaagctataagttttcgtgcccaactttgatcgtctgtcttgtttgaaatttttttataattagtatttttgttgttattagatgataaaatatgaatagtattttatacgtgacttatgtttttaatttttttttaaaaaaaataaataagacggacgattaatgttggacacggaaaatcatggatgcacttaaaatgagagggatatagtactatatttttttaaaaaaaaactcttaattaccaacgcacgactttctcgcaccaggccaattgacccttccttacccacatatacatgcagatgcggtcatatctcatagactcatactacgtaccctctcagtaacggaaaggtgtttgtcttctggctaactgctacagtgttacttatatacgtatctctcaacttgtgaaagtctgaagctgtcgctgtgccgtcgctgctagttaaaaaaggcttgccttggactttttccccctcctcccatgatcccatccacaccacacgcagcaacgcatccacacgctggatgctgctgctgctgctactcctgctgccgtgatcgatgatgacgcggacgccacgcgcgcgaggcgcgatcgatcgaattcgccgtcgactttgaccgccgacgtggcggcgacgcgcgcgttcatctagccacatagctaagctagcttacttcatttcatttcaagatataagacgttttgactttaaatttaattaaatttgtaaaaaaaaaatagcaatatttttaactaaagataaatttattgtgaaaatatatttaattattgatttgataaaactaatttagtattataaatattattatatttgtctataaattttatcaaacttaaaataatttgactttaactaaaatcaaaatatcttataatctgaaacaggggagaactacctagcaaccttgccttacttccaatggcgcgcgacacgcgcacgtcgacaaaaacctaccccttctggtgggtgtacccgatcattccaatgcatattaatacctctcttgctcagcgccgcgagaccagtaaaccctagcaaggttatttcttcattttttgtactttggattatttctgctttgcttgccatggccgatgatgatggctaccgatgccagcagcggcggcggcggcggctggtgcagaggatggtggcgtgcttcgggatgttgtcgcggcggcggcggacggtgaggctggtgctgtggggaggcgaggtgcgggcggcgaggcacgggaagatggccgggcaggtgatgctcgacttcacggacagcgtcgtgtgccgcgccgacgggttctgcatcggccgcccggcgccggtgctggcgatcgaggaccgcctcgtcgccgggaggacctacctcgtgctccccgtcgaccgcctcccgcagggctacgacgccgtcacggccgcctcgctggccgcgctctcctacgacaggggcggcgccggcgccggcgccgccggggcgacgtccatcgccggcggcgccaagagccccttcgagtacgtcaagggcgacgacggccggacggtcatcaaggtcacgccggagttcatcgtgagatccatcacctcctcgagaccaataggcgcctgcgccgccgccggcgacgaggtggtggagggcggcggcggcggcggcggggcgcagctgtgcagcacgccggagctgaggaagcactacgagcagctggtgggcgcggcgaggtgccgcgcgtggtcgccgaggctggagacgatcaaggagcgcaagggcgccaggaggatcgtcgtggcggcggtgagccccgggcggctgtcgccggtggcggcgaggctgctcggcctggaccgaggagcaagctagctaagctgatcgatcgatcagaaagccttgtaattaattaagctcaaaatttccgttcttgattgccgcttgatttgttcatttgatcagattgctagctgctcctcttgtttaatttggcagcaactaattcattttgatctgaacaaatttagcgatgaatttgaattcggttattattggagagtacaggtatagttttaggagtttgcttgggatcgatgtatgatccgtgtaattgaattgaaaaaaaatataaatgtgaattaatatgcaccgtcaattaattgtcacattatcaggaattcatctatgtgcaattaagctaggtacatcgatcaccgacgcgcttggcgttgttacgtcataccaggtactccgtagtccgtacgtgcgtaattagttagcagatttgcattattgtactgacccgatctatctacattacgattttgttcgaaacagcaaaatttaatgagaactgcgtgctgtccatttcaagttttcaactcgaatttttttttaaaaaaaaaagagagagagagaaaaactgttacgctgcttggattattggaccggtcaatgtaatctccattggggagttaggagatgtgggttggtggtttttatgttgttccctcagttttaattgctaatttatgcatatcaccacgtgatcggttcgattaattcggcgtggacataagtttggttaagttgttttttcgcacgtgattgaattaattcagttgcccaaaatagtacggctagctagatggactggtagagtcgtagagaccgaggggagctgtcaattggtgtttgattaattagccggtggttgctaaatagctaattgtttactcaatcagcatgtagctaagtcatgcaggacgttctgatctagttatatttgttggttaatttataagttctccttcatttagaaatgaagctactagtgcacatgcggttcatgcacatgtgtgtgaatcatgaatccgcttcaatgtaacacgtgccacaaagcccccgtgcagctatgaagagagcatatattatcatatactccttccatccctaaatatttagcgccgttaacttttttaaacatgtttgaccgttcgtattattcaaaaaatttaagtatttattaattttttttcctatcatttgattcattgttaaatatacttttatgtatatatatatatatatttacatatttcataaaagttttttttaataaaataaacggttaaacatgtttaaaaaagtcaatggcgtcaaacatttagggacggagggagtatatacgtgctaaaacccatgtccctgtgtgtgtgaatcagcgaagcgtatagagtattaattttcatatacttctaaaaacaaataacaacatcgcactattgtttcctcgaacttttcttcttttgataccaagtcaacgtaaggtagtaattaacgcgggattattcgtgtgtgtgaacggtgtcacagacgatgaaccaggacacgcagatcaaaggacaggataaaccgccgatcgcgggccgcagccttgggtttgtgaaaggaaaaagtataatttgactcccttaactatggcacgagtatgattcataacctccaaccacaaaaccgggtatatcgactcctccaactatcaaaaccggtgcaaaatatatctgagatggttttggaagcggttttggcttacgtggcgcttacgtggcagtgttgacccggtctccgtcctacgtgtcgttgacatgtcacatatgtggcattttagaataaaaaaaacaaaaatacgtgggaccaacatgtgattcacacttaaaaaaaatagtgggacccaccgacatgtgggccccacatgtcatcatcttcatcctttcttcttcctctctcctcttctctctccttttccccttcctcttcctttttctacggcctcctaactcccttcgttctcctttctctcggcccaagcgcgccgccgcacacctgctgcgccgcaccggtttatgcctgaccgccgagcttcggagctgcccgcctcacctcctatccacgacgccgccgaaaaccacttcggtcctgacgcagccgcctgtcctagagcaccgccatgcacagggttcgacttcccactgtcgtcgcatccgggaccccgccggtaacgacccctcccaaatctcagcttgaggaggaagatgctaaccgtccaaccaccttaagaccaaacgattaaacaaaaacagattaatttaggagaacttttatggtacaatgtactaccagtatatacttgtagtataaacaatctaacggtatagattgccttgtgatgatgtgcaagcaaacggtaaaaaaaaatcgcagggataagaaaattcccaggagccgaatcaaaaggggagggaagaacaagaactgaacagatggaagaacatgtatacttggcagggtaaaccaatgaaactaatctcaaagaaaaaaagcaacagatgcgctcagaaagccaataaaagagagagaaacacatttttaataaaaggaaatgcttgcttaattgttctgaaccaaaaaaatcaaaggaacaaagaagaagaggaaggacacaccaagatcagcatgaaaagaaggggagggggccgccgtgtccgccctagccgccgttgtccgccgcctcctcctggagccggcgccgccgagcttctcactcgccaccgcctcaaccatggccatggccgtcaaggccaacacagccggcgtcgtctctttctcgctcgtcctcaagccgttgcggggcg

SEQ ID NO: 58180 - DNA, 2854 bp, Oryza sativa
tcaccttttgagtttaaatcacaacctcaaacgtaatactagaaatcttaacccccaacttacaaaaccgatttaaattaggtcctccgacaatatagaaggttggtttctctaacgtgacaagttgactatggtcaacccgggtatcagcatgggacccacgtggactccacatataagtcggaaaaaaaagtggcctgggcactggaatcccgatgaacgtagtgggtatagtgacttgggcgttatcgagagcaggttgagaaacccactcaacgaggggattatccctgccgatgtcaccgacggtgaggggtgaggatggtgtggaggggcctgctatcccgcaactactgctccagtagtcgttgtgacgttggctgcggtgacaccaggtggggtgcctgctatccaactgtggtgaaaggcagggttttgcgaacaggtgtgtgtgcacgcatgcgcgcgtgcgtgtgtgttggggggaggaggggaagggacaaaggtggagatgaaaggcgggcgaatcttctagaggcgcatggagagaggcttgggttgctggtgctacggtggaagcaggcagtgaggggaatgctggtgcaacaacggtgaaggggtgccgacagtgagctgctggactatatcgtggaactggttcttgctaatgttttagacatgcgactgtggagactgtggagtggccttgcagatgttgtggctgatcatgttaacgccaagatgcatgttggtgttattgttggtgcgatccatggcggacggggataaaattagcggtcaggagcagcatgcctaggcgattgggcatggtggcgaagctaattgtagtcctggatgaaggggagggcatggacatggcggattggtggttgatgttatgcacggagatgagagaagaggaagctaagatgcacatgaaagggaaggagaatctgtcctcggcatccgcatccctgtgccctgcctagacctcaccgactacatcatccttgatctctacctcctatgcctcgctgtcgaaacttgggatggagagataggtgcactgtcgctaccgtgtgctaggggaagaggtgggagagaagggtttttcttgtatttttctgtgcgacttacgtgtggacccacatgggtcccacgttaactcaattggattgaccgtagtcaacttgccacataacaaaaccaaccttctatactaccggaggacctaatttaacccggttgtgctacttggggtcaaaatttctagtgttatggttgagggatgtgattcaaactcgacataaagatcatcaagtgaacttattccttgatcattccataggaatccgaccttttcctagacgaagaaaatggctcgcctaatatctaaaactcccagaactaaaatgcagagggagtacctaaacaaactgatgtccatcgatggttttcaatttaaaagctaataacgcactggtaagagcaggtacaataaacttccccttgccggttgaaagggtcaattaggcctagagggggagtgaataggctaatttaaaactttatgcggaagctaaaactgaaataaggtcggaaagtctgatccacagtcagactatctgaaaatatcagatagtctgatattggatcagactgagcacaacaagtagatctatcacacaaacaagagtaaagcacaaacagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttccttaagaggttgcactaagcactcctccttccactaaggggtatctctttccttgcggaggcgagatccggccttcacaaacttctcctggccaatcacacgtagattagtggctcgggagtgacacctagccgtctaggagtcctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggagaaagagctcaaagatccaaagcaccttagcatcaagctcaacccaaagtgaatgagaatgaaatgagttgggtaaccctagaaaagggttaggtggggggtatttatagaccccccaaaaatgtggctgttggaggggaatctttcagcccatgtcggatagtccgatacaagatcggattgtccgatattttaaacctccaaggcaacaagaaacagagaacgaagttccatgaaattttggactttccgagacatcggactatctgatgttaaatcggagtatctgatattttagaagcaaaaacttcatcctcaaacagagactcaagttctatgaaatttcggagtctctgtatcatcggactatctgatccgacatcggatactccgatacttagaaaaactcactcgataggattttttcaaatcaagacagagagtgaagttctgtgaaaaatcggatagtctgatgttgctcaagtaaaactgcaataactttttactccgaactccgatttcgaagatcttggactctatggaaagctagtatcatgggctatcaaacccaacataaaacatggtccaaaacctttaagagatgttgaaaaacttgcaaagaaacccggtgtaagtgttgtgacaagtgaaacaactcgggattgaaattttgacttaggtttttcaa

SEQ ID NO: 58181 - DNA, 2546 bp, Oryza sativa
atccagatcatattcatatacatggagtactgagcaaattgagtttttttgtttcccctatgcattagtacaagtgtaacatgtcaaatcttcacaaaatcaactcaaatgtgctatttgttctcatgaatgcaaaatctgcatggaccccaattgagatgacactcatggagtccccaagatgataaattcagagctgcatgcctgtgggctccaagaatttcctcctgataaaagtcttgtctgcaccactagggttcttggagctgccaatttaagtctccatggcagccaataggacgcgggtgtcggcgcggaatcctgtcattgcccacccttatgatggtgaaatccaacacaaaacgaaacaagaaaaaagtagaaaaagagaaggaaccatcagggggttgtgatgtagtaggattgtacaagtgagaagaaaagcaactgttggagcacttgcttagttgcttgctatcatattcatagaaacaatgacctttccctctttcccttttgctaatccaatgacttggcccactccaaatgtgcatctcctacagtatcacatcagccatgcttcaatttttgcaatattactttttttcgctgggcccatattccttttccatgagacatttatcaacaattacgaaattaacatcgtgtgaaatgagtttaaaatatgaatcgaactgtaccacttttataactgtaaacttataatttgttagggtattattggggacatatatggtgaaaacccatgaaaactatatttataagttttctaaattcatgaaaaattattggagagaagtatatgcatgatttgtaccaaatcttaaattcaaacttaactttatttgggagtaactctcagaggaagttgagtttggacttgagatttgacatgaaagtatttcatgcctatacatatctctactaatacttttattaatttagagattttttaggtatgtttttcataggttttcacttatttgatggttttcccaggatatttccccataattattagtcaaatgttaccaagtagtagatgtttgaatttatatttgtgcgtatatgaattagtgtaggaagtggagtacttcggttgaaaagttgaacctcattgaatggcatacaaaacagttcataaagatcagagggaactttatctgcctctatagacaagattaccaaaggtgaaaagctgatgcagaaaattgcatgctgggattatttctgagcagtcctaataatcagaagatattagtccatttatgaagcagagtagtgtatttttctgatttggtagtgggcgttgtgggcctctatgggcgaatcagctggttcagcacttttgggccctggacaggactgatcagcgaaaacgattttctcgtgttggacgtgtcacgactcacgagtaatcaaagtctgaaaatttgtatgcattttgagccaataaaattttttacagatttgtttcttacagaacaacagaaattatatgagctccagtattctctccgttctttacagttggtagattattctttgtaattacaatattacatcaatatttttttcttcaatcacaatgtctgggtggtgtagttggttatcacgttagtctcacacactaaaggtccccagttcgaacctgggctcagacaaattatttttattttaactttttaagttttgttggacgcatattttattttaagttttgttggatgttaatttagtttttatttattttaactttttaagttttgttggacgcatattttattttaagttttgttggatgttaatttagtttttaagttttgttggatgttaatttttttgtgacttgttaactttttttagttttgttggacatttttttaattttaagtttcgttggattgtaattttttattttattttaagttttgttggatgttttttttgtgacttgcaatttttttatcttttttttaaattttgttggatgttttttttttagttttgatggatgttaatttttggaaaaatttgctacaggacatttaaagattgtggtctttgctgtgagacacccaaagatcatgtatttgctcttggacaccgaaaaaatgtggtaatttgctggcggacactcctcccattattttattatttctggctgaaacggtgagagaaactttcataaaagacaattttgcccatgggccatttgtataagccgaccaggtccggctgcaaccagatgtgagagaaggaggaggaggcagagtagccatggctccctggccgtgctctgccatggcggcggcgcggcggcgttcgtcggtgacggcgcatggctgccgcgacgagcgttggcgtcagcaagaggagatggaggctaacccggtggcgcggcacggggctctgtgatggcgtggaggtggcgctgccgcaacggacggcgttggccagaattggggaagagagagagaggcagtggcgcgaggggaacaaggctttgccttggagctcaccgg

SEQ ID NO: 58182 - DNA, 12142 bp, Oryza sativa
atgagctcgccgtggtccacccctgctgggaggagaccgtacagcagcacctggtcgtcccgcccctcccaccgcgtgagcagcacctcccacacggcgccgccacctacagcgaagaacgcgacccgtgtcagaggcaggaaagggaaaagaaagaagaacagtgtcaggggcattttggtactttcaacactctttctctctctgttttcaccgaaaataatagaataatgccttaagtgtccaacagctaattaccatatttttacagtgtccacaagcaaatacacgatttttgggtgtccacagcaaatgccacaatctgtgagtgtcctgtagcaaattttgccttaattttctggtgacttgctaaatttttatttttagagttttgttggatgttaattttttggtatcttgctaattttgttggatgttttttttatttgttcgatgcagattgagaaggatttgcgatttttttatttgctctccatttgcattttcttgtgttgagcatttttgtgatttgctctccgcagattgagcaggatttcgtttttttttttctaattctctttcatattcatattgagcatgatttaaggtttgctcacggatagcaatcctgcccaatctttttgacatgctgcttactctgcgtgaaatgtgcacgtaaacctatgtgcacatgatatattcttgttttttgaaacacagtacaacgcaaacgtccatacaccacacgcatactcacctctatgaacgcgtacacgcacattctacccctgtaagcatctccaaagactgagctggcatatcttaacattgatgaagtcactacgtagaaatagaaaaaaagaaagagaattgttgtaggacaatgagatgaattatttttactagctcatggtgtaaaatgagagagaattgtttaggtggttaagggcatgacaaatagttggagggagtaaaattgacttcttttttcatagaaaatgattttctcgtgttgggattgggacgtgccactaatagtaaaaagtatgaaactttgtagattttgtgcaaaccaaactttgtatagatttgttacttacagaacaacaaaacttttcttacaaaattacaataatcttttactttcagtcacatggtctgggtggtgtagttggttatcacgttagtctcacacactaaaggtccccagttcgaacctgggctcagacacataatttttcgatttttgaagatcatttttggctgcagatttttgaagatcatttttggctgcagattgactaggatttgtgattttacaaaatattattcgatttttgaagatcatttttggctgcagattgacatataatttttcgatttttgaattaactgggctcagacacaattaatattcgatttttgaagatcatttttggctgcagattgactaggatttgtgattttacaaaatattattttgctgaagactcagatcatttttggctgcattcgatttttgaagatcatttttggctgcagattgactaggatttgtgattttacaaaatattattttgcggattgagtgggatttgtgattttacaaaatattcagattgaggaggatttgtgattttacacgttataattttttgatttgctccgcagatttgagaatatttcgttattcgcacgctgcagattgagggggatttgcgattattttcccctatctgctctaagtttgcattttttttgagcatttttttgatttgctcaccgcatagtgagctggatttgtatttctttttttttgaaaaattgctctcactctacatattttatgtagaacatttttgtgatttgctctttgcagattcagcaggaattctgatcttcttttatttgctcgcatattcaaattgagcaggatttagccacaaaaattaatatgcaaattttgttgcagaacatcacgacttcaaggtcacggccgtgccattgctcagcagcttcctgcttcctggcgtgcgcctcggccaaccttatggcggccacaatctcctcgacgtgaaactcggccgttctctcctcgccctccacgcccccgcgcaactcctccggcctccgcgttgggaccgccacgacattgtggtgggccgcgtcgacatcaacatcgacgtcgctgactagagcacgcgcggcctgctcggtagtggcgaccgctgatcacgccaaagccaacccgtgggtctccgccgccacggcgcgctcggccaactgcagcgcgtgagcgacctggtgccggacgagcaccatctgctccagtgcgacctctgaccgcagccgccgcgggtcgtcacgctcgcggtcaatgcgccggtggagcacctccaccaccgcccgcttcttccccgcctccatcctcgcgacgatggcgtcattcgtcagctcgacggtagacttgagcggcggtatctcggccaccgttgtggcgtggcggttcttagccgccaccagcttggcctgaagccatcttcttggtctggcggcgtcagagcgagttgaggtctcttccgccgtagcggtcgatgaccaacccgacaacgacatcggtggcgaggacaccgcggagtgaagggagcagcgggtggctcagcgacatgagcacatcccactcgaaccagatccgccggtgcctgtcctcgccgccgctccccatcttcttgtgttgctccgtctcccgcgagatcgccttgagtgccatggatgaggaaacaaccccttccacctcccccgccatggtgggcacaacgtggaatacgacgcccttgacgcttcggccgagcatggacaccgccctgaggtcccccaggctgatctgctcggggacaccggcttcggaggtgagggcgccatcgccgccgccgtcatggctggcgaagaaccgtgctgatcgatcgatcaaccaaccgctcgaggacaggagaggcatcagtgaggaggagaggatccgagtaggatcagtgcgtgaggttgcaaggtggagggaaagcagtgccgctagccagccacatgtagacaaactcgctggagaagagagaaatgagggagagaggggaagagataacgaagaagataggaagataaagagaaagaatgagcaatctagtgaagtcatgtaaaaaagtggtacccctaccattaatttaatcaattgtctcctgataaataaccatatttttatagtgtgttccctaaaaatggtttcgtgcgaagtcaccactcaccatgtgctataataaaatttaccaaattactccatccgtttctaaatatttgacgccgttaatttttttaaatatgtttgaacattcgccttattcaaaaaatttaagtaattattaatttttttctatcatttgattcattgttaaatatacttatatatatacatatagttttacatatttcacaaataatttgaataagacgaacggttaaacatgtgtaaaaaatcaacggtatcaactatgtagaaacagagagagtaataaacacggtgaagattgaaccggatctgtgatctgcccgcagattgcacaatcctgcccgatcttctcgacatactgcgtacgtgtcgacacgccacacctccggcgactaacccccatgtctgccaccacatctccctcgtagcctcaccaaatcacttcattcaccaatgttgcttgcaatctctaccctactctctaaactctctttattagtggctaagcaaaagattttctttgtctgctggagcaacaaacccgtccataaatcagggttagcagcatgttagcatgtttggagtggccaattttgtaatccctttctggtctaatcacatcagcctatgttgatgcttgatagtactaatttcgctttagaaaagggagttgagagattgctgagaatcgttgagctgtgcattggcagatctctcgtgagagaaaaatgagagaatcttgcttcttgctgggacaggaggcaggcagccacagagcagggttagctggaccgcgcaagtgttggtgtgtgatttgagattttctgactgatgaagaagatgtattagatactatagtagatgttctccttccagacgaatcgcgcacagaaaaaaatatctgatgtgttaaatttcgtttggaatgttctgaatcttgtcactgacataaacatgagaaattacagtagtataattgaaaattgaggataatgttcccttggtgcttctctgatgaaccctggaattttattttgtcctttgtatccccaatcaattcagagatgttattttaattgaatttgagtccgggacggcagaggaaaatatcgtgcaatcatatcatcaagattgcatgattgcaagatgcagagtaattaattaggatggcaagttttggcaactataggatggcaagttttcgcaggattacttatatagttaccaaaatttgacagcaaactaaatatagccattttttttggcaactttaccaaaatttggtaaggttgaaaatagcaccaaagggaacaggccccaagtggtacagtctgaaccacagcagaaacagtaattcaataagtaaaaaggtgatttgcctaacaaaaatcccatggtttaaacttccttctcaaataatcttgcttaatattcatttcatttcagttggtatccagatgaaattctggttacaccaactagcagttgcacaaccccatcacctgatctatgtgctccactgaacttggttaattcagggagaaaattagaagagaaaaaaaatgatttttaacacaagggaaatgaaaaaaaaagattagtagaaccattagcttagctaatatctgcaatactagtactgatgctacagcatcagctgggtgacactctctctacaaggcgttgcctcgccggagatcgacgacgacgacagagatgttgtcggagctgcggcgagcgagggccagcttggtcagcaccgccgccgcctcggcgcaccaccgctgcctgccgcggcggaggcacgactgcgccacctcgcacgcggcctcgttgctgacgacgtcccagaggccgtcgctggcgaggatgaggcactcgtcgaagtccgacctgccggtcaccgtcacctccggcacggcggtgacgtagggcttcaggtaggcgtcgccgatggagcgcgacatggcgaggacgccgaggacacgggcgccctcccagaagatgacgcggccgccggccgcctcgatccgctccagctcgtcggggcggtcgggcttgtggtcggaggatagctgcacgggcgcgccgccgcggcagagcacggcgcgggagtcgccgcagttggcgacgacgacgcggctctcctccacgacggccaccaccgcggtggaccccacgtggtcgcacttctgcccctcgcaccggcagctgccgctctcggctcggcagccggcgatcacctcggcgtccatcctcgcgaagctccgctccatcgtctccgtccaagacgccggctcgcgcgccgccgccgccggtgacccggcgcccatctcctccgcgacgagctcgtgcatccgctccctgcacgcgtccgccacgtgcgagcagccgtgcccgtcgaacaccccgtagaagtcacacctcgccgccgcaacctccccgttcgccggcgcggcgaacgcctcgcgcagcgacacggcgtcctccatctccctcctcctcccggcgaccgacgccgccccgtgccgcttcgccaccaccaccaacccggcctcaccaccactcgccctccgcttcctcgtcgcggcctcctccgccgccacacccgcagccgtcgccgtggcgttccacctccctgccccctcaactcccgcccgccgccgcctcccggcgcgcgccctcgccctcgcctccgcctccgccccgaccaccaccgcagaatcacagcacacctccgccatcgacatcaaacaccttggaagctccggcaatggccaccaccaccaccacgagacgagacgatctcaggagcaacgagagagagaatgagagaggcggagacgaaagcggggccgcaatataaaggacgcctcgcgtcgcgatcagtcgtcgatgccgcgacaggtggtgggttcggccgcatcgggccgtccacgagtcccgcctccccgccgcgcaccgccacgcgacacgtgtccttcgcgtccacaccaaacggcgaccacccacccaggcccggacacgtgacgaagctaccaccaacgcaaaagagaaaaagaaaaatatatcgctgtcattcgtcgtcgccacgtactagtagtaatgctactaccacgagtacacgcccaatctaatcgcgagatcaaatcctaatctaatcgcattcgcacccggaataatgcagtggcgaccgtccattggacacgcgcgtcgctgtgccgtgttcgacggcgacgcacgcgacgcacggtccggacgcccgtggggcccacccttactgcaacgtgtgtgtctccgttggacttggagctcgttcggtagagactcagacatctaaatttaattttactaatatttgggtttcaaataaagttgtgaatctgtttaagaagcgagtttaatagtacagctcactgttagctattagcatattttaaagttaacgtatatataatatatttacaataaggttagcttcaatttatcatctcatatccttctctctcacttatatattaatatattggttttagagcacgtattaagttagcttttgtacgagaaccatcattctttatattttttgtatattctctatgtattaagtggatttataactttctattgtaggtttaaacctaagtacatctctctagttaattttgtgagagtattttagctagctttaattttttagatgaagttgaaattgtttggttggacttcggttcgacgaagcgaagttgtgttaagggcactcacaatggttatttataggctctatacaagagatccatgtcagcatattttcctacttagaagagattaaatgaagagagagagcaaaactatctattaacctggaaatagtctatagagaaaaagagacaatggattagagagctatagatacccatgtagacatatcattgaagtggtttactattaatctagtctattgctgagatgtagttctatagatagcatattattttaccattgcgggtactctgaatgagcaattagtaataatcttttactagtattactactactccacaacaacaactagtcttcgatgtctgaataatcaacgtttttttcaatctaaagttgctgcggttttgtttaatatttttggtggggattagaaaagcatggtggggaagacgtgggtgggtgcgtgccgcgccgcgattggccagcgccggaaattggcgtggacgtcgagacgacgactcgtgtctctttcgtttgacctcccgcgcgtcgcgtgacacgttgacacgttggggctccgggtccgtggagggttggctcttgggctgccctctgccccggcaaaagcggcccacctaacgcgtgtggctcccctcagattacacgcgcgcgtcctccacacacacagcgcgggaagggacccagcaaaagacgagctttcatgccgggacggcacgtacgcgatgcgtacgcatcgacgtggtggtggtgggggaaaaccgcgggttttttcccgtgggattcgcgggatgtgcgagggcgccgtgggggttggggtttctcgcggtcaagcggcgcggcgggcgacctcggcggacgatggcggcaaacggggccgtggtgacacgtatagttgtgtgtgtcattgtgtgtgctggtgttgcgtgggaaatcgcggagtttgatggggtcgcggtggggtggacaggtgtagaggtgccggagggggggagaaaataggggaaaagatgggacagaatcgtgggttctggtgctcttgtttcgccgggtgccacgcgtggagcggagacggtgggtggtggattcgcaggatttttagatggttccgtgaaatttcggtggaattttgtcgacgggtatatgttcgtctcggtcattgagtgatggggatgtcgagtatcgtgtgagtccgcaggtgacttttggattacatcggaactgccaatcaaaactctgtggattcttttataataactagaaaggtagcccgcgcattcgcgcgggcatgtaaagtaggttacactgggaatatcaatcggatgatggagtatcaaacggacgatacctgatatgcttgaaaaaaaagactccttctgtctcaaattacaagacctatattttttttacataggttttaataatatattttgaccagtactttattccattctatcccaacaaatataaaattagcattacataaaagtacttcaaaatataaatctagtgatgtaacatgcataatacttagatatagttagtatgattattagttaaaagctaccgagtttgattatagttgatataatttgggatggagggagtatttctttataaattttcttcatcgctattgcttagatatttttttacaagatatttgtaaggtttgaactatataatatttaattcattactataagcaattatcaatgatcttctttattttcttgaaagaatgagacaataaatacataggagatatatatattgtacgcgtcctttcccttttatatatgtgatttatggtgttcttttaaaaaaaatacctaggcaccatgagtcctaaatttaaagttgatagtagcacatatataactttttaaccaactaagtactactatgtccgactaccttagtatgtcttatatatgcaataatatatgagaaactcataataccacgttagatggatggttatggcatttctattttttagaaatttattactatattctctttaattgatttgattcaatccctattgactttttttttctacttttctattttattttatacaagtcttattttagattaaaattataggcattatggataaagaattgttggtttaattatttaacagatcaacaattagattagaaatgttatgtatatattaaaaataaggtcttttcagtattattcataggaagggggaggaatggagagcggagagcatgagccaaggttgaaggggaccagcaatgttttgtgcatgtgccggggaggacgaggttttggggactttatttttctattttttttctaaataatttaagtaaaccgatgatcatattttttttcttataacttataagattttttttaattttgatgaccgttaaaatcagatatgaatgtcccctttaatggttgaagctgaccgtatccgtcgaggctttatttctccactgcctttaaacataggtcctgagtcgacatagtcgtgccccgcaatgccagcatgaagcgtaattttaatgtctagttcactattagcaccctcatatattattgcatcagtaagtacaaagttatgcagtattgtcaatagcggcctttgctggggtggcttcaactcaaccatatgtatgacccttgctacacttgtggtagcacagcatgcttggtgccctttatgggagaaaaagagggaatgtaggtgatgaaaatatttccctagtgaattttttcaaagttttgtgtagacaaaattatgcatggtattaatcagtaatgcttattttttttattgtgtagatacaatattctcttttcagatgagcaatgttgataaaaaaaaactaaacagacatacaaccgtgacatctaggagtaccatattgttctttatattttgaataagatatatagtttagcttcggtttgttttcattcatgtattgttcataattacatgcgacatctttacttattctaagaatatattttccaaaattatttaaagtaactaatttgttggagtgcatttatagttacttcagtggggtgtatgacatacattatcaattatgtttgatatattagaatttctaaactataaaaaatatatgatgaatagtttgatgcaaatgatttttcatttgttaccaaaccaatttcgcaaagaaaaaccatatatgaccgtaattctcctgatggattaaggggtcgtaatatagcaaggtcattgcctggaaattcccatcaaatagttctattttttttaaaaaaaatagaatcttaatatcacataaattaaaataaaatcaaatctgattgtaaaccacaatgttgtttcactttttctacatgtagatttgaattagtgttatatatttgtcaagcgaatttgacaccaagttgatcatttttgtcatgtgaaattaatttaaaaatgatcatgacattagttattatatgttagctaaattatttgaaaaataattatcacattacgtattatatgtcggcaccatgtgtcgtaatgaatttagcagttccatataactattataagtgattagtattttatttaattaaagaaagacaaaggattataagttagatatatatttgagaaataatttaaaagataaacatttaaatacagttgatttggtactttatattaatctagtttaaccgtgcatatttgtagagtaataaattttattttataatataggaaatcctattttaaagaccgtggatagatagataagtcttaagtatgtacttgctgttcgttgataaataaaagacagagaaaggcatacacaatacgtactacactatattcgaaagactgtattgttcttacggcatacataggttttttgatttttttttaatctttgtacgtacgcacgtgtgtttggtttttttaagagaacaatacggaaggtttatatccggtgtgtacattaatttttgaatttttctggtaaataatttcgatgaagctgggacttttctaaatagatctaatctaatggtctagaatagtgggtccaccaatttaagtgaaaatcgacggttagattaaaagtgccatgcggcggtttaggagcgtttgtaggagtgccacgtggcgacttatgagcgtttgtaggaagttttatggacttttagtatataatagatagatagatagatagatagatagatagatagcacacggtaaattaattccacgggtatatattagtatcaaggtgattccttaaatacactcgttatttccatgtcacgtactccctccatccacgaaagttacatatattacttttgacactaagattaagaaaaaaattaaatcaccttagatattacaaaatcaataagtgaatacatacatgtaaccaatgagtatttagatgactatttgagttctaataaaacacttaatttatctcttaagtttgaatacataaagactacaaatagaaacaacttatttggaaaaactcaaaatatgaaatatgtgtaacttttgtggatggagaagtactattttgtatagtttttgaaacagaaatggtagataattactccctccattttaaaatgactaacagctttaactttgctattttaaccactatttcgtcttagattgttacactaaattgaaaaaaaatatatgcttatatttatgacattacactttaaaagtacaacaccttttttagtgttggaaagctttgaaataaaaaacgagtggtttaagtgagaaaattaatagtacctgttgtaaattattttacaacggaaggaggatgaggtacatcacttatagtaaacatccatatttaaattcacctatacaagttaaaacagagaaagaagactttatacatgcgactttgtctctcttttttttttagtttttcctcactgaggagacggaatttgtggttatcaaagttactccacatacttccccatttccttaaccaaaaatatatgattttaatcatatagaaaaaaatgttcaaaatttctacacgatatatggtgaaaattcccgatttcagatttttttagtggatattt

SEQ ID NO: 58183 - DNA, 1193 bp, Oryza sativa
cagcatagtaccagaacttcgattgttccggccaattagcggtggccggttcgatacccctctcaagcaagctaacctccatctcctcccacttcggcatcgcgatgctttagccgcctgaccccaagtggtgatggtacttcttcttggcggtattttctttgtttctttccatcatcgcctgcccttgttcacctgtcttatatgcaacgaactcgtcccagtgatcccttagctttgggaatgtgtcgaagttcggtgtctgccccttgaggatatatttctagtacagatctcccttgaagctctgaaattgttctgccattttcttcagagtccaccttttcactttgtcctctgtacccgcgggaagggtgaatgtctcgagcattgtgtccatagcatctctttctccgaatctgggacaaagctctcatgatctccgcgtgcccttgttctgcgccagtacaccgtactgacaggcacgttatcccgcacaacccaaccgctgtgacgtacatagttcttggcggcttctgccggggcactaggtcgtccgtcttcgtccacttccgttatgatgtgctgaccctcaagcttcttcgcggcacctcgttgcccgcgtgccctcttctgtccaatggagggttgacttccactagcctcctcctcctggttcccctccacatccctttccgcgtgcccctcctggttcccctccgcattcctctccacgttccctttctcgttcaaatactggtttggatcctcgttcccctcttcttcgttccagtactggctgcttccctccgcgattgtatcgtacaatatctgttcctcatcgcgatcagccatctgttcatacaagagtggtcgtatattagaaccctacacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatatgctaagactaaaatagtcatgtatgctaagtgtaactgtcgtattttagaaccctacacaatcttatacgctaagtctaattacaaatctaataatcttatactcaaactcaaatagtgatatat

SEQ ID NO: 58184 - DNA, 1222 bp, Oryza sativa
ccgggactaaagatattttcccgctatttccaaattctttttaaacccggttagggttaagaaccgggattattgataagcgcactgaatattattttccattacatatgtgtttctaaaatagaagataatgcattaaaattatttaacgtacaaagattaatattaatgacaattacttcgaaaaattattgttgtctgtaataaattaagtggataaaatgtaataagcaaatatatgatttaaaattaataaaaaaatctaataatcatatatacttagacaagtccgagaatactgatctctttgacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcattcatgaatacacatagctttgttattattgcccggacattgtctggaaggataccccttattacaactagtagcagttgtgtcatcaacacgtgacagtcatgagactttaggtttgtgaacttcttctccttcgtgcttattattcgcttgatattcgtggagtatccagacggtacctttatgctctccaagcattcaaacatactttcattctgtgccttgctaagagtgtagctggctggattcaagtaatggcttcctttctcctttggttccgggtgaaggtcgtcgcgttgttccatatgcttcagatcattacgtgcttccagtgtatctttcgactttccgtatacacctaggaagccaagaaggtttacgcaaaggttcttagtgaggtgcatcacgtcgattgcgtggcgcacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgcctttcttccgtaccgggtggtttgctgcaaggaatcgacgatgacccatgtatataaccttcctacagtgcttaagatacgtattttctgtttcatccatacagtgagtgcaagccttgtaccccttgttggactgtccggatagg

SEQ ID NO: 58185 - DNA, 5174 bp, Oryza sativa
attttgttccttcaatcttcattgctcggaggttcaaataaatttcgttgtaatcgaatcgttcatccaaatttgatcagtttctctctaaaaaccacaaaaaaaatcctgtaacaaagactccgtgatcagtgcgtaactgaatggaaattacagcaaagcgcaccaaaaccccccgggtaccacgcgcgggaggtcaggggcggcgtcgcgagatggcggcggcgtccacgaggaggccgctgcgccgccgtgcgacgaccgtggacgacctcgacgacgctctcctcacgcgcgtcctcgtccgcctcgcgtcgccgcactggttcatccgcgcggccgccacctgcaagcggtggcgccgcatcatcggcgccggcggcggctccccctgccgtgcggtcgagttccaccgccgcggccgcaaccccatcgtcggccactactactaccccggacgcggcagcggcggcgcagtcttcgttccgtcggcctctccctccctccagccccgcgtcgacggccgccacttctccctcggcttcctcccggacagcgattcatggcggctcgtcgacagcagcggcagcctcctcctcctcgccaagaggaagtccggctggatgcgccattgcttcccggacctcgtcgtctgcgagcccctgacgcggcggtaccggctgatccctcgcctggaggagatgaaacaccaccgctgcatcggcgcgttcctgcgccgcgaccactaccaccacgtctgcagccggatgcccgtgcccactctcaaggtgttcgtcgccctctagaggggtacgccggcgtgtccgccgacctcggcaccgccacggcgttcgtcttcggctccgagaggtggccctggccctgcgaccgcccctggagccgctggcgtctcgcgggcagggccaccggcgtgcacatctccggcgcggagtccgtccacttcgtggggcgtgcatcgggcggcttctactggcggatggacgacgacggcgaccgcatgcttgttcatagttgttacacttacagttacagcacgttctcgcgggtggcgcttccggaggcgatgaagggcgcccggcggcgcgacgacggcacgtcgtcggcgttccgggtcgtcgccggcgccgacggcgacgtgcgcattgcctggttgatgagcggcgtcccctcggtcttcgcccgtcgcagggagcagtggtggatggagaagcgcctccagctaccggcgcacacggcgccggagagcttcatcatcgctggtaataatgcggtgatcgccgacgccggagcaggacgcgtcctcctggcgccggcggaggtggacaagcggcggcggcggcggcgggtgatctccatcgagctcgccaccatgaagatcgatgagcccaagcaccacgccggtggtgtagtgacgtatccgtacgagctgccatggccggtgaccttgaacgcgtgtttcttgagcaaatggagccgtaatgaaggatgggggtgcgtttgaattgtgccactcatttgaagattatactggagtggaatggcctcttttttactgagaaattataatcgtccgtgtattgtgccagtgtgccactcctttgaagattaatgtagtactagaaaacatgctcatacgttgcacgggtaaaatatttttggattacttgtacattttattctttggttttagaccaaaagtttatttcatccttttttttattatcgtacattttactctttggttttgaaccaaaaattcattcattccttacttttcaatctcagccgagcccgctacatcgttttatttggcctgcctcttgacccaatccacaagcctgcctcttgacccaactcacaagtggagctatacgaaactcctatggcgcgatcggttcccttgccccacgcgatatttttttttgcaccgctctacttttctgttttactaactttatacatatcaagtttacacatctaaaatttatatacctaaagtttgtacacctaaaatttataagtcaaaagtttatatatcagattcaaattcatctttaaacgtatttaaattcaaattcaaatttcaataaatcaagtttacacatctaaaatttatacccctaaagtttgtagacctaaaatttataagtcaaaagtttatatatcagattcaaattcatctttaattgtatttgaattcaaattcaaatttaaatcggtatatcaacttttgacctataaaagatgtgtaaaccctatatgtataaactttggatatataaactaaaaaaactatatggtgaagaaaagaaaaagtggtgaaaaaaacgattgcctgggacaatcaatcgctagttagcgatcccccgtgatatagatccaactcgcatagtcgattgccatcttcaaccaccggaagataatctcatgtccgtacatgccaaaatcgatcctcccgttaaattcggtcgaagaaaaaagcggatgaaaaaacccggaaaaaaggcgacgaaaaaaagttttaaaaaacgtggacagaaaaagaagtgaaaaaagaccgataaaataacagcgaaaaagatagatggacgacaaacagaaaataagaaaaaaaagaaaaagggcgaaaaaaagacagaaagaaagaaaaaaatagacggataaaaaaaagcgaacagaaagaaaggaaaaaaaacaaacggagaaaaaaaagaaaaatggaaaaaaaagaagaaggaaaaacggcgaaaaaaaagacggatgaaatttagaaaaaatgcactgtccagagacccacctgtcagtatttttttttatctctcgttctctgctccttcctccctccgttcttctttcttctttcagagaggcgagaggagggagaggggaggcgagcagggcggcggcgctcctgtagccaggaggcggcgacgtcggaggcaaaacgtgttcccactcgctgtgtaccctgggaaggtggcggcaaacagtgaaattgagggagaagttgggaacgcggtcggcaaaagctctgtcccgaggagagagaggaggctccggtgtggttcatggtggcggcagatggaggggaaacgtagagaaataggttcttctcagcaaggcggagctggtggtgagagggaataggaagggaagctccgattgaggagatcggctagtgatgctagattggccggcggtcggacggctatgcgtacgtgctcgcgacagactctggaaagccggatgaaaaaaccggaatcggactggaacgacgtgcaaaagtagacaaaaacattttaaacttttataataggtaaagatatggtcttttagacaaggacacatctttttttttgagaattacacagtacaacgcagacactcacaacgcacacgcactcacccctatgaacgcacgcacgcaaactctacgcacgcaaactctacccttacgagcatcttcgaagactgggccggcaaatcctggagagattgacgaagtcaccacaggcgcctcgctgtcgacgggtacgtcgcctaccactgaaagcacaacgccgttaaatcctggaaaattcgctcccaggaggagtcgaactcaggacctcaggtgctactgaggctcttgtaaccactaggctacaggccctttcgcaaggacacatctttaatggacaggtttaatttagtccttatcatttttcatgataaatctattaagaccattcagtataatggattttgcatattaatgtttcaagattttaaggtttgactacggattttaggaagctatgtatttgaaaaccagtacgtatttaaatggtgcatgtacatataactttgatctgttcaagggacgtgtaatacctcagcatgttaatttatgttccggttccggtttaaaccgttaggtccgagtgtttatcccacatgaaaacagtggctagtccgggtggccgcccaggctcgttggtgagaacacaactttagattgataagtaaattgacgttgaaatttttatctcaaatactagttatattaaagtttgtctgggctcaaaaatcttatttttggctccgccactacatgaaaattctatatagatttacctccaggtaccctttcatataagcaagctactatgagaaatatggcctcaattattatgcagagtgcgctaatacagatttgaaggatagggtggtacagggcgtcctattattttaccaaaatacgtgaaaaacactaaggctctgttcttttggttgagttgggaacccatccctccggtacggaaaacgaagcagtccattagcacgtgattaattaattatttgctaatttttttttcaaaaatggatcaatataattttttaagcaactttcgtatataaactttttgcaaaaaacacaccgtttagcagtttgaaaagcgtgcgcgcggaaaatgagatgggggagttgggaactccaggaaacgaacagagcctaataatgaaacttttaatatcctactattgatacgatataggagtatatactattctatttatattctagaaaaaggtaaagtgtttccaaccctcttgcatgtaacctaaatcttaactaattaaaagatttggatttttccgttcgtcacctcgaacgttcgccttttcatccgtccatcgcaatcccctcccccccacccccacccccacaatcccaatcggaatcgagccctccgttcccacacgcgccacacatcgatattacacaaattcaatcgaatacaaaatctaaccaaacatagaacgtagaggaagcgaaatcgaacgagaagaataataaaaaccgcacaaatccgtcttagtccatgcattgcgcacctcctccctctgattcatccgctctgaagatcccacgaccaatcccaaatcatcacaaatctaacccaatccaatcgaaatcagctaaaaaaaaaattccaggataggagataatccaacatcacagaggaggaaggaggggtgagcgggaggcttctgctgctcctcacccaacttcctcctcgccacctcaccgtcgtggaggtcccgagccatgggggagccgctgcgccggggagccactgagcaggcagcgacgacgaggccgaggaggc

SEQ ID NO: 58186 - DNA, 3995 bp, Oryza sativa
cctaaaatccccaaaattcgagaaaccctaatttcggttctaagaacctaagaccaaaacccgaattaaatccagattaaactcaatattagggttttgggatcgggaatttaccggatttcgaagcctctaaacccaccggaatttctccgggaagcggcatcgccgccacttcacctcctcactttccctcgccggggacgggaagcgtcggcttggcggctgccttcgggctccgcccccccgccgacgaggtccgggccgcatcggtgctcgccgccgcttgtgcgcccgcctcgccggaccgccgacacccggcacggcttgccgccgccctcgtgcgtgctccccccagccggcgcaaatggaagccgctcggtgctcgtcgtcgcacgcgtgctccacctcgccggaacgccgtcaccgccaagatcgccgccgattccactcgctcgctcgccgggagattagatcgggggagagatcagagagaagaggagaaatgaaaatggggattagggtttacccctccccgtcggcgactttaccggcgcaagaacaatctgagccgtccatcaatcggacggctcggatcctctccgcgttgggccagcgccactgacgggccacgcgccttcggccgcggaagccacctgggccgctggctggggcgcactcagctagcgcgtgcgcacacacgcgaaaacgggccggcccaagtttgggccgactacggaagaattgggccgaaatcaatttaattcactaaacgccctaattaatttcaaaattacacaatttcatctggcattattttagccatttaaaattgctggaaaattatggtcaattatttgatcactcggaaaactatttctagttaaatggaaccgacgggaaccgacgggaagtttaactagaaagaaattaatgatatgatattatatttgactaacgttaatataatttcatgtcaatatttattaagattattatttctttaagccatttaatttatttctagttgaatgaaaatttaactagaaagtatttatgatttcatgtcaacatcattatgatggtcatttccttagaaacttaattatttatagtcgaatggaaccaacgagaaattcgactagaagcattaagatatgaagctatatttaacccacgttattataattgcatgtcaattataattttttattccttagttattttctaccaaatggtgatataattaaggaattaattttaagattattcataattatttatgaccaatggtgctttgactatgaaattctaagtttattttgcatatgattgattaaagccatggtaaactaattatatgccatcagcaattcttatcatttaagatctgttgcaatactgagtaagttatttctagataaatggaaccagcgggaagtttatctagaaagaaagatgatttcattaagattgttatttccttaattattttctgcccaacggtgatgtaattaagggaagaaatctaattattttctctgtcattttggccttaatggtgatatgacttagaattttattgatgccattagtgcattaattccttttatcacttctactttacggtgatgtgatcgaggatctactctgtcagtaagcttaattcctttaccatttctagccaacggtgatatggctaaggattttaattttaattctatggcatcactaatggcgtcatttcctaatcatttctaccgtatggtgatttgatttgggtttttttactttatcacttctaccttttggtgatgtgacttaagacattaatgtttattccctaatcatttctgcccaacggtgacttgattttggattataagtaatttcatttattgattccttcgttttgtctctgcccaacggtgatgcaaagcgaaataaagattaagttattattgcgtaagttaatgtactattgtacgtaatttgcacaagcaaccacaataatagtgccacttaattttatttatcagttaaagtctatggaattattattattattcctcattgacttaactgagcctaaggcctatttgagtatgacttagcattaacaaaggattccttgtggctcccgcagctaatgtcactaattttttcctaaactcaagaggcatctttagcctgggagaaggccaatatatgctatgtttcgcatgtcactcataaatattgagattatcatccctattagtgttaggggagaattttgagcatgacattgcgaaactgtatctagcaaacgttgagatgaactttagaagtttgtcaaaactaatgcttagtacaattttagtgcatatgcacattcgccgccataatttaaaaggtagcacaagaaataaatcacatggcgtgcaaacttagtgagatggacatcgcacatttcatatgcgccacttctccatttcatatgattcttctcccattagactacggtcattttcagagttgtaatactaagacaaagtggaccataattgacttggttcatcattccgcaaatcaataagaaatatagaagactaagaggcaaactaagtaagatcctattaatcttgtcatttgatggcaaagatgaagctttactatggggttgtagcaattccaaatttaatgataataaagctcatattcctcgcaaggggaaataaaattgcctctatgtcctatgtatgctacccttgaaattttcttgtgtaagttctttgcaagaaatagggacatgcttaatgtcctgattcaataaagtagttaaataagaagattaagggcattattttttgggttgaatcattatgagacattgtcgaaattatggccttattttccggccacatttctaggggagaatatatgtctcattaaggtcgagacacttcacccttagaaatttctgacatctattattacttaaatgataattcactaagtaaaattaagtgattcaagtttatgaaaaataagatattatgcttccattaaataaataatacaatcagtgggagctcatcaagagctctaataagagaagattattctacctcatttatgactcatagctccattatgtggacgctagaattttgtatctcttaatttgtgacttgcacaattaaatatacataacatgacttgagggttttgttatggaaagacaagtcacatatagggtgcagacttaagaaatccatttgtggacatgatcaaacattgatgatgttttaaattcggctgcgtcattagtgaactaagcttaaataagaatgaggagaataattattctataatgatggaagtaaggcgtcattgaaatagtgtcattgtcgcttatgtcacatacctaggggagtttggaacgtctcgtgagttagagatattctttcccttagattttaatggcgttgtttagttttaagtggaaatttcacgaagttaagatattagccaacaaatgattttttatggctatgtttacccataagcgacctccgatttcctttaagaaatttaagatactaatcaaatgaagttatgagatcggattatggtggtaaacactaaataaagcttgttcaccttataagacattaaaaaataagcgttcatccaaatggttttcgaaccatgtaaaagtaaattgagatggatgaacaaaataagacattaaagtgttcatctaaatggttttcgaaccatataagaataattgagattgatgaacaaaataaagaatttagtagaagtttctaaatgagtcaaaatagtgggtcatttaagtgggttaatgaaattaagcccgactctaatggaaatttcgaacaatccaagtgaggtggacagctgcatgaaaattaaaggtgggaatttcattcaccggtactctatactaatgacattttattgtcaagctatgcatattgctgttagaa

SEQ ID NO: 58187 - DNA, 8527 bp, Oryza sativa
acaatttcaaccaatggttttgaatcgtgatttatacggttccagggcagtgtgcccaaaaggcggttagtaacatcacaacagccctcaatttttcattccacagccaccacgattttatatacacatgagcttatcatttgaccaccaaaaaacatgatagcgccatgacagcccctgatttgaaaaacactggttgcaagtttcaacatcttgtttagaaagctgtgtgccaaacatgcttcttagttctcagccacaccgcaagcagaaacgtgcacgcacgcacgcacgcactggtaacagagtgtcatcatcttgtcccaaaaatcactacgtatgcgtttctgaactttgactgatcaaggttcattcactttgggcagagcctggattgagctgatgctgaaagtatctggcagaacattcccagcctgaaccggaactgaagaaaaggatcagaggaacatggcctgccggaatccggcaccgatcgccacccatgtgaaggagaagaaggctggccgcatcgccgggtggacgcatgtcgccgcagcccgcatgtgttgggtgcagggatttagctttgcgaagatttcaaagtaaaaaccgctcctcaccggttttccaaaatctgataaaaaacccggtaaaaaccaatgactttgggttgacgcccgtgcgaaaaccgtctaataccaatcggttttcataaaccaagacctagcggtttcacgaaagtcgatcggttctcgctaaattccatcggttgggtgcataaaaaaaaaacagaagggcgaaacagccatcagcagggaaacctgattaactgacagctccaccccgttttgctattccaggggggccctctgcaacaacacaaggtttgcctccacctctcttgcatttcctattctctcaaatactaggacgcgcaccccgcgcgccattccgcttccccctcccctcctctcgctctcgcttgcggccgcgcgcgcgggcccccggtggtgcgagcagtcgtcgtcgtcgtcgtcatcgtcttcgtccggggccaggtggtcggggggcgaggcgatggcgtacagggcggaggacgactacgactacctgttcaaggtggtgctcatcggcgactccggggtcggcaaatccaacctcctctcccgcttcacccgcaacgagttcagcctcgagtccaagtccaccatcggcgtcgagttcgccaccaggagcatccgcgtcgacgacaaggtcgtcaaggcccagatctgggacaccgccggccaggagaggtgaggtcccttctctctctctcttttcttgctcgcgttctcttgttgtgccgcacgccctctgttctgatcggttcatcatccagcattgcttggttcggcactgcggccattaggttgatcacgcttcgtttcttcaggaaattcaatgtttttctgtaggattcagtctgcgcgatttgtgcgtatagtttaggaaatgcgcaggttgtttctggtgcgctctcttctgtgtggttcaggattagtaggcacagcatattggtttaagattgatatttctttgttttttttttttgccccatgcattggatatgtggatagtttacatcacgtcgtgtacagtcagcaaaactatagcctttcttaattatgctctctctcatgcgtcattatttttgtttttcatgtaaaatcctttatttacctatctttgaatgtgagccagtggggcatgctatcttcctgtgaaggaaacgttgctctatgacttatgttctgagagagattctagtttattttctagcatcgctatcgtgcagttttattctacacctgcattggtgatgtcctgttgttgccatgtactatttggcatttgataattcgtatggacatttacatgatttcaatccaactgtctcctcacattatttagaaaattgttctgctgcaacatctgtttgtcttatggctctaaataaaaccttttctggcagttgaccatccatccttcaaatagtaaataccatgagtggtcgtccaataactatagaatcactaggaatattctttttttatttacagctctatgctgatgtttacagtattactcttgtgccatttacaatcaaattgctgtccctagtgtctcaaagaacttcatgcatttgatatggagtattaggcatatcctttgggatcaatttctttggaatctgctccatgtatttgatgacatttcagtcatgttgatagtttcagtgctcggtatggactttgaagttccttctgtactctctcaacaggtatcgggcgattacaagtgcatactatcgaggggcagttggcgcacttgtcgtgtacgacgtgacacgccatgtcacctttgagaatgtagagaggtggttgaaggagctccgggatcacacagatgcaaacatcgtcatcatgcttgttggcaacaaggctgatctgcgtcaccttagggccgtatcggttgaggacgccaagggcttcgccgagagggaaagcaccttcttcatggaaacgtccgcgttggagtccatgaatgtagaaagtgccttcactgaggtgctaactcagatctatcgcgtggtcagcaagaaggccctcgacatcggcgatgaccctgctgctccaccaagaggacagaccatcaatgttggtggcaaagatgatgtttctgctgtgaaaaagtctggatgctgttcatcctaaatccattatgtccatgagaaggaaccatatgctcacctgattatatcatgagtaattaaaaggataactttcttttgctgcctaacctggttgcctgtgagattttagtgttacatcaagaaggttggggctgttaaacccaggttgggaaaaagctaactttgaagtgtcagtggttttatggtttgcatttgtggtttcttcattggtgtactattgttccatgtaaattgacaggatttgagatcctccccacctttcactgcataacatatcccagtaaaatgttgttgtaattggatatcagactgtagctgattggcagcaagagttctaattagaagggctattatattctgtaactcctactcacaaatgtacaaaagtttgcatccttgaacttcttaccagcctgtatattacggtactgaaagattgtttaagataatttcttctatttcagtagatgtgcgtaaaggcgtaaactatagcatttatcattttctgcatatctctgttttgcaatattactacagattgtgactgacctacaagatgtttcctttcattttatcagtattaatagagtgaaatgatcagctttgaatgtctgttgtgtaggagtactacattctggcagatatgaacaggttgcactggttaaatgacctttcgagagggcagaagaagagggtatcaaggtctagttgcagtggttaaatgacctttcatgagcagtggttgcaaggtagccttaatacaattcaaaggacagcaacattggttaaagcaagttcaatttagtggaatatggttggtccggtgattgcccatgttctgtagttacattgccaagtgtaaggtaggatgcaatgcaatggttatggcatgacaaacctaactgcattgctttagcaaaaatgatgaattcctgatggccatgcctggcgccatgatcctgttaaagaagtaacctatctccattttgtgaataccgttgcattttttttgaccgatttaagcagcactgatctgacatcatgttatcagccaatttctgaagccatacatttttctgtagcaaaatttgcattttttagaagcacagatcttgagttctttgacattaaggacttgttcacattgttaccactttcaaccatagtaaattttggtattatcaaattttagtactgctaccttgccaatgctaacaaaccaaacaaatccttgccaatgctaccttaccaaactttggtaattataaaagttcccactcttaaaaattctatcaaattttgataagcattcaaactaaacacaatcaacgataccaaaatttggtagcagtaatgccaaaatgtgctaccaaattttaagcaaagccagtgagaattcggtgcttccgaagaaaatgcaatttaattcttccatggtcattcagctccacgcaattctcagctacaacgaaaatcaccaaacaaaaaagaaaaatctccacacgattttcagctaaaacgaaaatcacaaaaaaaaaattgtaagatgagtcatggaaactatttctcactatcagcaaagaaatgtagccgtggagaacgccaccgtgttgccattgcctgctctgcctccccttgccacggctgatctcgcggcggccaccggcgccgtcgccggcgacgcgtccgtgctcctcgccgtgaaccggtggtggtgcagcggcatggagttggcgtcgaggcggtggagcgcggcgacggtgagcacggagcaggcgagcatcgggacggggccgaacacccacatgagcagcgccgtggcgaggtagagcgcgcggagccccgccgcccagaagttgccgccgcggaccacggcgcgctgcgcgtcgcccaccggcggcgccgcgtcgccggcgagcgcgctcatgaggaagctcgcgtgcacgaagtaccgcgccgactggatgaagcaggtgaaggaggcgaggaagcaggcgaggagcgcgacgcacttcaccgtcgccgtcgcgtggctgccgtcgccgtagccgaggacgacgacgcccgcggcgcccggcgccggcgagctgctcacccacgcgccgatcagcgagcccagcgcgatgcacagcgacgccagcgtcgtcgccgccgagatgttgtccgagatcacgcccagcgccagcgccgactcctccggcgccgccgcctgcaagaaaccactagaatctttcgtcaccattgatcagttcttgaacaaacaaattgaattgatcgaacaagatgatgaacctgcagcatgcgctccacccaggcgagcttgttgtgattctcgtagccgatcacggtggtgtgcgggtggcggagaatccggtggaggagcatgaggtggtagccgaccatgatcgccagcccgcatgggacgagcaccaaatccatggagctcttgtcaacaagcatcatgaactgactacctcaatttctgtctctcaatttctcaacctatatatcaattaacctctacctagctagcttagctctatagctaatttttagttgctgaatcttgctgttcttctcttctactcttatcttgattcgatcttgctccctttctctggcatgattgcaacacgatggacagaatgtgtacaaactgtacttgccattgcttagattgttaggtcaattaatttgtgttaacttggtaatgggcactctcgttttcattctgtccgtgatacttgatagtagttgcttgtgggtctcagcagaaaaaaactattgttgtggctttggatgcaagagaaaatgacaagatgaaaatttcatcctatgcaatgtttgcaccatctcaaaaggaggaggaaaaaaacaaaaactgtactttgcagttaggagagagtggcttttgcttgcacttaaaagcaacatgggattacaagaaagaataatttcttaatggacttcctcaagctaagccagctgcatgaatccaaatttggtactttttttcgtattttattttttttctcgtgcatgtgctgcaatactttggctctaaaattagggggaaatctcacaaaggggggtatttgtgcatggataaaaagtttggggctgttcagattgatgccattttcaaccataccattttttttgtaaagttgccaaaaaaatgcttacgttttgtttgttactaaatcctgccaaaattggtaatgccaaaatttggtaagatttattttggtaacaatctaaacaagtcctttataccttgcagttgtgcatggtttgggctgtccggcccactactgagctgcatgcctcatgatcaatcgcacctgtatcccaaggcccaatgcggtcaattaaacaagaggtttttcctacattacagcgattttgctatatatttatcgataaattttcttcctaaaatttgacaaatgtaaatatacgatcatagtgtaattacattataacttgtatgtaactttcacataattttaaaccgttatatttgctttaaatcttatatatgcaagcgagaaagaaaaaaatcacagcgtgcgcacatatgataggatttggtcctccactttacgaaaataatatgttaatgaggtatttttaaaagttatatacgagttatatgcaagttacaatataattacaatttttttagggaaatttgtcgacaaatgtacgagcaatcccacattacaatatttgggtttagtttttctaatatgcaaggacttaggacagttgaagttattaagcaaattaatttaatatagtttacctttcaaactctacaagcaaacatttttttccgattgcacggatgatgcacagatgcacacctatgatgttgccctcttactctcgcaagaaggggccagtggcaaatctatgacggcttgatttaattggatttttgttcctttattgcttccctgagccttttaaaaaattactatttgaatggaaatgtctgttattatgaaggacaattacgttcttatccatgttacgttcattcaccaagagggtctcttcaagatttttgctcatatccatgatccatccacaattttgagcttgtttctaaaaagggacatcgagaggaaatggattaaaatttggaagtacatatactgatattttatacccacatattggtacaaatatactcgagaatgtttggaaaggaacgagaaaatcgtgaattcagaaaagatttctgttgtattctactagcttcagttgaagttcggagacattggatgtagtacaatttgtgaaataccattaaagatcccggttggtcaggagacataataatggcccagtgacaagaacagccggatcataacaagaactaagcttctccagtactgacatgtgactgactcgctttgcatatctgtcgcctccgttattatctctagcggtatactcgattcatttcaggaactttgtgtgggaagcagaaggtgtgttatcacttacctggtatatatgtgtaaaattaagattggttgtatttcagggggggtatttagttgttccacattctttaagttggtcatcaccatgcaatgaaatataaggaaagtatattacctctgttgatcaaaatgattgaggctaattgaacctctcaaatttctatatacatatattcttgcatcctatatctataattttgtacggcactaatgcagtttaccttttaggcgtccacatgttcagctgtatatagaaactagtagaaagcttcttgtcctgtaaaagcagtctctggatgttgcagagtgtgtatgttcacttatggagttcaggagaattgtatgttccagttattccccttcttgtagatcccggattactggctacctcgatgaatagaaaggcaagaatgtttactagtaacaatttaccaggtgggaagtccatgacagatatgttgggaacttgcaagtctggaccggaaaatgttggcgtgagcaccttgttgagatgtcggaagcactggtaaactgaaagatttttcaggagtttccatgcaaggcacaacatgagaacaccacaacctggaattccaggtttctgcattgttcaggcactgccgtttatcctagcatatgtcatcagattaccactggtttgttctgacgcacctcaaccacggcaacaaactgaaggatatggacgcagtctgcaacttacacagtagagttctcactaacagatgtaaatcggactgttcagacaagcggtcacactgttcatcgtacagcaacaaaaacatggtaacaagggatattattgagattaattttgcgcagtccttaatccttaaggcatagtggcacttataactgcacctgatctgaatcgtttacctagtatagcctactacggtgctcctccccttaaaaaataagtttatttttcatctattccacacatactactttcacaaactttaatataatgattactaaaagataagatttattttaaacaaataagatgaaacaaaatgaacatgggagggtaccagatacccttgctacttggaaatatattggcacaacgttactacctatccttgtgtacaaatagcggtacatttcgatcagtgtgacgctcagtatccctattgagatcataatacatactgatcagtgtgtgaatttcagtttaagtatgtagattagtacacgtcgaacacagcgtgacgctcagtatcagcagaaa

SEQ ID NO: 58188 - DNA, 3147 bp, Oryza sativa
  unsure (1)..(3147): unsure at all n locations
agcgatactaaatgaagaccgctttcttggccccagaggatggagcatgtctgaagtctcaggaaatggacaaaccaagtcactgaagggtcagattgtagggctcatctatgccacacagttcttgaggatgccgttgatagcgcttaatgttcttatcattgttgtgaagttggtatctggctgagactgcaggtttcagttctggggtttgatttaatttctgttacagcgtaatgtaaaagtaatcacagtaaagattgctgcagttatgttaatttgtctctaatgtatgctgttactgttctagtaaattaattctgagccgcaaactgtttctttggcacataaaccatgagagtatgtggtctggcgatgtgttgtgagggctccttttccttatttctgttctgaatcaatcacacatttgtttgcttgttggtgtgtgttatgctcaggggttatctgacattcagattttcagccttcaggtgccgtttttaatggaaatattacctactatggtcatgccttatgtccggccttaattgagtattatctttgccaattgtatacatgattcccagagatgtatttttatccaccctcttatattatgtagtttattttgaggaatgttttgtagtatatggccatgctcaattagctttaacattgatcaatgatatcactgccatctgttattaactcatcatggacttgtttaacttttagataactagcaaatatgcctatgcgttgtaaccggtgaatataaaacaaatacagatggttaagattgcatgtgtacttataagttataacacatgttcacaaaatctcgaatttgtacatatctcgcaaatacaaaagttactgcaattttatcttaaaataatagctcaaagtgattaaaaattaattctgtaaataataaatggtatttttggcaataaagggaaatgaataaggcccgaaacctggcggtggcccaaaacagtgtacgccagtatgataattcacgaggcttggtcggcgcggctcgttaagcgaggacgcccttcatcgcgcacggaggcacgtgtggcccgtaacgcgtgcaggcagtcgagtaggccacgggcgagcgcgatggcctagacacgagcgaacgtgcgcgtaggcctattagcctgtgtcgttggattgtaatcaacggccaggattgcttgcggcagtgtgagtaagcacgattgatgagtttatacatgacactaatttattcagctcatgtcattttgaatataaatgatatttttttccagtggaataataattgatcatctagggaaaatgttgagttctgctgattgcatatgttgagttgttgcttctagggaaaatctacttgttgtcaaaatcataaaattctacaagagaaaatgatataaaatacgttagtactgtattcttttatcttttttatattcaagtaattgcatggtattntaccntgnacnaatcctttagcggtgtttgaagaggtttctgaattcttgtagtcctccatgcattggtagaaagtttttaaactattttctgattattcttttaatattttttgcataataatacatacattattgccttgcaatccaatgcaacgagtttggcctacatgttgcatcatatttgtgtagctgagtcccccccccccctccctgcccccggaaatgttcatattagtagtacatatttttgaatttagttacactagcgaataagttttttttttctttacaagccttacgtccgaatttagtaagccatatttgtcagggttatggataacacatacccaataatagtcgactaagtttggcggggcctacaatatacaagtcttatacggaatcatatctcgtatatagaaggagttccagatagagaaggacaagtagagttctacatgaaaactataagtactattcggatcatatctatatttgtctttctaattctacttggacaaggaaacatttatacaagaccccctaggaggagggggagggagataagccagcacagaccaacacgctcagtcagaatagacaccaatacgtgttgccagatatcgacatgagagattagcctagacatacccaatcaggcgcctacagaggccgacgagggatctagcgttatctctgatttcgccgagtacgtattcaaggaggaagactaccccgtcgttgactacgtgttagtgttccatgtcgtcaagtcgacgacgactagataggttatcccaaatattgtacctgtgtgattctaatgaataagagcaacaccggcttcgaccagtaggagtagggcttttaactgccagttaagggcccgaatatgtataaaaatccttgtccctgtctattttacctctatatcgcacgtactccggtaccaacgatcctataccatgtaaataccgtagttatgatctaaaacatcgacaatattcatcatatagcatttgtccaccataagaataagatccttgtaataccgtagttcctgaaatatcatatgaactcaattagtagagcaaatccctgtctcctgcaattgaaaatgaaataatagcctatcaataagtatacgaagagaaagagaaagagagagaagaggaagaagaggaagaagaggggataacatgtggaccccacataatcagtgggtcctacaatttttctttgtgtgaatgaaaaatggatcccatatatatttttttaattctaataccacctaaacaccacatcaacgccacgtgggacaaaaaaaacaagtcaacaccaccatgcaatctccatgctagccaaaacactcaccaaaactaccgaggaaatcaaattacaccgatttcaatagttcggggtcgagatatgtggtaatgtggttcatggatacgaatcggacccactagttaagggagcaaaagtggacctggtgttggcccagtgaattttatgtcttgtggatggcccattaaatcccgtccattcgttcgttttgatcctacggctggatgatgtgaaaccctaggaagaaaatccgtcgaaagataaaaagtggagcagtcgagtgtcttccccttcctacattccctcggcg

SEQ ID NO: 58189 - DNA, 1539 bp, Oryza sativa
gaatgcattgtatctagttttatggtttaacggtttaggtatgcaattcaaattggatgtcaaaatgaaggacctaaagtgaacttattccccggagacgacgatgatgtccaccacgagatggagcccaaatttttcccaagaaaacggcacgagaaaccaggggaatttatatcctctgtgatgcagcaattaatgccgctctagcaacctacccctatcaacacaaacacaaatttctcagcttctcgatgcagcgctagattactatattttgatacggacaaactaatattcatgcagtcggtggcatattaccatcaggatatccccagctgtatatctgtactcagtgcacaacatcacataaagtacagcgtttctgctgctagagtgcgagccactgtaacaaatgacccaaacaaaaaacgatcaattcaaaaaaaaaaaggaaacatcagacaaccgagtagtagggctgcatatacatggacgtggcaacaaactcttgggtcattttcattctggtatagtcaaaaacattttcggccatgccattacacccacagattctattcctaattcttacaaagttctcctgtcatattggccccattatacctgaactctttgttacaactcagtcctcaccgtatcaagtatgcattgtcttcatcgtgctatttgttcattgctttgtgtgacaattagatattgatccaagcctcttcctaatactccaggcccttcctgcattttgcgtgtgccatatctatcccttaatcttcatgatactctgggttatttcttaggatcacaaaaccctcaagaactggtgtcagtggaagatatctgcatatagaaagaacataagcataagcaaagatcaactgacaaatttgaaaattgttctccagatgttttagtttacttttcagttgccagctctgctcgttcccctgcggcaagtaatacaggcgttgaatgcgtctggaatccagtaattgtcttgggtcgacccgcctgaccgacgacgtcaactgcttgaccaacacaaaccggaacagagaggggcttgagatcctcatccacagtcaatagcatccgaggctgtttcagtagagaaaaaactgagaatccatgtgactggtttagctaatatgtccactaccaagatctttgaacgagatatatacctgcatagctagggcaaggatataaagcatgtaatggtacttccccagaatgatggatttcatgtcaaggcaggcatgcagaaccgtcacaagaccagcaagtgctatgctgaaaagtgaagaatggactctcttagaaaatgtggttccaataagattgaaggagattcaacaactttgcaagttactcacggggacagaaggaaccggtcagagtgatatggcgaaagggtcagcaaacccttcccaaggtgaacaagaccttgagcaatcctcacctgaaagtcaaatgaaaaaaactgatatgaaacttgaatacaacagcatgagatcagaataattg

SEQ ID NO: 58190 - DNA, 4320 bp, Oryza sativa
attcctgcagcccaactggagttatagcagaggccaacttcacagcttcttcgaagcagacatctccagttaatcgatagccgtaatcactggttggatcctatgaaagagtatcatgagtactaaatgggcagaaataagtagtgtaaaaaaaaaggggaaagtgcattgatgcacaaatccagaactgcactcatgaaaaaagttcagtaggaggcatggttagctgtctatatcaattcacattcaggacatatcataggtagagacaaattcatacatagaataccaactaaaccggaagggttcaacaagatgctattaaaaatggatgtgctaaataataacaccaataatgcagtaagccagtaatgttgtaaatcaagcatttctgttctcggcccgaactactataaacaacatttcctttacctcaattgggtttgttccaacatcgatcacaactgcacctttcttcaaccagcttcctcttacaagattggccactccagcagctgagatcacaatatcagattgacgggtaatctcttctggatttgttgtgaaagcatggataatactaacagtggcatggtgtctctgggagaaaaaaaatcaaaaatactattagtttgtcacaatactggccttgtaataatgaagaataatcaaggtaatagcttggctttacctgtaaaagtaaagaagtgggcaacccaacaactttgcttctcccaatcacagtgacatgtttccccatgagttcaatcccagactggagcaataactcaaggcaagcctttgcagcacagggcacaaataaaggcttccggcttctgagggcaagattaccaacattcaatggatggaaaccatcaacatccttctctaggctaatagcgctcagaatcctttcttcatccatatgctgatttagccaaaaactagcatgttaaatagctagcttgatgttcattatgtcaatattgaaaatgaaaaaggcaaagcttggatgtaaagtaaactgaatcttaacaaaacatactaaaatgaaaacaaaataaaggatagctgaagttggctgtctattacaatgacaacaaaagtagtttgcattagtcatcgaacaaaacaatcatctaattggtgcaaatgaaaggttttcataatataaatctacaaacttaatccaacttcctgcagctgcaacactagaacactagacagtaattacctgtggtagaggtagttgcacaagaatgccatgaacagatggatcttcattgaatcttgacacagaatccaccactacgtcttccgtacagttcccaggcaactccgccaacaaggactttattccaacctcctcacagcccttaattttgtatcgcacgtatgactcagagtcccttctatcgccgaccaatacaacagctaggccaggcacatgccccactgcatttttcatttgacgaacttcttcagcgatctgaaaccttatgtcttccgcgacagacttgccatcaataatggtcgcagtggagtcataatcaactacaacaaagacaaaagcacaagtacagaacatcaaatcattaacataagaagctaaacgacaataacataaggctccctgtatgaccaatcaatagtgaagaactgaagcttcacagtcttttcatggaaatggaagcgtccacaagcatgaagggtatcaacctagaaatttccctacaacctttgcaccaactaaaccaaagattattgcagccgccaaataaaactactctatactctacagcatggtttcaggctttcagcttggcacaagtaaatctataatttttttcccactgcacctttccatttttcagccttacactagcattcattccatttgaattaacattctgttctaccaatagctccattctcggatgtcatcattcattagcaacaacagcaagtctttcgacactaaactgctacaggatctggaggtgggttcagcaccactaagctgctaatctccaagtgggttctgcaccaatcaagcgagaaccactgaatttaagtatccgcagcacgctctcaaaacccatgtactaaaccccaaaaccatccgaatacttcgaatggcatctcccggcgaaaccactggtcgacgaagcgcacgcctagcaaaagcttcacatcagcaagcccgccggttacctccggcgccgctcgggggagacggccgcgccgcggcgcgcgggggcgagtcccaggtgtcggggatgtccggcccgagaaggcggctgctgctgctcctcctcctccgcctcctccgggtcctccccttctcctcctccgccgccggagcagcagcctcgtggagccccgcgcgggccgcgcgagggaggaggaacgccagcgggcccgcagcggggcgccggcgagtggccgcgagcagggccacggcggcggcggcggcggcgccgcccatctccgtcgaagcggcggcgagcgcaacgtgtgtgaactcggaagcgatgtggatgtgtggatggaggatttgggccttttgggccctcgacaaaaagagatatttttgtcatgattgttttcccttttcttttctttttgaaactttttttgtcacatttttgggccacaggtttgagtttttgatgcattttttctgaaaaaaaaaagatctaaagtagcaggaagatactgtgcttgtggaagatgctgtttctgatgtcattgtcggggtatattctgatgaaatctttgcctgatacttcacaacaatccatcgaaatcgttgtcgatgtatttattttgaatgaaaaatccttgctaagaaaatagagaacactggattgaattgtaaatttaaaattatgttttcttaaaaggttttgaaattaaattaactcgaaaaccaccatatactttatgctcggaccaaaagaaaaaccaaggggtaatatgtttggtgaatgtccaccatgtcaaccatgagtcatcttttgcgtttcaacttactagtcacaatcaaaattcaaaattttacagttagttgattttaatgtttctttattttaatttaatttctaaaacacaaatataaaaagttttatgcacatttttttcccgccaataagcataacggcttatgggcaaaacgatggaactgaagtcatgtacaacactaatgtgaccagttgaggtattttgttgtaaatcatgattcattgatttgaagtaatttattttagcactttattttgatgttgttttctgtatggaaaatgagataattcaacatctttttatggattgtcattatgcaaagtttatatggagagcagttcagttatcttttataccttcctattagcatatctcatattttttatgggcggctgttggggtgaacaataaaaagagtaaacttatattagtgggagcttatgcaatatgttgggctttgtggttgagtaggaatgatatggtttctgacaaatcatcatctattttatatatgcagataattttcagggcaacatatttgctctggttttgggcacaactacaaaggtgtgatgaactcgaagagttcttaaaagttgcacgtcgtaagcttgagacaacggttatgcaacttttgccaattatagatggagattcacaaatagacttcaataatgtgttctccttatcttatattggttaatttttatatttgtgtggtgtttttttttcttatttgaactaaactcattttagagtgttagattgtaacaataaactgtaactctcctgagcagaggccaggacgttatattccattattaaaaaaaaatagatctcaccctctttagaatttattataaccccgtcacgattggatagaaattaagtaatccggctagggctgagaatactcgttagtacaaacagatctcaaagatggtctgaattttagtgagtactctacatgatacattcaaagtcgctcgtaagaataaggtgcgcgcgtgttacgagagtttctttttctcgcctgtctttggaaaaaaaaagttcacccgtatatattctttccgacctgggccctgcaaaattccttcgaagcccacacaacaaaatacgacaacagtcgggccactccgcgagttgggcctagcagcccaacctcttctccgccccactgccggtcgccgcctctcgccgtctcgcgtcgcgcgagctctgcctctgctccggcctccacgccccatcgccgccgccgccgccgccagcctcgttttgcgccaccgccatcaa

SEQ ID NO: 58191 - DNA, 1541 bp, Oryza sativa
atgccccggcgctccacctccacctacaacgccatgctcgccgggtactccgccaacggccgcctcccgctggcggcgtccctcttccgcgccatcccgcggccggacaactactcctacaacaccctcctccacgcgctggcggtctcctcgtccctcgccgacgcgcgcggcctgttcgacgaaatgcccgtgagggattcggtcacctacaacgtcatgatctcgtcccatgccaaccacggacttgtgtcgctcgcgcggcactactttgatcttgcccccgagaaggacgccgtctcatggaatgggatgcttgcggcgtatgtcaggaatggacgggttgaggaagcgaggggtttgtttaattcgaggacagagtgggatgtgatctcttggaacgcactgatgtcggggtatgtgcagtggggtaagatgtcagaggcaagggagctatttgataggatgcctgggagggatgtcgtatcctggaatattatggtctcgggttatgcaagaagaggggatatggtggaggcaagaaggttgtttgatgcagctccagtgagggatgtattcacatggacagcagtcgtgtctgggtatgcacaaaatggaatgttggaggaggccaggagggtgtttgatgccatgccagagaggaatgcggtgtcttggaatgcaatggtggcagcctacattcagcggaggatgatggatgaagcaaaggaactgttcaatatgatgccctgcaggaatgtggcatcatggaacacaatgttgacagggtatgctcaggcagggatgttggaggaggcaaaggcagtttttgacacgatgccacaaaaagatgcagtctcctgggctgcaatgctggctgcatattctcagggtggttgcagtgaggaaaccctgcagttgttcattgaaatggggaggtgtggtgaatgggtgaatagatcagcattcgcttgtgtgttgagcacatgtgctgacattgctgcacttgaatgtggaatgcagcttcatgggagattgattagggctggttatggggtgggatgttttgttgggaatgcactcctagctatgtactttaaatgtgggaacatggaggatgctcggaatgcattcgaggaaatggaagagagggatgtagtttcatggaatactatgattgctggttacgcacgacatggttttggaaaggaagcacttgaaatttttgacatgatgaggacaacatccaccaagccagatgatattactctggtaagaatttgtttcttggaacataccacatacaattagtgctagcacaccaatttgccgataactaaattcagtttatctcctataaatggttgattaaatctgtagaaagttcacccactttcgataaaatatttattataaatgctaacagtgagaactgtcccagtttagtaaaaagcaatagtaaaaagaactccctggttttttaaaggtaatggagatttcattaagcaaatgaaagcatctagcttctgcacaaaagtgta

SEQ ID NO: 58192 - DNA, 7548 bp, Oryza sativa
aattcctgcagcccttcattcatgcagagctgaacccgactaaatatttccaacattattaggttatcaaaatgctaaagtttcagagatacctagctgctatctggggtgcacttcttaggactggatataattccaacggtttcaagtacattgtccaagaagagcacatactaccgctagtagtatcatccgttgcctgaaatcatgtggcagggagcgcctccgtaatcttcatcgccttcggtttgttctctcccttgatgcaagcaagaacttcaccacaagcctcatcgacgggcggttgtttgggaggttcttaacgcagagcagcgcaatcctcagaactctacacatctcatccttgaaatgttcagcaatcttctcatctagcactgactctgccccattctgctccacattggtggctgcccatgccaccaggtccttgtcaccaatatcggatgacatgggactctttccagtaacaagttccagcatgaccacaccaaagctatatacatcgctcttctcagttacacgtatagtgtaggcatactctgcgatacaaaacagacaaacacacataagaaactaggaagaaattacggtgacttatgacaatttttagccaattacaacaacccacaagtacaaaaagaaatcctaatcagaacatatggaccaaaaaagactgtctgaactgatcatcaaatcaatctcaaaagctacattcatatatactctaattaggaacacttctcagaaacaaattaggaacacttctcagaaacaaattaggcataaggaactcaccaggagcaatgtatccacaagaaccagcaatgacagacatggtggccggcccatcaccaatagacttcgcgacgccaaaatctgctatcttggcacgaaaatcagcatcaagcagaatgttgtttgacttcacatctcggtggatgatcgcgggaacaaagtcatggtgcaagtagctgagcccctcagcagcatcgagtgcgatgttgtacctcgcaggccaatccaagatgccagctttggcactgtggagaaagtctcccaggctgccattaggcatgaactcatagacaagcaaccggcatgcctcgttcgtaagacagcagaagagcttgacaatgttcttgtgcctaactttgctcaatgtttccacctcggcctcaaagctgtcgatcttcttgctcgccaccgtgctacttgcccaaagcttcttcacagccaaggtatcactcctaggcctgacaacagccttgtacaccatccctgatgaacccttgccaatcaaattgttctcagtcaggctattcacaatgtccctctcattgaactccaccttgtggaaggatgtgagtacccactctgaattctcgctgtcaacttcgatggcgcgcttattgtagctcctatacttgtaaatgaaccaggcaacactcgtgagtagaatgccagcagcagctgtgaggatggctacagccatctggattcgggcacgccggttggaatcaggatcaccattccttgaacatagcccatagcacaggccaggattacccaagaagcacggtcggaattgatcagtgtcgaataagattggaagatgcccagtgagcttgttataggacaggttaagaacacccagcagtttcagatcctgcaattgtgcaggcacctgaccagaaagctcattgttcgacaaatcaagcgtgctcatcttatccatacccccaagctcttcaggtatactaccactgaggtggttgtctgaaagattcaacaatgtcaaattcttcagttctccgatgctgcgcgggatctctccagaaagggaattgttgctcaaatcaagcaggaaaagcaccgaaagagatgcgagtgacggcggcactgtcccggtgaagctgttgtccgaagccgacagcaccaccagctgggttaaattccccaattcagcaggaagaacaccggtgaatcgattgttatcaatgatgaggttggacaggttcgcggcacggccaatggcggcgccgacattgccagagaacgcattgccacggagctcgagcaggtagacatggggcaatccccagaattccggcggcaccgggccggagagccgattgcagggcagcctcaccctcatcagcgacctgcatttccccagctcgtcgggaatggcgccgtcgaacatgttgttcagcagcaggagctggctcagcttcccgccggcgcagagcgtcgccggaatccggccggacatgcggttgtccgagacgtccagcgactggagcgggcagttcttcccgaactccggcgggaacggcccttcgatctggttggcgaagatcatcagctcggtcagcctcgccgccgccgcgagcgtcgccggcaaccgcccggtcaggttgttctgatacatgtgcacgctctccaggctcggcgcggcgaacatgtcctccggtatctcgccggagatgtggttcatcgagatgtccagttgctggagcttcttgaggccgcccaaccccgccggaatcctgccggagagctggttggagaagagctctatctggaccaaagaactcaagttcacgatgctcggtggtatctcaccggtgaggttgttgctcgagaggtccagatcgacgaggttggtcagcttcccgacggaaggagggatgctaccggtgagggagcagttggcgaggaaaagcacgcggagcgcggcgaggtcgccgaggttgtccggcaatggcgacggggagaacgagttgtaggcgagcagcagctcctggagcgcggttacgttggcgaggaaccccgggaacgcgccggagacgaggttctgtatcaggttgagcaccgccagcgacgggaacccgccgccgtaggccgccgggagctcgccggagaagttgttcgacgcgaggttgagcgtctcgagcgcctggagccccgcgaggcaggcgggaagcgggcccgtgaggtcgttcgacgacatgtcgaggtgccgcagcgaccgcagcgagcagagcgcgacggggaaccccccggcgaggtacagaccgccgaggtagagccccgcgacgacgccgtcggagacggcagcgttcccggccgcggcgtcgcacgccacgtgcggccagcggcagaggtcgtcgccgcgccatgccgagagcgcggcggtcgggtccgtgagcgcggccctggcggcgaggagcgcgcccgcgtcgccggacgcggcgccgccggtgcccgcgcggacgcccggcaggaggaggccggcgaacacgacggcgaggtggagcaaccgccggtggagcggcgccatggtggaggtggtggaggtagagtggggagcgtgggtgggaggaggagaggtttaaagggagggaaggaagttgcataggaggattggaagcatctcctcctggggtggttttgtcttttagatagacgaacacattgaaagcgatgagggttggggattttggctacagctaccaagggaagtgtccacacagggagtattatcactacgagatacgcttggatgtggtggtccgcatcgaggggaggctggatatagcgagaggttgtacggatcatgtagcaagtttggaagatatctatgtggtgaacgtggcaatatatagaatatgctgctttttccgtacatgtaaagtcaatgcgcttggctgacgtatgagaaacgtatccggacgttgagttacagttagatgttggtaatggtacgctggcgttggaagaaagcaattgttccgatttttctatgttgacaagatgattgtggctttggctttcccaaataaaatatattattttagttgcttcaaatagaattagaaaaaaaactgcaaaaatatcttacgttacaaaagcgtcgataagataacgtcggataaaaaattattcaattttgtccatcttttcttaaagaggagggctatatttatctcaataatttatgatgttcttgctataccgattgccattaaaatagtataacagctaaaaggtatccgtatttcaagtatgagattattcctcggcattgtaagagcacatttagttagcaaactttaatagaacctttggatgtggcatacgattgagtcatgattttattttcaagaaaaaaaaagcaagaatatatcatctgggaacctcaccggttccaaattaaataagtatgaaaaacaaaccgttcaagatttatctcctgtctctactctatcaatacattcatattcctctaaaaaaaatgcattcatattttttttcatcagttttggtagtggtggtggcccttgtgtgcaaaaagaaatgtgctttgctggggttcgtctcctctgctattagggagtactagtagcgttttacagtgaaaagtaccgtaattattttatgggattactgtagcaactactctcctgcattcattcaaatttgatccaacggctacaaatagctattgacatggatcagagtatggagttctctaccattccggttgggatggcagaggatactatcccactttgctgtggagtacacggtcccgtgtggacgcagcgatatttgcggttgcttaattaagtcagtgtttgggcctgggaaatgcgggaagcgtggtttggttgggcctcgttttccagcgttaaacagtaacagcaacgcctcgtcttcttcttcctctcgcctgcagtcgcacgcgcccagaggcgccatgcacgccggccgcaagcaagggaccacgtacgtactgatcactctttctctgcatgcagctatagccagcttcaagccttgatcggtctgctacgatctggacgacgcgctcgctcagctggatggatggatgcatcagcgtttcgcgcgcgtggccttcctgctccaggtgattcttttgttgcttgcgctgtgccgtttcttaatttgtcttgcacgcgcggctcgatcccctccctttctatctctgccttggccatctctgccactgaattgagaagtgatgcagggatggatgggttggaactgggaggaagacgacgacgacgacggctcaagctgttggttgtagatggggggcgttttggaggattgagatcttctgtagccgtcgacttcaccatgccattatcactgatatgtgagcccgataatatatcgggcctacatgtcagtggcaaaggtacggtgctagataatcctgatccgtttttggatggttgtgcagcagcgagggtgcgggaggaggcgcccgccccggccgccgccgcgcgcgcggcgtgagcgtggctttccgcgcggcaactgtggctacgggagtggctgatcctggccggtgggctggaaaagctagctagctcgttgtttgtgtgttgtgtacttgtgtgcgggaaggttgtgacagatggaccgcatgccacacgcgcacggcgcgctagcgctactctcctcctccctgcatgctccttatatggtggtttccggagctgtttggcttcgttgttcgtatgctcttagagctagagctggtacaataacatactattagccaaatgtaacatattttaatgagataaaagataagaaagaagaatagcggactacagatctgtagccagctgcagcgtgaactccaagacgcaatgtgtgtatgacatgtatggccatatatctatctattatattattaaaggaatagaaaaaggagcctccacgttcgctctcatagcctagaaattctcacattaatcggagaaaaagaaaagcagagtccatatagaaatacaatttagaaatagctgaaattcgaaattaaaaaataaggaatattagaagaagagactagagtccatatagaaatacaatttagaaataactgaaattcggaattaaaaaataaggaatattagaaggggagactagagtccatatagaaatacaattaggaaataactgaaattcgcaattaaaaaataaggaatattagaagaggagactagagtccatatagaaatacaattaggaaataactgaaattcggaattaaaaataaggaatattagaagtagagtatagagtccatatagaaatacaattaggaaaagtcgatagaaatttgtaattaaaaaataaggaatattagaagtagagtatagagtccatataggaatttaaaactaactaaaatttggaataaacataataaaattaaaagtagagtctagagtctagagtctagggtctagagtctagattcagagttaaaaataaagaaatattgaaagacgagtttagagtccatataggaatataatttacaaatactaaaatttgatattaaaaataattaataactaacacgtatatataataaaatataaatattacacattagtagtttcgtaaagttagtataaaatttaaaattagaatatcatttttaatatatttgaataatacattgagaaaacatatatgctattacatgagaaaaaaaatataatgatgctagccgcgcaatctgcgtgggccaccgtgctagttaatagtatagtaagcaactattatataaattggctattaaattgactatagatgaattggagctattagtgggctatactattaaacttgctcttacatgacacggaaaaagatttttttgaaaaaaaaaagcaattagcgtacgattaatataatatggagtaatttagtacaaataagttaaaaagaatcgtttttacatatcataataaaacgaacgaatggagttagctgcaccagtgatatatgccaagctatttagctgtcccctagcttggtgtggctaggctagtaatccgtccgtcttattttaagtgtaaagatttttctatatcaaatatttgaccgttcgtcttatttaattttttttaaaaaaatttcacacataaaaatattataaaatttcaaataagaccgactgtcaaacgttgggaacagaaactcacaaatgcacctaaaatgggacgtatggatacgtgcagtaaccttttctggttttgaaacgatagtatatttcatgattaccatacggttttcacgataaccgcacggttaccacagtaaccacgaaatcaggagtgacgatgacgataatcaccctaaacggtttggtaaagtattgagagttgtgcagtataggagactagttactagtatagttgtacagtcatacaaagctatgcactctagcttgttataaatgatttgctggtcatttctgaaccttttgcagagtttggcaacgaatagatttcttaggcattgtttagttcccacgcaaaaaactttcacgatatcacattaaatatttagacacatgtatggagtattaaatatagaaaaaaaactaattacacagattgcgtgtaaaattgtgagacgaatattttaagcctaattgctacatgatttgacaatgtggtgctacagtaaacattt

SEQ ID NO: 58193 - DNA, 2442 bp, Oryza sativa
aattcaggggcccgaatctgtataaaaatcctcgcctccgtctctttacctcagtctcgcgtatatcctagtaccaacgatccctataccatgcaaataccgtagtcgagacatcaaacgtcgacagtggcgcgccaggtagggggattttggtgcttcaggatttcgacaagatgggtttaagagatggactctccgacaacaagctattcgacgacttcggaccaggaagatccaacccggccagagtacgtctctcgatgaggttggaatcatcgtcatcaactatttgatccggcgagatcgatcaagctccaagatatcatcgccgcgaaggataatagttcaatatcgccagatacgggacttcggttcatgtcgactacaacggaacttgccgatctacgatcataattggtcccgaccgagtccaaatctgattacgtgcgcctgtaaattctcaaaaccggctggcggctgcaccttgtgcctggatagtcctactcggacacgatgacaagaggatgcacactatacgtgaagtctgtacagggaactgaagcacgtgtccaccatgtgacgggatgccacccgttttcaggtatttgatagattaattttttaaattaatctactaattttgtagatatatccggtatatatctacacaggtacgcaatattttcgtacctatttttacaatctatacagcattgtcagatctatattatgtttacctagagcatgttttttatacaatatctattgcgcgagtgtccccgatgttaaatcgacaacggtttaacgctggggctcgctctattttcttctgtataaatcatgcttgtttacggtttacataatgcctgatatttatatctgctcgttatatcctgataatactagaagatacatgcagttttttgagtacatactcgatattctctgctatatgtcttgccttctagaaaatatttttcatgaacaattgagcacttgagtaggttgtggtcaagtacatcgcattgtcgagaacgatctcgacaaatgcagagtcgttgcgcccaacctaccaacaaagaccgacgacctatctcatagcaccggccatggctggactactcgagaaaaggtgttaacggataattcctcgggaacgccgttggcttgatcacccgacatgattgcgaacggacatccggatatgctacaagtggggtgtgtgagtcatgctggccacatgacacgcacatgtaataaaccaactctagcacctccattggtgttcgagagatgattctactcgctcgctggttctcgaaccagtacgtagcaatctctcgcaccgcaatctccattggtgttcgaaagatgattctacatgtttgttggtcctcgaaccagtatgtagcaatctctcgcaccgcaacctcagatggtcgaggtacgactacagcaataacgcagcggtcctcgcaccacgacttcaaataatcgagagacacctacttactggttctcaaccagtcaatcgtagcgatctatcgtacatttacttctagtggtcgagtttagactacatctggttctcgaccagcggtgtagcgattctcccactgcccttaattctagtggtcgagtttagactacatccggttctcgaccagcggtgtagcgattctcccactacctttacttctagtggtcgagttacgactactacctggttctcgaccagcggtgtagcgattctcccactacctttacttctagtagtcgagttatgactactacctggtcctcgaccagcggtgtagcgattctcccactacctttacttctagtggtcgagttatgactactacctggtccttgaccagaggtgtagcgattctcccattacctttacttcaacaaagttgatatcaggtacacaatatcgccaactgttttacccagagatcccttaccacgatgacacctagcgttgaaacctatcctactgttcctttacgctgtcttgacaaggcctctgaggaatctaagggaactttagctgggacgcccagagccgataaggccttgtcggatccttcagagacgaaagaccatgtaagatctggtcgtgtaagagttctcgccgtgcgtattaaccaagctgtgtaatcagaaatggattttccaacttcacggctgggggctaggatcagtgcttattcaactaaggcaggtcaaaggtccaagagccttatcctccgagaacgattctccgacgacaatgctgggggctagggagagtgtataactcaacaaactgactgatcgaagtcggtaaaagagtagacgctcatatacaaaacattggtctgtaagtttaattcattttcggttttccatacatattataacatgttaccctttgagcgttcgctcgggggctat

SEQ ID NO: 58194 - DNA, 10049 bp, Oryza sativa
attgaaagtacataagagagtaagtttgtgtccttttggacactttgtcaactcttaaccctcatttttcgcacattttttaaactgttgaactgtgtgatttttgcaaaaaaaatataaaaatctaatttaagaaatatttaatactaattaatcatgtgttaatccattgctttatttgcgtgcccatatgaaagggttaccaacactggctatcgaacacatcctaatgattgcataaaatatgtagtcttttcgatttcatattggtatgctattgaacacaatccaatagttgtatcgagatgtgataaaataaagatattatagtatttttaattttgtattggtacgtgtagaatgtgtgaaaaataaacttattttgggacgaagcgattacgcaatgatcgtattgttcaagttagagggagagaccacgagacaccgtgttcagaacacaatagtctcgcaggactcgcagtgaaaatggttcaaaacggcagagaaagtatacggagataaggccagcagagaagcacggggcatgtcgagtctgagattcgagaaaggcatggagaaagaagctgagcagcagggtttacgattccaatatgaacttcagtttcgggctctggtgaaatgacggttttcatgaaatctggtgaaaagccggtaaattctgaacaaatttcataaaccaaaatttgaatacaaataccttgagtttatcgataagcttgcgaaaaccagtcgactttagccaaattccgagcgaaatcatcgaaatttaagtgttttcctttttttagtttgttattcttttctttcctactataaatttcagtaaatacacagaatacacctttttttcaaaaattacgaaaatcatactatttataagatttcaaatttgaatttagtcgtgtttagacacatgtatggagcatcaaatgtggacgaaaaaaccaattgcacagtccgactgtaaattgtgagacgaatcttttgagcctaattacgccatgatgtgacaatatgatactacagtaaacatttgctaatgacagattaattaggcttaatagattcgtctcgcagtttacaagcggaatctgtaatttgttttgttattagtctacgtttaatactttaaatgtgtgtccgtatacttaaaaaaattttggcacacgaactaaacatagcctttaaatgaaactcatcaaaatctcaaacggcttctactttcgagtctcgtcaaaatcttaaagttttacggaattcgatcggttttcgtcgaaattgagaaccctgctgagcagaacaaggatttccaattgtaacgccccgattttcatttgggataaaaatcatttaataatgcattttctagaaattaaataaaagttaaatcaatttaattaagtgaaataatgggagaattaaaattttccattaaaaatcattggccgggaatattttgtaatattctttgtgccctaatacaccctccggatttttccgtgaattttcggagctcaataaataattttaatgccacaaagttcactaaatcaatttaaagaaaaagaaaaaaaaacaaattaaatcctccttcctcccttttcgagctcggcccaatcctctctccttcctctaccgtggcccggcttgcctccccttttgacgcaagtctgcttttcctccctctcggcctcccctctcactcaggccgacaggtgggacctgtgggccccacctgtaatccccgagatctagccaggccggcaactgccgcctgagccgctcccgcgtcctgccaccaccgcagccttcgccgccccgcgggcaagcccggagccgctcccccattccacccccgagctgccctctccacggtgaacccgagccaccgtcgccattgccgcctctggccgccaatcgctgccgctctcgtccgtcccgcgctacaccgtcgcctccctcggctccgcaaggacgaggagaacctcggccacctcttcccattgccgaaaactcactggacgtccgttttcccgtacaccggtgagaccttcctcccttccttccctctccggccggccatgtcgccgccccgtcctccctaacgcctcccctcccatcccagggtgcagctgccgctcatccgcctcttcccgagcgccgcccgccgtcggagacgccgtttcgccgcctcccgtgccaccgccggctgcttccccggtgtcatctcgtcgtcgccgccctcggggagaacccttcctccctctgtctccccttcaccggccgccttgcgacgcgccaccactgccggtggccgtccggccggttcatcaccaccgcgccgctgccggctatgctgggcagccggttgccgcctccccttgctgcgccgcgccaccgccgcccgcatgcgccgctgctccccgcgccatcgccggccgtcgtcgccggtggccgcgctgccgcgcgccgtcgctcggtcgggccggcttgagccgtgcctgtgtcccggctgcgccgccccgtggccgcccgatcggctaggaccgatccgggccgtcggttcccgtggaccggcagtggaccgcctcggtggtcccggtccacggtggaccggcgcccttgtgtcgctgaccggtggggcccgcttgccggcgccgcccctcccccttgatgacgtcagcgcgtcccttttcctttcagaaaataattaataattgcgcaataaatcagtaataattctagaaattcatttaaatggctcgaaacttctaaaattcatatctaattcatatgaactccgaattgagccattcaacttgcaaaattcatctaaaattgagctctacatgtttgtttagtttttatgtactttttcgttggtttttattagagtttttcctcgttttgcgtgccagtgtgtagaatccgtcgttttgaaagttcgcggtcgcaaggataagagttcggaagattgtttgaagaagcaatgcaagtcacacattccccttgagcattttgatcctaatttacaaatattttatcgtttgcaaataaaattgcatgtcttgctaattacatgggatccgggtattacgtgccatgtttacttgatatctgtactttgtcaacattgggtaataaatcgactagctcatgttacttatgtgacctagctagaactttatgcttagccatgcttaattaccactagctcagttgatgcgataattacagtattagacctttttagtatcagaatgagctgcgtgctcgagacatctggccatgcttcatggtcgtaattatccaactaaaatgcgactgaatggtgggctgtaggtgtatggttttgctagtcgcacccatggcaattaaggaccggttcgcgggatgccctggaagaacttatcgtacataccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgcggtgtggtgtgcttggttagagggagttatgcgaagggtcctgtcatggcctctttccggtatgtcatggtggcatgtcggcgcacggaaacgtgtcgtggggctgtgtcttgtgggaacagttgtacacctctgatcagagtaaaactattcgaatagccgtgcccgcggttatgggcggttgaccagattcaccgtgaaatagtctcacccctaataaatcgacctaatgcactgtagttcaggtgggttgggcctgttcaatgtggtgtagcgttgatcagtggagatctaatttactttaattacttaacagttttactgttttgctcaataaaatattttacaaccgcctttatgcaaatagccacaaaccgtccttgtgttccccttgcacgtctgcatcgttggtgtggcttgctgagtacagtggttgtactcagccttgctattatttcccccttttcagaagtgcagtgcttctgagctgaagacgaagttagaggaccaaggctcagaccctagttgagttttgcctgtggagtggagctgaagccccgtaggatcgtctttttccgctgctgtcgttctctttcgtgtgaggactaagtgcctcttctgtaagtattttacgctttatttacgtttagaactctatattacttgtcgtttttgtgtaccctgactggttctggatatggatttaaaatttgggttaaatttctgtgagtgacaccatttctccatggtcctcctctctggccgagcctttacctttgcttccgtctcttcgagctgctgctgccacctttcgcagtgatgtgagagatggccaagctgctgctgctgcctgctacggggtagctgtctttcacgtcagcccgttgcatgcttgcttgctgccctctctttagggtgtgttcggacccaagggttcccaacccttctcaattgtatttaacgtacatgctttttaaactgctaaacggtgtgttttttgaaaaagtttatgtatgaaagttgcttaaaaaatcaaattaatctatttttttaaaaaaattagcaaatacttaattaatcacgtactaatggaccactccgttttccgtgttcacttttccggatgggaacttttgtagcgaacacagccctcacgtttgtttttaccagcacagttggataacatggatgcacgtacgggatcaaagacagatactccctcgtaaaaaaaaaacacatgtgtccaagtacaaacacagtatccaagtacaaactcaggattagatattttttgacagaggaagtatatacctaccagcaaggaacacgatgacgggaacgagggatgatacactcgtctctactataactaggtccaactcccacatatacactatccgtctcaaaaaaaaaaaatcaacctagcaggggaggggatatacccctcctaggatgatccctcctaggtcacatctccgcctagattttctttttgagacgtagggagtacaacttttgtttttatcgtaaaatataatagattttattcaccaaccctcttatttcaaccaatcacatatacttccatctaggggtgaaaacggttacggaaattcccgatcgaccaagcgccgtttccgtataagaggtacctttttagctatttttaagttttgttttttcttatttctttctgtatcatattaatatcgacactgagtagtttaaatgataaatatgatcaattatctttcttcttttcttctcttatgaagtcatatcaccttaattttcctttagatgattaatgtatattatcttccttattttccttttctcattgagacacattactttagtattgcttttaaatgatcaaatatattatttaaactgttataaaccaaatcattttaattgtttatagctttttcaatagtgaaaattatataaaggatataaagttatgtcgtgtagctatcttgcaggttagttttacatttggatgattaatctatgttatattttttccctaatctcattgagctaatacattactttggttttgctttttattgatcaatcataattgtttatagcttttttttcaataactgatcaaagatgaaaatcatataaagttatatcgcatagctacatttaagttatttctactattatgataaaaaaattcccgcaaaaatttctagttagaaactcctatttcgtaaaaaaagtgtaactctagactactatgggttcatttggttccactagaaaggctaaatatttggaaccagtaaaaagacatgcttttaggagcaagctagccttacagggtgagaaaaatcccgctggccagggagagccgatttagctcgccttccatggcaaaactccaattgcaaaaacaaaagagaggaaaagctctactcgcacgaaaaaattaggataagataagaacgacccaggcttctctgaaatcagaaatcagagatatttctcgacaactcggcccaatctcataggcctcttctcccacctctcgctgacgaagtctttccctgaaagcatcctctccacctactcataaaagtcacagccatctggagaaaaatcgattagggaagaggcgaactcatccgcaaactcgatctgaggcaaatctattcacacggccgctcctggatcttgtttctctttttagaaacaaaacgagaagcaaaataatcatcggcagagcaagaatttcgtacacgatccaaacagctacccactatttcttgcctcaggaagcaaactaaacacaggaggtacgacaaggcaagcaaactgacaatgagatggtttaacctcaccgagctaggttacttgcgccaagatccaaatataatgtaccctatctctccctttcaccaccccttgttcaatttttttccatctgaccactaactaggggtatgcattagatggtttgttttattttaaacaaaattggtcatctaaaagactaaaagtgtctaagaccgagtaattgttcggtcttttatcaaaacagaaatggttgacagtttcataagagcaagtttaatagtatagcccactattagctccaaatcatctatagccaatgcaatagccaattcatacaataattgtttactatactattaatacatggtcccacatgtcatatacacattgcgtcttggagtccgtgctgcagctggctacagatctgtagcccgctacttttctctctcatcgtttatcgtattaaaatatgtttatagctggctaatagcctgctattgtacctgctctaatgctctaagattataattaaattttggcaacacttctcttcttttaagatttctttactgctctcttgaaatgatcatatatatatatatatatatatatatatatatatatatatatatatatatatatatatatatatatatatatatatatatatatatgtatgtatgtgtatatatatatgtatgtatgtatgtgtatgtatgtatgtatgtatgtatgtgtatgtatatatatgtatatatatatatatgtatatatatgtatatatatatatagacacacacactgcatataggtaggagtaggatgcgacactgtaatctgacgtggataacaagatggattgggagcccctttcccatagattttgtgagcaagcatagctgcatgggcattgggcaagctagcagaattgacgtgtgtgtgctgcctgctggctaatgaccggtggtctcaactctgaagagaggcgtggcagaaaggggtatggtttcagttgggattctttccaagcctcctgcaagattctcaccaaaaggcagcgatagattcgaaaggcaggggatactctcgtgaccattgaggtctttgacgagagccttgatggcgtgaggatgtcacgacatttttcttttttttgttaaaaggaaatttggtcttgaaggattggaatgcaaacttgttctaattaatttgtgtttgggaagtacattaacagaaaagtgaagcacgaaggtacttaacatccaacccaagaatcactagggctgtgctatcgatcgaccacatcatagtttaggacaggctttccttgaacaaggtatctttacctctatatgtttagactttagaggagagtcgacagtactaaaataatcccttcaaattgtaattttcaaaaggctcagagaagcaataaaggaataaaaatccaatgacatcaagccgtcaaagggcttcatctttttcttatgcttatacttatcatccaagatttaaattttcaaccatcaaagtttatttttcagtcgttgcttttagatcgctaagaacacgtatataaaagttttattcataatttacttttcgtttgcaaatacgccgtttcgcgatggctccgaatgatttgccactggccccttcctgtgagtgttagagcgcaacattcataggtgtgcatgtgtgcatcatccgtgtaatagaaaaaaatgttcaaagagttttgaacggtaaacaatatcttaacaacttaaaaattgataatgttccattcgtcacatcattttttttccataagtctgatggagcgatggcctccgtttccacacgcgcgagtaacgcatcgcataagacggataaagcacaaattcaaagatagatcaattttttttcagtccgtcattctcgcatcattccgagcccacatcaaattagatccggtcgggatttcacataatcagtttgtgttacacctgtcctagaaaaatccctaatttgtagaaaccctaattttcaaaatctcctcaaattagatcccaaatacaagaactataaagaatggcaggcaaaaaaaaaaacctaaatcatggtcacaccggtttagatcttcggccgcaaatatggcatgatttcagaaatccgattctcgcccttgactaccgtgcacgcaccctagccgtgcaacactcatgagtagaatgccagcagcagcagtgaggatgggcacagccatctgtattcgggcacgccggttggaatcgggatcaccattccctgaacatagcccacatcggaatcgggcacaggccaggattggaagattaagaacaccccagcagtttcagatcctgcaattgtgcaggcacctgaccagaaagctcattgttcggcaaatcaagcgtgctcatcttatccataccatacccccaaactcttcaggtatactaccattgaacccgtcgaacaacggataagatgagcatgccggtagacgacgtactcgtcgatagcgagacgcctatgattacttcatgaaccacaaaatatgccggcccagccttccagatgtgctcatagcggtagtgcgcgcgcgttatgagcatctacgtttctattgtgtatccaaaaaagaaaaaaaaaatatgctttatttattagggtacactgtcccgtgtggacggagcgatttaatttgtggttgcttaagaggaagtttaatagtatagtcaactgttggctccaaagtatatatagccaatttaatagccaattcaaacaatagttgtttactatactattactatctggtcccacttgtcatatacacattacgtcttataatccatgctctagctggtgacaaatctgtattccgctgttcttatctctcatattttatcttttaaaatatgtttatagttggcttatatcctgctattgtactcgctctaagagcaagtttaatagtatagcccactactagcttcaattcatctatagccgatctaataactaattcgtacaatagttgcttactatactattgatatatagttccacctgtcatacgcacattgcgtcttgaagtccgtgctgcatctggcgacagattatagcccgccgttcttctctctcatcttttatctctttaagatatatttatagctgatttatagtatgccaatgtacttgctctaagtcagcgtttgggcctgggaaatgcgggaagcgtggttgggctcactcgcttggcagtagggatgaaagtggttcggatactttccgtccgtccagaccaattttcggattcggaaaaattcggtcggaaatatccggaatttctcggattcggaaacggattcggatttttttctcggatacgaaaacgaatacagtaacggtgatatctgacggaatcggaaaacggtcggaaactatccggcatttttcatcagatatccggagatatttttcagcaaaaaaaaaccagaaaccctagccggctagccggtcgcgctagctgcccgctgccgccgccgcccgcgcgagcctgccgcggctcccgcccgccgacgcccttgccggccacagcttcc

SEQ ID NO: 58195 - DNA, 6091 bp, Oryza sativa
ccccccccccccccccccccgcgcgccgcctcggccggccgccgcccggccgccctgccctgcgcccactgtggataagaggaagtgagagagagagagagtagaaagtgtgtgagagagaggagaggaagagtcaagaggataaggttggggttaaaaaaatggtggatttttttaatgtaaaaatcaatttttattttacatgtggctctttaaaacgaatttaaaggcactaacttaactcatatgaaaaaagttgttaaaaacaaagttgtataacttattgagatctatcatttttactttggtcatttctccgtccgagtttgattaaactatataaaatttgaatttaaaaatataagaaattcaaataatttttcgggtagtaaatgatttcaaatgaaaaaattgtcaacaacaaagttgtataacgcatcaacatctacaacttttgttttggtcatttttctatatgactttgtttgaaccatttaaatttgaatttcaaaatatgacaacttcaaataatattttgaaatactaaatgatttcaactgaaaaagtcatcaacaacaaagttgtataactcatcaagatctataacttttattttggtcatttcttcatccgacaaagtgatagtagtattgtttacaaaatttacatctatatcatttggttctataaactataaaggagatatgtaaactttgtgaataatactactgtcactttatcggatgaagaaatgatcaaaataaaagttgtatgtcttgatgagctctacaacttttatgttcatgactttttcagctgaaattaattacagcttcaaaatattatttgaagttttgaaattcaaatttttaattgataaaataaagtcacaagaaaaaaatggctaaaataatagcagtaagaacacaataacatgatagagcatgattttagaaatatttagaaaaaaaaatcatccaatttagagttcatatgagtgagataaattagtttcaaattttctaattttatttttgcatacggcttcttaagtcaaccgtatggaaaaattgatttttccatgcaggtccttaaatggtccacaaacaaacaaatgaaaaaattcaattctgaaaaataaccactcaaatttttaaaaactttcaattgaaatgttcaacccaaaatttaaaatattcaaccaattttcaaaaatttcaatgtgcttacgaaaatttcagtgatacacattaatttattgtttcatgataacataaatttgtatagaaagtaaacataacattctctatctccccttgcccttataaatagagacaaaatttgagaatactgatgttttgtttttgaaaactaatggctacatcccttcctcgttttaagaaggttattttgaggggtcttgatattttgataattattcgttaccgtattcgtttcgattcgtattcgctccgtatctgtattcgataatattcgattccgttttcgtatccgggtttctgattccgatttcgattccgagaaaaaatataaaaacgaatatgatagaggtagtttccgactgtattctatccgttttcatccctacttgccagcgccgcgcgcctcgttttcctgcgcttcgtcttcttcttcctcgcctccctgcagttactgctctctgctcgcctgcacgcgcctagaggctgccatgcacgccgcaactcgcaagcaagggaccgtccgtccaggcgacgcgttcagctcagctatatatgcatcacagcatcagcgttttcgcgttgccttcctgctggccaggtgattgtttgttgcttgcagctggctctgtctggtgccgtttctttttgtcctgcaccgctgctctgctcgactcccctccttttctctatctctgcctcggccatttctgccactgaattgagaagtgatgcagggaaggatggatggctaggtactccaagcagcgtgatgacgactgatgaggaattgaggaggaagacgacgacgtacgacgcctcaagctgttacatttttggatggttcgagctgcagcagcgaagcgccccggccgcgcggcgtgtgagcgtggcgcgtggtggtggtggtggtgcgagcagtgcagtgcagggcaagggcgcgcgcggttgggtccgggttttccgcgcggcaactggctgtggctgtgcctgcagcctggcaggctacaggagtggctgctcctggccggtgggctggaaaagcgccgtgttggtgtgcgggaagcttgcattgtgacagatggaccgcatgccacacgcgcacggcgcactgcactgctactccctgcatgctccatatatacatggcggttccatacctgtttggcttcctcgttcgtatcgtatgctctttcatgacccaaagaagacaatagcgtatgataaatggaatataaactactgtctacgttttaaaatgtttgacaccgttaactttttagtacatgtttaaccgttcgtcttattaaaaatatttatgaaatatgtaaaactatatgtgtatatgaaagtatatttaacaatgaattaaatgatatgaaaagaacaaaaaattgacgaatggtcaaacacgtactaaaaagtcaacggtgtcacatattttgaaacggagggagtattacaaacttaaaaaatgtttttttaatttattttaaaataagtctttataaaaagtttttgaaaaaaaaatcagcagtttaagattcatgcttaagaaaaacgagatagtaactacgaataaagttagtgtagcttaactacactctggtggtgaaacatattcgtatgagttcaaattctaaacttgacacggctgttcgtatttacgggtaattattctttcagtgatagacgacgcatctgtgtcaaaaataagacttctgtggtgactttatgatactcaagatataccggcataattttcagatgtgtttacagaggtaataggcacatctggtgacaccatgaatatgcgcgcgtttatatgagtggatatgtttattgtgtttcgaagaaaagaaaggcatgggccaaatcaaggagctgattcatcgaactgagccaaacatccactactaaaaaaaattcgttgacggttaaaatgggtttttgttggtggctgattgtatcgctagcgaccaaaggctagtgaaaataatgcatttgcgctgacagggcagttggccgctagcgaaaattgatttccgctggcgaccacgctaagacggccgctagtgaaaatcgatctttgctggtagctaagctaagatgaccactagcgaaaataagattgtgttgacggcaatgttaagatacctgccagtgaaaacttttttctaagaacaaaatattgaaaatccaagtccggaacagctaatgagaaacacaaattccaatcacatatcataatcccccgtcacaaatccctaatcccctagtcgccagttcccgtcgtcgagctgcagacgtcgccgtggctgccacgattgttgtcgtcaccacccgccgaagcccacgctcgagccgaatcgcagtcaccgggtggccctgacccgtcgcttgccgaatctaggagagaggagggggttggaggagcccggttgttgtcgtcgtggcagccgcatccagatccacctccttgaccgctgtggaggactgctcacgcccccgccacctgagcaccgtccgccgccggattagcccccacgatacctcccaccacgacgaggggaggggagtggggcagtcgccgccgtccgcgagctgcatgcacaagtaaacctttcatggatccacgcacgtcttgaaaccacaacactgtctatacacgtaaacctttggtgcgtaagcatggtgtgataggatgtcaaaatcgcttcctcttattttcatcgattaatttgagtaccagtataccaccaatcgagccatcagctccaagggcgacgacgtctttacaccatgttgctaacaatctagtatactatatgattccccgtattttgctgcggaaattacaaagcaagttttaaatatattttttcaacaatcaatctaggagtaaaaagaaaaaataaaacgtcagggtttataagtacttattgttaaacaaacaaatgatatctacactttaatgttgaacatgttgataagtaaatattaaatactataaaaaataatatgtatatttgttaagggcccctttgaatcacaagaatgaaaaaacggaggaataggaaaaacataggattctgacaggaatgtaagtgtaaaacagaggattgcaaaacacaggaaaaacataggaatgaccgtttgattggaccacaggaaaaacacaggaatttgaggagagataaagactcaaaggatttcttccatgaggttctacctcttgttaaaattcctccaaaacttgtatgggaagaggcattccataggaatttcatatgattccatagggttcattcctttgattcaaagggctttgtaggaaaaattcctataggaatgaaatcctctaaaattcttatgaattttctttgaatcaaagggggcctaaaatattatggaatgatatgataggtgatgattggatatgcttgcatgttgatttgtagaattaaatagattgtagatgatgttgcgtgcttgcatgaggttaaatatgtattattgctagcaggtgatcttatcaaaaagaaaaacaaatgatacctgcactttaatgtggaacatgttgataagtatatgttaaatctctactattactttgttggtattttggtacgtcatccgtatttgagtcagtttttaaattcgttcgtttttaaaaatacagatctgtgtatgagtaggattttaaattcgtgtagttttcgaaatacaaaataagtcgtataagaaatttctttaaaaaaaacttgcatgctaacttgagatgaaagtcagactcctaattgtagctcataattttctaaaaaaaaatatccaagcgaatttccatagtgaattttatcggtttttaagttcgttcgcttttgaaaatacaaatctatgtatgagtcagattttaaattcgtttagttttcgaaatataaaagaagtcgtataagaaatttctttaaaaaaaacttgcatgctaacttgagataaaagtaggactcctaattgcagctcatgattttctaaaaaaaaatatccaagcgaattaccattgtaaatttcatcctagttaaactgtatatagtggaaatgatgtgataggtgatgattggatatgcttgcatgttgatttgtataattaaatatattgtagataatgttgcatgcttgtatgaggttaaatatgtattattgctagtgggtgatgatggcatggttgcatgttaagctttggagttagtgggttgcaactttatagaaagtatagattgctaagttctagtagtattataacgtacttccaatcttccatatctatagcctataggctagctagtgatccgcaacgacaacgaggagttgtcgaagcgaaagtcgaaggagaagttgtctattggtatcaaggaggagttgttatcaaggaggagttgttcattgataagcagtgattcattttgagcaacaaccccagccaccccctcgtctttagtttcggtgaagacgagtatgtcggctgtgaggtgcaaggggacggtttatcggagctctaagttgacatggacaaagctatcgaggaggtgatggcagaggccatgaattccatgaacgtgaaggcgaccgagcaagcggtcgccgaggccggcgcggaggcagaggcgaacactgtagtaggcttggatgccgaggtcttggagacggtggcggaggcaaaggccttggagacaatggcggaggcagaggccttggatacaacagtagagggcgacatggtgaccatcgtctctcgcccgtctggctacccaaaggctacaacttcggaggaagcatcactagagaagcatggtgcgtaggttagggcaaatagg

SEQ ID NO: 58196 - DNA, 3096 bp, Oryza sativa
aacttttcactgtcttagtccatacacatgtgataacataattgacagaagaaaacatgtgtgggggttctaactgaaccaaaaaaaaagaaagcaatcaagctatctcaattcttgccaaataacaatggtgtatacatcaatcagtacaatatagatgtggggtacaaaaatcaaaaaggtctgagggaagatcacttaaaaacacttgttattaaaatcaacagcagctagactagacaatggatgttaaactaaagaatatagtcatttagataatataaacaagggtgatcttatcttgtggctttaagacctattgctaatggaattaaagttttgttagggattaaaacaaaagttaaaatatttctttctttggggtgaagaaatattatgcaattcatatgatgatatggataagggtccaacctggcgcttctggaattcctgtgcaatttcaccagccaagtttctagcaagtgagacattgacattgttagaaaatccaatctagattcgaaagacaaacatatgtattccaagtttccaacagcaacaaccttattctcaataacaaacaaaggaaacagaaaaactgaaaactccaaagttatttccagatacaacctaaatccgcagcattactaaccaatcatttcttttgattaatgattaaatcaactaatcaaataagcatgcacttgaaaacctgaaaagaataacttcttatctataatttcctgagttacgattcaatattatttaatacactgataacagttaaatatttgaccgtaccataaattctaaataagcctaaggattcaacttcaaacataacagggaaaaacatcaagttgtcaaacaggatatgaaggtactgtttggtagttcatcataaactatctcaggaataaatgtttaccattaagattcacaagaagtaactgtctcgtgaataaaagtgagtgctaaaaaatttaggaggcctggcaattgatgttacctcacatattcatgaccccatgaaccaatgtcaccttcagagcctatcattcggtacttgaggctctcctgaaacaaaaaaagaaagcatattagccaattcttgaaggattgatattgtacagttaacagtgagaaaaagttaaactctatatgtctatcatttaaaacacacacaaaaaatgtatgactatttacagaagtaaatcattctcagaagttagcatacaagcaaattaaaaaaaaacactaggaaattgacacaaggaaaagacatcagaatggcattttcacatactctttctccttcagcggacattgtcagggccaatactgacaagatatcagccatatacttctgcaaaataattgaagaataccatataagcatcaagtagtatttgaaccatgactcaacctagagatcgaagattggttgataccttcagctcagattctggcattgtctcaaagtaagccttgagaattccatagtgcgggcgaaggaatttgagaggctttgggacagaggtcattgaacttgtcgcagaacggatctcctgcctgttaagcataaatcaccattaacaagagatcaataagacaaatgtgaaaactgtgtatgcactaactggttgaataatgcaaagtgatgccaccaatagcagcagtagccactaggatgcgagattccagctgagcagataaaacaatctcaccatgatgcagtagagattggagaaattgaacagttaaagcatgacctcatggtaattgtgattacgtagtattgtacccaagatttaagggcaaaaggataaacaagcctccaacaatgtgccgccaaaccaatagcttgggccgaatttatgcgcattttaaattctcacgacagtaagtttgcagaacaactaactcttgcacaggacaagttagcagtgcatccaaaatacctatgagttaattagtcttatagtctactagatgacatgatcatcctcaattggctagctcctctgtcatccaaaccataagtagtgtgataaatgcatccacccaaaccagatcacactaaaacataagtcatcacgaactatcagaattatacagttacacaccatcagaaaatcctcctcgttacctatgctctcgagggcgagcttctggacgccgggatcggggtcctgcgcccgcaccacgtagagctcgagctgctccttgagcgcctggtcctcctccgactgcaaccacgcaaagaaatccgtgagagagagagagagttgggggggaaggagacggcgaatcggggggtggctagctcaccaggtcgtcgtccttgttctcatccttcttcttccccttggccttggccggctgcggcggggcgggctccgaggggaaggcgcccccgttggggtccttgcgcggcggcatggcgagggcgatctccccggcccgcggcggcggcggggcgcggcgaggtagggtttaggaatcgagctccgcggaggcgagggagcgagaggagcgcggcgcggcccgttgggatcctttcttgtgtgcttgccatgacattcgcctcttcttttcatatctttatcacacgattgctgcaccccaccaacgagagggcaaaactccgaaaatgctccagttggaacgtccaattagataaaaaaacgtcggacgcttgtgaccagctcactccttactttgctattcgctactttcttagagcatcttcaacggcctctctactagcctctccaagccaaattttagccattcaaccacaaaaacgaggtccaacagactggtcaaccggatggccaagcctggccaaaatcgctggctggctggctagatttggccagccaaaacgcctcgccaaaccggcccgcagcaactgtactcctcgcgaggtcgtcggggcgccgtcgtcgtcgtcggggtcgtcgtcgcgagccgccgccgccatcgccatccccgccccgagctccgccgccgcgcccctcaaaccattgtcgccgtcgccgcctcccgcctcccagcgccggtgccatcgtatcctcgccccgagctccgccg

SEQ ID NO: 58197 - DNA, 1400 bp, Oryza sativa
agggggaaggaaggggagaaagaagaagggaggggctgacatatgggtcctgatgtcatagagtcaaagtagaaagggtagatagagaggctgttggagtgaacaactagtttgactagccaaatcaaatggagagttggctatatgagtgtttggagagttagatttggagaggctgttggagatgctcttagaaaatactacaaatcggtagcctgtggattggacgaacccctgtcactgtaacagtgacatacatgcctagccgttttttttttcattctttcctcatctctttaaatattttttctcctaaattatttatccgatctatgaaccgatcacaccgttgtattcgttgcaattaaatctttacaataagatatcacatgattatattatgtcaaaagaaaaacatgtgtttcaaaccgttataacaaaatgtttcatacgtgatgaagcatctaggcccccggtgttaattttggtaattcatgacaagcactaattgtggactaactgttgtctttgagctatatattttaagttaggttcacatcatgtgtgcgcatggatgattatcgatgaattaaaattgacggcacaaagcaaaaggaagagaagacgataaactagtgttttcatttttaattgatcgatgcgttgggcgatcaaaattatggtagtttatttatagctttgccgtactattaagaggggaatgacctagcaaagagatgattttaattgccacattaggtcattatgcattaagacgtgtgctcgcatttagactccccatatttcaatttacgtattcactgtgtggcctgaccagagccggtctgaccatggcctaatggctagtctgaccggcctatgcagccggcctgaccgcagggtcactaccggtctgaccgctgccacatagccggtctaaccggcaggtgttgcccggtctgaccggccggtcatatggccgggatggcatgctctgggatggccaatcccgagccgccggagccgtattcggtcagaccgagctggtggcggtctaaccgagccgaggccggtctgaccggccaccccatgtcggtctgaccagtcgaggcagtggggcccaatgacaaccctacaacggctagttttagagcacggtctgaccggccacatacctcccgtcagactggcagagcactgagttgggggatttcgcccccaacggctagttttggttggtgggagtataaatactccccctccagcagcaaggggactctcttggcacccaattcaattgtatacactccttgcacctctctcacacacctttgagcttagtgttcatccattgtagtgattgaggttgttctagccaagagtcaagtgcattgtttcca

SEQ ID NO: 58198 - DNA, 846 bp, Oryza sativa
ctctacctcatccatgcatacatatatgtattttagcaagtttcaaaatgatttttctcttaaattacttatccaatctatgatctgatcacattgttgtattcgttataattaaaagataaacgcatgtttcaatccgttaatatttattgtttcatatgtgacaacgacatgtttcaacgtgtatcttcaccatatttcataaaatatataaatgtttcagttgctgattttttttgtttcaccatatataacttaacgtttcacttgttggtcaactgcaacatttgaccgtcagatatttttcgaggcatcggacatccgatggatagattcctccggcaaaactcttctcatctatcccttcaggtcctatttggtagagctccaactcctaaatttagctttaggaattgggtttggagtaaagttgtgaagctgcctaaacccagctccacatctctagttcattttgtgaaaaagctccactcaactctgcttccattttaggtggagctgaaactgtttggctgagctctaactctaggagaggtggagctggagctggagctggagctgtaccaaacagaccctcaatatatgcatatgagattcactcatatttcccatatgcatacattaagggagagtttttctcacttcttctcattcaaaattaaatttatactcattaagaggaagcgattttgacatcctatcacaccaagcctacgcaccaaaggtttacgcgtacagacattgttgtggtttgcgagacgtgcgtagagtcgtgaaaggtttgcgcgtgcgtgtgactcgcgcacgtaaacacatcgagcctatgaa

SEQ ID NO: 58199 - DNA, 936 bp, Oryza sativa
gtcctccttggtcaaagcgtaaaggtccaggatgagaaaacagcagatcctctgaagtcattgacatgtgagtcccactttactatggtccacatatcagtgacttaactgcacagcagttaaatcagaggatcccttagaaaacaggaaaaaggagaggagaggatcagtttgcatgtagacaaccgtacttactttatattaaatcgctttcacttttttactacgtcaaagtttattaaccaaacctatagaaaaagttaacaacatttaaaatattaaattgattttattaaatctagtattgagtatattttgataacatgtttattttatgtttaaagtactactatatttttgaataaatttaataaagctgaaacaaatttagcgacatgtaatacaggtatacagagcacggagcagtaggagctggtggcatccatcagcgacggaggcagtgcagcaaacacgccgacaaccgtgcaggggggcatcaccacgtgccaagatccaaaatgtagcgagacgatcaaccgaaccatcgtgaataagcgaaactttatatttacaaataaaaagtaatttatgaataaaacttttatataattgtttttagctatctaaaaacaaaagctaaaaaataaagtttgataaaaaaaactttaaaatcagcttcaaatttaaaagtttaaattttaaattttagctgataagtccacgaaactctcttcggcgggacctccgtcaccactcaccagcaaaagcaggggacgcgccgtagcatatcaatctgcacttccgcatgcaggctgttataggatgtatgcgttcttgagcaaatggtaagttgtgaatacagaaatcgttaaaggagaggccccatcggttgcccactttttattataagccataacggcttattagcgattaaaa

SEQ ID NO: 58200 - DNA, 2888 bp, Oryza sativa
  unsure (1)..(2888): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctactaatatgcataaaaaaacatgaattctttgtttccaggattgcttttatgatttccttaagagcatccaactttgtgataaatagttgaagcttgcttgctcactaattgccttatctgggaggaaggttcaaggccactgatgccaataggcttcgtgctgaatacaacaggctggttgatggattggcacagaggggaaacctgccaagtgagtaccattttttctttcactaattctgtgtcttagactgctcattgtggttggtctttctgggtcagttaatagtttacgataaaatatttcttgttatgtagtatcggatgcttggctcgcgaacccggccttgcctgaggacattctgaaggaggctgtaccaggaaacatcaggagggctgagcattttcttgctgttttgcggaggcttgtcaggttcctagatggacgcctggaaacagagaatgttgagaatgaaatgcctgttgcctttgttgcttcaatccattcccaggctggaattgaccagaaaatgttaaggttttgttatgatcggctacactctctaatgcttaccttggagataaccgatacagatgagttcatgcacatccagacaatttgtgactttgccacattgattggaacttatacacggggcttttctataataatagaaccctatgatgagagaatgcctgatatccgtgatcctgtgattcaggtactcattcttctctatatgacaataatctctaatcttaactgtcatcaaaagtcgtcaaagtgcattattgatatcctaatcaatttctatgtgttgcagctcagttgccatgatgcatcgcttgcaatacagcctgtttttgagcgttttcaaacagtagtcataacttctggtactctcagcccaatagacctctaccctcgccttttgaactttaatcctgttataagcaggagcttcacaatgtctttaacaagggattgcatatgtcccatggtcttgacaagaggaaggtatggaccgggccttcaaaatttcatgtggcatatattattttgaaagcaagcaactaatttatccattgcatgttttaaatactagcatagcatctattgaatctttcttcatcctttagagcatcatcgcatgaacttagtttagtttttgtattgggttttggctctcaaaattctagtcttactggtgatattgcaaaatcttgatgtataacttcaaatattccatcacattttcagtgaccagctacctgtcagtacaaagtttgatatgcgtagcgatcctggcgttgtaaggaattatggtcggctcttgctggagatggcttctgctgtgccagatggcatagtttgtttttttgtcagttactcttatatggatggcattgtcaacagctggaatgagatgggtattttgcaggttagtttctttaccagtacattattctggtatcgagcagtctatagaatataaatctagtgcaaaactcttcatggattatgacattgaatctcgttatgtcaccatataaagtctaacaattgcacaaatgcattgtttcagttggaaaaacttgtagtactgctctggaacagtcacttgtagtactatatatggtgtctaagcctctaatgttcttattacatgtgcagtttattgtactgctaaaaagtgcattgtctgagctgatttcacatgattaatgcttttactgttctcatgaatacagcattcttggcaaagccttgataacacgcaatgcattagcacctaatatgaaaatcttatgacttcaatttgcaggacatcatgcagcataagttggtattcattgaaacaccagatgttgttgagacaacattggctcttgataattacagaaaggcatgtgattgtggaagaggtgctatattcttttccgttgccaggttggttcactttatattggttttgtcggaaagcacccttcaaatttagtgtcagtgttcagcttcgcaattgattggattgcttgagactattacagctattttaacatcgacccaagtaggtgataattatgtcaaaggtgatatataattactggttggccaatggtttctttattcctagtatatccgaaacaacgaagacagtattagtcaaaaataggtgtaattatgtgttaaccaaaataaatgaatgtcctagttggtacagcaattcagtaagtaatttcagaaaatgcttcaatcaggcatccaccaatatttcattgatgtgtaaacatgaggaactcatacgttgagtttttaagtttatttcttgcaaaaaaaattatcttgtccctgaatgctcaaataaattgctgccattagctcatcatctggctgatcaataggctacaataagcataacccagtaggcaccacgagctaatttaccatcattacagtatattgtagattggctacttctgttcaagtgttattattataaatgtttaagtggtcttgactcatggctacataatatgatggacatatgactcatagctaactaccactatgctcaatccaggggcaaagtagccgaaggtattgattttgatcgacactatggcagacttgtgatcatgtttggtgttcctttccagtacacactcagcaggtgaggacttattgtctgaacttaagatccatttttttgtgcaacccttgatctctatacctga

SEQ ID NO: 58201 - DNA, 6971 bp, Oryza sativa
tggatatcacatcctactttatgacaaacgacagttacttaaatatatcttgcaaatttgttttgggtattttggtcctgaggtcttctatgtttccatttgattctgtcaaaaaaaaaaaaagcaattctaatttgtcacacgcatcctgtccatttccctgccttactggtgaccaagctttcatactccaggattgttaatatcatggtatttctcacctgcagatacagtcgccatgataaacggtctaaactgcctgggtggatactgtcacacttacatgatgcgcacctaaatctgagcactgatatggctttgcatatagctcgtgaggtatgttccataacatttatttttctttgactggtgctatgtagtttgaattgcttcaagtactgtaacttgtaatcatttaaagagcaagtttatctctaaccgataatgaagctatgcttgcccgtgttattattttccaacacaagcacaatttgcatgataaacattcttgcataacaacctgtgcaagaaattgttcagacttgtcgcattctgtgctgaatatattctaacatctggtattaccatcttgtataacagttcctacggaggatggcgcagccttacgataagacggggagcggcggcaacaagactctcttaaccgaagaggatttgcagaatatggcgcaggacgccatggagatgtgaaaccatgaaagaaattgaaagagagggagggggagagagagttttctgctgtacaatacattcaaaattgaggtagaagtcactaatgtacaaaaaaattttggctactcatgtgaaccagcatgaattcgagctgcacggttcatgctaaattgctaacaaattggtccttccaagcacatgtgatattactctgcatctgatataggtatgtacaccttaaagtccttccggatacttatatctgaatatgatggcggcctctgaatttcagacgtgtcgttacattgcctacagccaaccgttctgttctttacaactttattcaccgtattattaccacggattatttgcttcacgtttttagacatacgatatctcaatattccttctgctgcttatatgatgtctacatgtactcttttgaactcttatgtaagattatatgatgtctacatcgtgaagtttatttccgtatgaattttactttactttctctgaacgttttggttactcgtatccattcagtttctctcggtttctctcctgctgctgtcccaatcagatcccaacacaagcatttgattgagaatccgattcaatttcgatcttgactcggtacggctctcgtccaattcccgtagattagattttgatgactctgtgattcctgagtcagggtttacaattccaaaatgtcctaccattccaggcactggcggtatgttgaattcacgaaatccggtggaaaactgacagattctgaacaaattttatgaaccaaaatttgaattcaaaatttctgagctaaccgatatgttcacgaaaatgaatcggctttggtgaaattccgacataaaccatcgaaattttactcgacaactagaagacaaggtattctaaaaaccattcggtttctagtgaaaactgatcggttttgtcaagaaacctacgagaaaaatcaaatttgtttttatcagtaaaatatagaaaaatgtcagataattgaaaaaaacgtaaaaatgtcaattcctataaatttgatagcctcccattggcatacatatgtaatacatattcataaaagtctataatttaaaacacacgtgacatcactcatcaaccattagccaaatagaatgcccatcacctaaatattaaagtcgattgcacacatagtttagagttcaatacatactcctcgcctccgccgtagccttcatggcccgcctgagctcaaactccttatgtatgtagattacttatggttccgttcgaattagattaagataaagatttttcggcgcacgtaaaacaaaacaaaccattaacatatatattgtacatcctgaaaattcccaataataaaaatcactaaaattttaaactttttaaaaacttttgcatcatgctagttgttatgattgctattgcttgccaaaccgtaagtgatcacaaagaaagtaaagaaaagatcgacatttaagcaatagatatataatttacgagaatatattattgttaaccctaccaatatttatgcacaaaatagtaaagtcaaatattaatttctatataaattacaaatcagatattaaatattcgaaccatgattgatagcttgatgtcacaattagctaaagaaatagtaagattgaatctaatccaatctcacatgaaatataagaacacatgaaatgaaatgatgatcaccactataatgatcgtgtttataaataagtaattcactagaatatatatagattgatacttagaacatttccccgagttcctcatgacatgaaaatcactcatataaaataatggtcatataaataaattaagctttatatataaataagaatatgtgagtgtttaactaaacaattagattaatgttgtactgagtctcaatctactatttataagataaatagattcaacctatccgtgtaaaatatattgctatgcaaataagatcaaccaatgtgctattgtgtcaatatggatcatattaaaatattttagttaattctataactatcaaagcctagaagttatataggataattctaggataaattaattgaaagcaaattcatttaggatgaaacaaacaaatgaataaataaaaattcaaataaaatatttgagttcccaaaaacaaaatgtatagattgcatctcaaataaaattctaatcccagccatttttcagtttggcccctccatctttcccttttttttccctttttttcccttttcttcttttttgtgattctcccagtcggctactgttcatgggccgccaggtgctcgaccagagcccaagccgaacacccagcgacccgcgtcccatcgccgccctccccctgccgggccgtgcctagctctgcgcacgccgcatcgcgtcgcgccccgtgtcgctgccgcgccacgcgccgtcacgccgcctcgcgccccgcgccgccatcgccgtcacgtctcgtcgccgctgccgcgctgcgcgccgtcgccgtcacatcccgtccccgctgccgcgccgcgcgccgtcgccgtcgcgtcgccatcgccgcgcgccgcgagccgtcgccgtcgcgctgccgcaccttcgagccccgagccccatgctgccacgtgccgtcccatcgccatcgcgtcgccgcccacatcgccgtcgccgtcgtcggtcgcatcgtctcgaacccctcccctccgcgcgcgctgtcgtcgtcgcccccgcgtcgcgccccgtgccgcgacgcctcgcgccctgcgccccgtgccgcgccgcgcgcgtcgctgtcacccgtcgccgtcaccctcgccgcgccacgccgcgccgttgccatcacccgtcgctgccgccgcgcgccgctcgcctgtcgccgtcccgcccgtcctgtcgcgccgagccccgtgccgagccccgcgctgcgccgcccgcccgtcgcgtcgccactccgagccccgcgtcgccgcgcgtcacagtcgccacgcgccccgcgcaccgcgccatcccatcgccattagggccggccacccctccccgcgccctataaatccccccccagtcgccattccaccccacaccaccccacatcctctttccccattttccccttctcctccaccgcgccgctgctttcgtgccgccgcgcagccgccttcgcgccgtcgcgccgccgcctcggtgccgccgcgccgcgccgtgcgacgttccgccttacaccgtcgtcgccgccgccaccgtcggtaagccgccgccctccccctcgttcggtcgccgttgccgccccgagtaggcagagagccgagagagagagaaaaagaaaaagaaagaagaagagaggagcgaaaagaaagagagaaaaagaaagaaaagaaaataggaagaccccacctgtcagtcactatagcttgtatagcttgtagataaggttgtattataaataaatgaattaggaacagtaccatttcgcaattattagaattaattcaaatttgaatctttacactagcataacttattcattttagctccgatttgagtgaaacttgaacctaaatttatctaaattcataagctttccaatggtatataattcactatttgataaaatacatttataattattaaataattaatactaagataatgcataatagtcaacttaaaaatgtgctaataaatagatttgatattgtgcagtagagtagatgtaataatattggtccttaacatgttttgtcactgtagaaaccacataaattaatcataatcaatgtttcagattaatggatgtataggaaaataatagtgccatttattaatctatgtccaaatataattaaacccatgactgataggttatttaaataaagtttagcctcatatttgtaactaaaaatataaacacgtatagatcattccttagcttatttgtgaggaacaataacagacctattataaatagactactaaaaggaagttgatcagtagcatagggaatagcatatagttaacttggttagcatccaatagttactccaacagtaaaatcacttgtcaacccacttagatcacatatactatacaatccatttaaattcatacataaggacaatcttttgtatataggaaactaaggagtctatgacaaacatgaatattagataaatactagttataaatcttgacctcatataattatagttcagctgtaaattaggattgttcattaagggataatctgtaaccataatgtgattaacctaaacaactctaacattcaaagcatggataattattaaccttttataatttattgtgacaagtaaaatttgttcataattaaagtaaagcctccatcaattaaataataatacaaatgattcattatttgattgatcctaaatccatctaacaacagaacctctgttatgtaacagtgctatttagatagatgcatatatagccataatccttccatagccatttgatagactaaaccaccgattagccaaatatatgtgtataccataaatgctatgttggttaactcctaaatagaccacgatgacaatagaaagattaagaaactttagcccttagcatgattggaattcattagcaaacatgaatagtacattttgttgtgcatatttgattgttgtttgaatattggtttttctcgcgtattatagaccttgtgtatcggttagtcgtgaggcaacgtttgcaacttccaggaggtaacggttgatcaagattatatcaagaataaggcctattctgagcaggcaagtcatcactattctttgaacatgttgatcccaattgcgaaattattttgtttacaaataaaattgcatgcaatgatgaacatcctacttgtgattatgccatgccttgattattgtttaccccttattccttcataaccatgtttacgtatgagtccctagtcaattatgacaattgcttagaaatgctattctagaattatgcatactcatatttatcaaatgctatatacttgggcaattacctttgggaaggtaattgagatgcggcatgtcgagacatgagcgccacattgccatgatattgatgacatgatttgtgaaatgagaaataaaactaaacaactgttttcgactggggcggacggaggatttgggtggtatctggaaaaggctagtaccgtccccggtcaattaaggaccgagccatgaagttaagcatgaaacgacccccgtacaaccgcacttctcgtatgggtatagacctagcggattagatagccgagcggaggcagtatccctgcatagatggttcacccctgagtgaggcaggtgcgctaccgtgggacagccgttgaggtagggccgagaggcgtgccctacatcggtgtcgccattggtaggactgccatgagtgtgtgagagagaaactaacttaatgagtgtgtgagacttcctttcccgggagcgccagaactcctctcactgctagaaactgtgtacgcctagagtgcatgaggatgaaaagttcatggagcgggtactgccaatgcgaggttatcgaaaagctttgccgtggcgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaactggtgtgggatgggatattgcatgatgaattttatgctgatggagacacttcctgagaggagggaaggtggacgtcctcagaaaaccatgacgactcaatggcgggaagctatccttgggattacaatggatggtggacagaaccgccgttgtttaatgtgaacactggtattaaaacttgatcagtctatggtaggtcttaggcttgtgaaaagaattgcaaaactagctttatgcaaaagaacctgaagccattccttgaaataccctctatcatatgcattgttgttgtggtggcttgctgagtacggttggtactcacccttactatttatatatcttttaggagagtgttgaagagaagcccttatcggtacgcttgcgtatccaacaagatgatcggagtgcggtcttgttctaggtctcgtttccccagtcgactgcctgtggcatgttaaccgggcccttatattattttgtcttccgctg

SEQ ID NO: 58202 - DNA, 4088 bp, Oryza sativa
gtactgatgagtatgtagaatacatgtcaagagttccatattctagtgttgttggttatttgatgtatgtcatggtttgctcccatccggatttatctcatgctatgagtttagttagtagatacatggctaatcctgttaaagaacactggaaagctgttcagtggattttcaggtacctcagaggcacagctgatgcttgcttgaagtttggcaagactgataagggacttattggctatgtggattcagattttgctgctgatttggataagagaaggacactcacaggttatgtatttactattggtagttgtgctgtgagttggaagacaacattgtagcctgttgttgcccagtctaccactgaagcagaatacatggctattgctgaaacatgtaaagaaccagtttggctaaaaggattgtttgctgagctttgtggagatgattcttgcattaacttgttttgtgacagtcaaagtgccatatacctcactaaagatcatgagaggacaaagcacattgatatcaagtaccattatgttcgcgatgtagtcgcgcaaggtaagctaaaggtatacaagataagcactcatgataatcctgctgatatgatgataaagcatgttcctgttgctaagtttgagttttgctcaagcttagttggtatagtggtttagcccaagaggccatttggcgctgaaagtgttttttgcttttgttgtgaaggattgattcatgctataagaaggaatttgtcttaaggtggagtttgttgagttgtgatccaaattcatttgcacttaataaagaccagcttctgccggagcgaagtggaagccttgccgaaggccccgtggtacggatcgtaataccttttagggtttcacctcatatatataactcttgtaagccgccgtgtggcgttgtaacctcaccccgatatagtgaagatattttgctggctggcgcccgtgttttttctctcctgctttgggagggttttccatattaaatctcgtgtcttttgtgattgatctattgttatttatcgtttgtttgcctatctttttctaacatgatttggatttttttttcttttgatattttccttctgccacttgagttaaatttgattttagagattggagtttttttttcatacccttctgccacttgatttggattattttttcatttgatattttccttctgccacttgagttaaatttgattttagagtttggagtttttttttaatgccacgtgagttgaatgagttttttttccctcctgcgcttgagttaaatttgagttcttttcatttcattttgagtgtttttttttgtctgttttgagttcttttttcatgccacttgagttgtatttgagttttttttccatcttgagagagttagtttcagtttttcatttcattttgagttttttttcgtttcaaaagaaaataaaaatcgtccaagaaaacatcccttacaattcgagttgcgagaagtaaaaaatcgtcgttaagccaattcatatcctggcaacactcgcacacggtacagcacacgtcgatcggatcactgtttctaagaaagaaaagagcagatgtatcaattgaaacgcccgagcagtcaggagtaacgtgcaaaaaggtcgtacacatctccacccttctaccaaaaggtccaaaaccccagaaccaacctgattacccatttggatccacagtatcaatacgatcaaacactcgctcctttttttttctctgtttatcagacaagtttaatcgatcatctcttgatctaagcacaacataatttattgttcacacacctataaatttaattaatcacaacacggttcgcttacaaacattcatcacgctctacaacgagcgacgggataaagcctcaaagctccccgtccaatctaacttcgacaaccttgtatagctgcgctgtgcaaagcagcgtcccacactggggacatggtgtacagtcattacaaccttcttactcctgagtaaacaatgaactaatcatgtacactaaagttacaggtaaaccacccaaagtacatacaactcgattatttgctcatcattccattctgtcctttaaaattggtgtagatgagagggaccgggaagcacatagcttcgcttacgatttgaagctctgaacggttgtgtagcttccaaccgaggagatgaagtcatatcaactacactgaacactgaagcgtcacaatgaactaatcaccagatgaacaccttcgacaaacagggggcctgtgatgtgatgctcggctgcaggttgtttggatgtataatgtatgtaccttgtgactggtaaagagatttccgtcaagaaacatggatcaagaagctggaggtggttcaacgatgtatcatatataagcaagagaatttctgtcactagcagactgtggccgtcctctagttggtgtaggtggccgttgtatgttaagttcctgcatatgatcagaaattgtgcaaacaaatcattaaatgagccatacattcagagcctaatgttgagtttttttagatgaatcagaacctaatgctgttgataaaaagttgttgctcacaatcaagttgtgccttgccttatctcactagagaaatgagaagaaagaaatactcattctaacctgcatccatgtggcgtccatggcacgttctggggaagactctggagaattaactggtggaggaagtggatgaattaactttggaacaataactagtcccctgcccaccacaagtatggccccagcgttgtttgcagtacctggtgcacgcatggtcttagcaaaaaacttggttgcatacttgcataggtaacaaaggaagttagaggagacataccacaatagttagtggctgaaaataaagttatcaattgcccatgagcaaaacgctcaaacccatccataacacactcatgagctcttatgattagttgcaatctgtttcgtttacagaattcagtcactcgatcaggctgcaaagtagacaggaaaaagtttaacaagcagattacagtatgatttatttcataaaaaaagaagcatgtgtagtttaatttgatgttgctagcactcaaacttaaaaggaaaacaacgagcatagtaggagagctcaattatcatatcataccccaaatgtcaccaagccaggccctcgtgcatttggtctcaaaccctccacactatcattttctgtaggatcggacctgtatttatacaaggaaagtactcatgaattgtcatatacagatgaatgtagaagacaacaaaataagaataggtaccataaaaggtccatgagaataatagatccaacatccattgtgataggccgttcaagtttctcgatttgctcgatagtgtttattgaccttccaatgccaccatgcatgcaaattattttcttttctatcatggcagcaagtgggagataattaaacagttgattgaatcttgtccaagcccatatgccatcactttcaccctgcataagagttaagacaattaccacatcaaaaaacttctatagttcaaatatgtattaagtattataataactaccattctctctatgcattcaaggcggaacccaaaaagtgcattgatgtcagcagcctcgtgatttcccctaatcaagtggacgttttcagggtactctatctgcaggatatgttttcaatggctcagaaataacttcatgacaatagtgttgtggcaatcaatgtatttcaattaccagaaataaagactcactttaagagcaagaagcaatgttattgtttccaagctgtgctgacctcggtcaacatagtctcccaagaagagataatcaatatacctaagaaaaatagaaacaggtgtttagacaaagaaaagcacgtgttcaaagtatttggaaggatataacaacagaaaaaaatggatatatttggaaacatctagtacactctagtagctttgaaaacaaaatatgattaaaaagttcagcagcaactaacgttatatcaccagcagctgatggataa

SEQ ID NO: 58203 - DNA, 5028 bp, Oryza sativa
  unsure (1)..(5028): unsure at all n locations
ttcattagaacgcaggaactcttgtagcgttaaacaagatgagtatggaacctgaaaccagaagctatctcgtgcctgttatttgtagtgggagaatctgaattaaaattgtggtttctattttgattttctgcccttgggactctgtcgtacatagatgaagtaaattctgattggataggtgcattatcagcaacaagaaaatcgtcgaggagaatatctgtttgaaaagaacatatattagattttcaacagcatgaatttggagatatatcaatcatcacaccaaaaagtaaaacttggaataatccacagttgacactgaaatataacaatgcagagtaacggaaatgaaaagcatgccattttcccatctactcatcagttgcttacaaaaactttgtggccttgatataaataggaaattctatcattatctaatatctgtaccttgctaaaacgctgaatagttaaatggaatatttcaattctgttagaaaattgccagactacaaatttgattgtctaaacatgtgtggattgtctacactaaacacatcgaggtgacaactgccaaccccactacattgagaaacaaatattaagtatagtaatgccatctagtgacagcaaaaggaaaaatacagttcagacaacaatggtcacagtattgtttgaaaaggtttctccaattctcagatggacaaatacaaaatgaggcagccaatcacgaaatgggcatccaaaaccagttacctcccctcagaccaccataaatgtatatctgcgttccaacagaagcagctgcatgacgacaacggcgaagtagatccgaagaagcatcatggtcatgtgaagacttcaatgtgcgagaggtcacaatgccatttctatccaaccaaactccagcagcagtgtccagaacttcagaaagtgtggtatggttgagtccaagagagtagaaataagcatatgaaagctgtgggaacaaaaggaggtaaactcacctgctattgcaccctctccctcaatggctctccctcctctaaggactccaccagtaacatgcaaccgagcaccaacaaagacctaaaacatatgaccacgagccatcaatataagaaaagcagaatattgtatgtgcttgagtgcagaaattagatcaataaatatgaggcaagattttaaagaaagaaagtcattgctgaaaccaaccaaccaggagaacccgttaacaccatctgagcaccaattcatcatcaacaaataaagaaattcagctctcatgtatggttaacttacagctgcatgctgatatcttggagatggagatacccctggagctagtgtccactcccactggccacttgtatgcattagtagtccataagcatcagaaagtggctgcacatacattgcacgtatcataaattaatctcaacataaaattatttaatgacacaaacctaatgttcaaccagcatcttataataataaaactacttcctccgtcccaaaatataaacatttttagctatgaatctggacaactgtgtgtctagattcatagccaaaagttgctatattttggaacggaagtagtagataacttgattggcatgataaagcaatcctaattttagtacaagtcccactgcctataaaatatgcataacagtacaacacattaaaaatgctaaaacaccatgcttaagaaacttgctatatacttgatgcagaacccctcgaagataagagagagagagagagagagagtatgttttttttcatcctagtgatattatccataacaaacagtgattcaattccattaactatatttaaagatttcatctctttagttatgctcgtttgctatctttaaatgcttgccttccaaagttccaacttccaaagatagataattaggaagagagcattgataattagcatattaaatgtgtaggagctatcctaagaatatattaatccattactacctccgtcccaaaatgttgctaactaggatgggatttgacccatcctagacaacgaatctgaataaaacctctgtccagattcgttgtctggtttagggtttaggtagcaacattttgggacagaggaagtactaaataatgaatggatgttctcagccaccagaactcatgcattacataaagccatcgatgatcttcattcaccatatatgcatatgaggttcttgcactagcagaccatagttaaacaatgacacataacatcatataaaaacataatatgacattatgctaaggagaatattttagagctaacaaacagntaacaaaagcatagactaccatcccagaagcatcccttccaccgcaaagtaaaagcatgccatcggtgcgtgcactggcagtagcatacctacagtgatttagaatgaaacaaagtaagacattgcacgtttatacaaacagtgtaaattaatgcaatggctacacctaagaaacttgtgaagtgctagtttcattttacataaaagcatgctgaattaagtgctacatgctgtaatttacaatgccatttatgctgtgagtttcatccagatacatcatactatttatttgtacgctgtcagaacaattaccatagtgttatgtgcagaactcaacattgttactacggttataaaacagtacttttatgctctatctttatccctctcactaaatttcacaagtaattaagcgttattattagtggaatagtggcaggccaaaaatcggacccttgattagctttaaaaatattgattttcattttttatagcatagaagaattacgtgaaactgaaaagcaaacccagacaagcctgtaaaaagacaaaataccagattgtatgcataatacaggctcgtctatacagttatttttccttcttttctttaatgtaagagtgcttgcaaatatagctagaaaacaaggctaacaaagattcaacagtttccaacatggagtaatattggaagatgagaccgtttgcagtttgtccaagaaagtcaaatacaacaaatacatagtaggttgccaatctactaaaaaggaggtcaggttgaccactcgcaaggggctggatagaagaaaataaacaaatatgtagtaacaatgaaaagtgaattgatctgatgcagtgaagctctctaaagtagtggactgactcacattctcgctgaaggtctatcgccatcagggttaagtttctgccacctatatggtttctgtgctgtgtccagagcccaagcatccgataagactcgctttcctgtaccaaaagaaacattatttgacaagtccgacaactattaaaagttattccaaaacatgctagcgaaatccttttagaaggcaataaataagcaacccatgtgaaatcttctaatgggttgagaacttcaggctacttaaaaagttggctgaactataaatctataacaataatagacaagttatctatagttttgttactgaatacggatagccaaggtactgaaatgtccatatatatttgcagtgaaagcgtttttgtaccaaagaaactgttctagttccatgttttctttttataaattgaacaagtgcgagtgaaattcaggccatatttcctcttccacttgggtgcatgcacttttgttagaaactgtccttgtttagggaacaagttatatagatatgtttaataaatactctattgtggagagccctaactggcaggcagttaaaacttataagcaggtatattcattagagtgttacaacttgccagtcaaaacaaaatggacttccataaatagtaaggaggtggaacgccataaaaattattatggaaatacaattcactgatttggagaatttagcatcgaagggctaaccatcatttccagagacagttacaagataacgttgggctaccagatccatacagtgaccatagcgaggaccaggcccagccccctgaacaacaaccctgcatccaatggcagaaatgtagacatcacatatccatccaatgataagcccaaaaagggcaaatgcatccgcaaacaaaaaggctggtgtctttaacattcacctgtgccatttaaacttgtcgtttgtcaggtcaagaacatagagatcatctgtcgagtgccccgctggtccaataccaccctatgcaaacattgcatcactcacaattaattaattagaagtaagtagacaggtaccgaacaaaaaatcgaagatcccaagttccaaatacctggaaaacaaccatcgttcctacggcagctgcagcatgtgcagccctcggcgatggaggctctccagctggatgcaatctgcgtcattaagaattgaacttaaaccctgattatttgaacccataatcccattccttcccttaacggccaagttaagcaaattagttgaatgggtggaatgcatttctcatcctaaacgcacgacagcacaaatataagacaatgatttcatcaccatgtataccataaccctaaaagactatataacacagaatatacgaaattgaacctcaaataaactccaagggatgaggagacctggaaattgagctaaaccctagatttctgagcagccatatgaaacaaaatctaaacgcgagcagcgcccgtacctcgtccacctgcgcgtgtccacatcatacgagtgcaccgagttcgtcacccccgcgagcccttcaagcagagagaccccaaaacccccaaaccattagagcaccaccacatcacatcacaaggggagatagagagaggagaaaagctcaagcaaacacgacgcgcgcgagacttcaaaaaaaaaaaaagagcaccgtactgatgcccggcatgcctgaggatgcgccggcctcgatggcggtggcgccgccgaagaggatgagccgcgggccgtgccccttggtgggcgcgaccaccgtcagcgagtggccgcacctgaaccccggcgagtcgtcccccgccccct

SEQ ID NO: 58204 - DNA, 10264 bp, Oryza sativa
gtgttagaggtggattcaatacggtggggccaggcgtcagcgacggtcgggttaaatggggtgtacgctttgccggagtcaatggtggcagctggcagcaacagctcagaggtgggggaaggacaccaccaccaccaccaccatcggaggagagagagagagacgaggaggacgaggcgggagtaaatgggaggcgcggccgccgccgccggccggagggtggtgggggcgccgtcgcagcagccagcagcgcagatgagcggagcagacgagtcctggttggccgggggctctaactggtgtgaattactactagtactattggtaggacaccgtacacggctcagattacaccaggaggggtttcttctccggggacagcaacaggaggaggtgtgtgggaacgccatggcgttctagaaaaaaaaaattctaggatgcttcctccagtgccgtgtgctgtgtgcgtgtcctaataccttctttttcttttctttcaaccgtgacatttgtcaacttttttttttggttagagatgacaaaattaagcgggttttcaaagatgactttgaggtattaggagaaatgtcgttgtttgatggtcatcggtttttgcgggtggtcatatggttgacgaatcagtttaaaagtatgtgtatggtctattagtagtcaaccgataaaattgatttgagttatatagagaaagtgagtgatccataaaacgactcaacaagatattagaaaacagtacagtatgcatggaacatgcaaaactaggctattaattgacctaagcgagtgctttggtgccacgattcaaaaacatgtaaaactacgttattaattgctctaagcaagtgttgtggcaccatgacttaatacacatttttaccgttgaacacttggaccacggcattaactgtcatgattggattataatttaattttctattttaagcttggttttagtggctttctctcccgcctccattgttcaaattttttttcatgatcacgacgaagacgattaaatatatattttataaacttatttttaaaaatcagtgaaacgaaataagctccatcttaaagcggaagctatgccaagtgggcacttaattattaagaaactagtactcactctgtttcataatgttttaacttttttctagtcaaacgtctttataattgaccaagtttaaagaaaaattttagcaacacatacaacaccattttgatttcaataaatataacattgaatgtattttagtatatattgttttgtgttatatagaaatgttgctatactttttagtaaacttggtaaaatataaaaaatgactaaaagaaatcgaaacaatccttataatataaaacatagggagtgatatctaagccatgtcgtagtgtggaaattggacattttatacatgcacaacataacaaacactaaagctattaggttttagaaataaagtgagtaatcatatataatcacaaaggcactagagatagtgattaaaaccaacacggaggcacaaagggcatgtagaaagtgggttgttgagataggaggtgtaaaggattgtgctttgaagacatgaagaaaatcatctcagctatttggacaggggcactaggtagtacatattgtgtcatcagggtgatatcgattgattgttaattaggttactataagagtttttttaattagtatgactataaaagaatacccaagaaccatccctttcattgacatcagaaacacgataagctaagcatgtaaactagggtatgtttctgttgacgtaaaacacgaggcctaagagatctgcttaactccagtgcaggtccaaaactcgccttcgggtatgctagcgtgccagttgatttgattttgcaatcaacaagaaacaaagacaatacaatcgtggttaaatacataaatgatagccgatcggctatgtgccgatgacgtatcatttatctttgagccaatgtcatatgtgagtcgatcggcggttataaatagataatgaagaactaaatctattcgatcggctgtagatgtcaatagaatataattcttatatcgacatatatttaaaccaagtgattgggatagatcggtcatcatgccgagacagtataaatcacttagattgaaatatatgctaataacagaactatatgtgtttacagcatagccgatcagatagatctagcatgtatcagctagtactccgatacaactctatgttaagaggttaaaacaagtagaatataacagaccgaagcttaatatacttaaatgcaataatatcttgacataaggggcagatctaatgtgtcaatgaagcatataaagtaaatatagttaaatcagataagatcggctgaaactccgatactaccctaatcagcaaccagaaggcatgctagagattgatattctaagcacgacttaataggtcaaactcaactgatgcagcattaagtatgaaaagaagaacaatatctagacaatcaaaccgctggaagtttcatagagtggtagatatcttatacaatctaaaccaacatcgatatttaacctaatcggctgccctatgttaacagatgttagccgattgtaggttagatggcgacattgctagagattatataagatatatgataattcaacgaattacataaacaagattagagtgtcataaagatagaagcactaatcccgagaacgcaagccgtcataacaagttttatctcttgttgaagatcgaaaccgatgcagctcaacccgaaagcaagaactcgtcgaaataaaactaaagcaaaaagggtggcgatgcgccgaaattgtattgaacgtgtgttaaaaattacatagggctcggggtctatttatacccgagaattacaagatatgtccataccggacacgactattatctctaacaaactctaatataccataagtcttttgcggcaaacttttgcccaagcatatctctaaggaaattacataaaatatcctaattaatagatacaattgccttctcaggactctatccatgtgcggcaatcatcttgaagtacatcaactcaaacccgatatcggatacaagtcgtattgtcagaatagactgtatcacttaacccagtccaactcggacttagccgattctaatcgtagccgatccgaacctcagccgattcttactctgtttccgctataatcctcatcttcgattccgcttcaatccaaccttcatcggaccttctttccgatgcagatattaccaaatttggtcgttaacagtttctaatcatttcacacaaaaaagagatacccatgtcccttttggcccaattttgagggtaaaccattatacaaacgtacaaactatttgatttagtgttctcatctatttatatataaatttacatataagacatcattctcgttatttataacttatagattatggagtatccatggcacactttctaagctaaatggcatgatctccaataacttttcttcttcggcatattttggaaaaccttttaactttgtaacgttcagttcattcgcgttttcccttgaataattattatgaacttagaatcaatcatcatttctcgctgggaatgacctatgagctcttttgagcatttgagcaggacctaaattattattattattttccttgaacaggaggaaaaatatattgtttatttgctaatagagatacttcactgaatgcctatatctatatggttaggacaaaaatacttgcaaaattattacttcttccattctaaaataaacaaagacgagtcttgatatattatagtacaataaatctagataataataaaagggatcacttatacatttatcaacaattttttttttcaaaaatttaacaaatataactatagtataattgtgatgtaattatattatagcttacgtgtaactataatgtaacttgtatgtagctttttaaaatctctacgtaacatgatatttcagtgaaacggagatcgtgggaatgaatcctctcacatgtatgcacactgtgatttttttccttcctcacttgcacaaatcttgaaacaaatctaacaattcaacatgtgaaagttacgtacaaattacatgcaagttacagtgtaattgcatgcaagtctcgatataattatattataattatactgtaattacatccgtcaaatttttaggaaaaaaattgttgataaatatataacaaaaattgtaataataaaatattgaacagagatactatcgatagcctatccagatttatttgggggagtacctatacatatttcgaaagatttttatgatcgtatcacacatatttttaatctttgcattaaaattcgatagatataataaaaagcaaaaagcaattaagaaacaccataatggacactaaattaccatatcctcaagaaaaagaccaaatccaatacaaaatttaaaatttacatgcaaagattcaaaaattacattgtaacttacaaaagttacagtgtaagtttcataaattacactgtaacttacaagaaaatgcactgtaaatttgagtgagaaaatcgagtgtgagataagaaaaaatctttcgagtgagatatagcaaaattgtttggttattttgaagtccgagggagtactgtaaacatatcgttatgggctgggccttgggttaagacaaatcggatccgacaggtccaccgacccgacccactacaaatatccccaacccgaacgccgtaaaaaaaacaaaaataaaaaaaccctaaaatttccccaccgaaagcccaagccaagccacacaggcgcggcgcctgcctcaccttccctcgccccggtcgatcgatcgaagccgacgaagcagcgggaaaacgagtcttcccccctcaaaagcgagcggaggaaggaaaccatcgaccgtttgccgcgccccgatttgaaccctcgccgcctcgcctcgcctcgcggccgtggaggcggagcgaaaccctagggaggcgatggctgcctcggtggaggcggcggcggcggcggtggtggccccgcccgcctccgtgggcggtgacgaggtcgtcgtcggcggcggcggcggcggggcgtcggagcaggccaggacgctcatcggcgcgctcaacctgctctcccgcaacctcccgctgccgcccgccgtcctgcacgccgtctcgtccatctaccacggcggcgacgcgtgggagggggaaggggaggaggggggtgaagaggaggtggcggcggcggcggcggctgtcggggatggatgcggcgagagcggggagggggaggaggaccgcgcggatgcttctcccggtgcggatgaggtgcgtgcgcgcccctgtgcttcatcaattttgctgtgcgttcccctttcggttgggtgtgcttcgagttgctcgattagtgctagctgttggattagctagcatgttcagtagaattggcgagatgtagttagggtttcccgtgctgctggattctagagtggtttacagttggggaatgtgggctgcacttgtagaacgctcctccggtgacattttttgatgaatgtctatacctagtatggttttgggtttcatcgggtggaggcattgcaaggcatacttacctgattaatctggagctagaactgctttgtggatcggatgcttgttccaccaaaaaaaaaaaagagatgtttagtgttttagggatttctgatgatgtggaaacatcatttttttttattttttacaaatgcatatatgtttgtggtgtgtaatattttagatgtcattaatcatttttttttacagttggtatgccaccatgtttgtgaagtgtgtactagcgtctaggattatattagtaaaagccttattgtctttaaggccttgttcggtttggagggggttgaaggggattggaggggtttgagggggaataattgcacaccacaataggtgtggaataaatcccctccaatccctcctcttggggattaaccgaacatagcctaaacgggatataagttccagagaacttggttaatactgggtctatacaaggatttgccctcagtagatgtatttacttacgtacattacctcatattgtttttatgtgattgaaacaaaattctggtccaaaagttagattcatactatttgggccttgttgagttgcgtgctgttgattttgttgttagggttgtagtttcaaagcaccatattgtcactgcgatgattgggtgtgtcattacctcttgttctcctttttgggttatggctgaggcatagtgcttatgagtaggcttttgaatggccttctcatttgcgttttaactgagaataaatcgattgccttatagggagtcaccttgattcaagagcttgaagatgctgtattgaagaatcaaggaccgtatatgtcatactcagagttgactgctttaaaagaagaccgcttcaacacttccattcagcataggctgactgaacttgaaggtctgctcatacatcacctatttttactttctgatttattctaagttaaattactttaacggcaagactcctctttggtgtttgtgattatcctgctttgattttcctgttcttacaaaactggatgggttgggatgtgttttcccggcctactacgttttggtcttacgaagttcccaggcctggccttggtgtaaactgcaaaccttttgcttttgggcctgtaagcttgcactgtgaaaaagttgaattataactggccttctgaaacggtgcaaaagctgatgttgttgtgtttgactttttaaagtctatacgtgttttattgtcaacagtttagttttttctgaaactattcttagcatatattccaccaataggatgctgcctactaatattatcatgcataagatatttttaatattcagcctctctaaaacctgctttgttgttgactactgtattagttatgtaccaccaccaaactcatttctgtttatgtgccaggattaccatctactaggggtgaagatttgcaaatgaagtgtttgcttgaattgtacgggcttaaggtaaatgtgatattagaagcaaatgttactttggaggcgttgatgttttctgctgttactgcttttcttagatggtgccttttgtgtacagtgatgtccctagtggtgtgaagtatacaaattaactttgtttggaaagcgacatttgtgcaaacatgcataatctattgcattttagacttctagtacattttatggacgggcagatttcagacgttactacccaataatgtactgcagtagtcttgtccagggaaaaactgttcgtcttttcttttgactgtaccaaaaaacttattgtctttaactagcagtttgcctaccaaatcttgatgcatgtgtgaagaaaaccataactgtactatcctaggcagttgttttagctcctagaacagaaaccaaggaaactattgatgtggcgatgattactatgtaaacgtcgggggcgcctaatgggcgagggagtgtgtggcacgcaatttgcgctcacgttatcacgcgtaacatgcgtagcattaggtacgagccatctaggaagttttgataacttcctatatgggtttaaatctttccattagaaaaatcactctacagatttttattctgagagaaaacttcccatagttattatggatacaaactttaatatggtaaaactgtcaatagagagaaaaaaatccaatgatccattggaaaaacttccttttcttgaaaattttatctactcaaagatttctttttgaaccaaaattgataaaacctaaaaagaagaaagctcatgtagccctctacctctaaagcccagcgctctgtcagtggaatgaccacacatacgttcgcgtaaacagattgttttatgcggaacagaaaacggatatcactcactgggagaacgctaaaatggaaagcgtgagaaccattcacactgaacgcgcttgcgaatcaggagttcaaatatatatgtggccggttgaggaattcagggatggaggtgtgaagctacatcaaccgcaatggtgattttgcaaatatctaataggccctctactcaatagataaataagcttcactactaaaaatgttcgaattggtgattgtgatggtgtgttctaaaccacattcctcctccccactccctcagtagtaactagtaaagatgtttgactgcatgctttctaaaatatcatatttctgaacggatagaatttgttcctaaatttgggtcttgaatgtacatgtaaataactcacgccttactgattttttttatttaatatgcctcagtacttctataaaaaaaccacaaaggatctctgtaatttctcaactgtacaatgatttgcataagtaattaagtattgtgcttttccacaaaaactgctatgcacctagctagatccaactccgttttgatcaaggcattgaaacaattaatcagttgagtagttggtatggaggacgtctttaggcagggagtactagtacaatagtagtatcatcatatgatctgtgcactatcctttagtgaggtgttaattctattttgttggacagtttggctatttgaaaattgaaactatctagtgcaaagctcaacaagtgtatgaattccataggtctatatcaagaagtacgatattagaagtgagttatcctatcaagctcgctgattattcatatacttgtgcagttattagacttgcagaagaaagtaaggactgatatcagtgcagaatactggctacacaaaaaatgtgcacaccctgataggcaattgtttgactgggggatgatgcgtatacggtatccttttaccatgtatggaattggagatagtttttcaatggatgctgatgatatcaaccgcaaaaagagattctcagaggttttgtatcatgtatcttttgattattatatgtttggttaatttatatacacttgaattaataaggactccctttttggtatttgggaacaacagaggatctcaagacttgaagaggaggaaaagaaccaggcagagatcaggaagaggaaatttttttcagaaattcttaatgctgctagggagtatcagctacaagtaccggcttcttacaaacgaaaaaaacagcgcaatgatggagttctggtacggtcaatataattttcattagagattaacagatagcttgagattggcctaattggttccttccctatggagaaactaactcaccatattttggaccaattattcccttttttttggttacaaagactaggttgcactggtaccagtaccttatgacagtgttgtttgccaatagtgcctataggtataagagaaaagaaactatttttgttttactatgccttggaataatattttatgccctatgcccctatctgtaatggtctcgcgcctataacttatgatatgccttggaataatattttatgctgttggtgattatggaagatgagaattttgatggcacacacattttggtgagaaaacaagtgaacaataccttatggatgatgacttaattgtgtaccctgcaaaaataatgaattaaagattgagtttttgtgtgatagtatggatcaagttctctataaagaatgtttaaattcttgattcttgtttgctacttcatcaatacattatcgagttatcattgtactgcatttcctttgttagagcatatgtacttgttcctagatatattccttttgtggattgttcaaatgtttgtgccctttttttttcctctaaatgtaggcatggcatgttcgtgcacgtcaacgtataaatcgcatggaaaagagtagattacaagttttaagggttggtgaccaagaagcttatttgcgtatggttgaggagagcaagaccgagcgcctgaaactgctccttggaaaaacaaatgagcttcttgaaggaatagggaaagctgtgcagagacaaaaagatgctgagcatgttagtcgccctgatggatctgaactgccaaaagggtcagaatctgatgattgttctcaaatatcaggcctcaaggttgaatcccctgatgaagagtccccatcagatgttgatgcagaccatcatagttctgctgatcatagtaaattta

SEQ ID NO: 58205 - DNA, 1981 bp, Oryza sativa
acattcactaaaattataagaatgaaatttgttctgtgaatgtaatacattattagtttgttttgtgaatataatttgatatttagcacacctattttctttcgcacctcagtatttgtttgcttcatggctacttgcctactctcatgttagcaaattcttttacatttattcttcatccttctttttagtgattggacattattaacatattccttcaagcttagtgaaatgaatagttttgattttttaggataattttacattgatttttttgaattgacattttacactgacttacatttactatacttcatttgtagatatcaaatccgtcgccgattacttttgactggcactccaatccaaaatagcctacaagagctgtggtctttgctgaactttattcttcccaatatttttaattcatcacagaattttgaggaatggtttaatgcaccatttgcatgtgaagtcagccttaatgatgaggaacagctgctaattatacatcgtttgcatcaagtgagtgatggttgcccccaatccacctactcatgtcattcagtatttttaagttttaacttaaaatttgcaatagttagctttaactttctcttgcatatcaccttttcggttgaattcctgcagcatgcaaagtgtgtggctaaaacatgagttaggctaattattaatatatgtgaatatttatttaaataattccgttactctttgttctctgcacaggtgctgcgtccatttttgctgaggaggaagaaagatgaagtggaaaaatatcttcctgtgaaaacacaagtaatactcaagtgtgacatgtctgcttggcaaaaagcatactatgaacaagtcactagcaatggaagggttagtctaggatctggtatggatactaatccttttcatattgttaattgtttgtaatgtttgactggttcgaagagattggaataatgctcagaattaatgacttggctccactgcaaatatggatctgttttttcccctgttgttgctatatctaattcatagtctcatccttgcttttagtttttcactttcattctttttatgacctttctgtcttgcttaagaaaacaacaaacttattgtcatgtttgtatatgcaggactcaaatcaaaggctttgcaaaatctgtcgatgcaacttagaaaatgttgcaatcatccctatctattcgttgagcattataacatgtatcaacggcaggaaattgttagatcatcagggaagtttgaattgcttgaccggctacttccaaaattgcagagagctggtcacagggttctgcttttctctcagatgacaaaactgcttgatatcttagaagtatatttgcaaatgtaccagttcaagtacatgaggcttgatggatctacgaagactgaagagcgagggagattattggcagattttaacaagaaggactcagaatatttcttgtttcttctcagcacccgagctggaggccttgggttgaacttgcagactgcagacactgttattatttttgacagtgactggaatcctcaaatggatcagcaggctgaagaccgtgcccaccgtattggacaaaagaatgaagtgcgtgtattcgttcttgttagtgttggctcaattgaagaagagatcttggaccgtgcaaaacagaagatgggtattgatgcaaaagttatccaggctgggctgttcaacacaacctccacaggttagattaaatcctcgaacaaaattcatacttcctctgtttcatattataagactttctagcattgcccacattcacatatatgttaatgaatctagattcattagattcattaacatatatgtgaatgtgcaggctgggctgttcaacacaacctccacaggttagattaaatcctcgaacaaaattcatacttcctctatttcatattataagactttctagcattgccc

SEQ ID NO: 58206 - DNA, 6353 bp, Oryza sativa
  unsure (1)..(6353): unsure at all n locations
agtcgatttcagtgagaggaggaaaaggcataaatctctagtgaacattgcagatgatgccagcattccaatgtggacaccagaaaaagtaagggctggggtttcttcatatagcaaggatgagaatgaagacgatgccgaagatgaatccacacaagtgttttgcaggggggcagttttacatggaagacccttagaaggaaaaggtcaagccacttctccaattcctcagattcaaaagggcgctcggcattctaatcttgggattcaggaatgttgttgccctgatgcatttgtttgaatcctctcctttgagaaaggagtgctcctggatagaaattaacagggggtatttagggtacatttaagcttacaaattttaggattagtggtattgtatggatttcttggtattaaattgtgtccatcagaactaaaacatcgtagttggctttctggtataaagtagatgtactgttcgtctcgccgtgatatatccagtggcagagtggctttctggtgtgaagaattatactgttggtcgtgttttgggagtggtgtttattggtaatctatcgagcgatcggtgttaatctagctaggtttctgcaatggatcatatccatggttgtgcgctctgtgcggccggatgatcgcattaaatattcatcatttttgcgcgagcaatttatacatacgatgaaaccaggaaagttaaataaatttggactataaggtgctccctctacattctggactgaggatatcaaagcaagtttatttgtttatcctatatgaatgtgacatctttctggtttgaaaatcgttggcactctacacgtcctggtgcctaactgcctatgtctaatgcatggaatttagaaatgtcaatagaattattggcattagtttcttgatgattatgttcaagagatacacttacaaataagatataaatgatagtctgtatttatatagttggaaaaaaattagcatcttcaattgaggtgctaaatttggctctccaaatcttcgttccgccgttctcaccaaaatattgttttttttttggtccactccaacagactcttttacgttaattggatttgcatgtcaacttgcatattagcgggacttgtacatgagaggaagggaaagagagagtatgggtagggaaacaaaaatagaatggtcagggtggctaaatttgggcactaaaaaaattgttgttgtttttgtcatgttggctaatactccctctctccgtactcgtaaagtaagtcgttttggacagccacacggtctccaaaactcaaatttgacttcttgtttctataaaaatatttattgaaaagtgatatatgtatatttttatgaaagtatttttcaagacaaatctattcatataatttttacatttccaaactcaacagcttgagagttattcatgattttatattttcaaggtttgacttaaacattgtcctaaacgactttctttacgagtacgaagggagtatttcttaagatagagtgagacggcttgaagcatttattacattcaaataagtaggcacaaaaagtatcttcgatattttgcctactcgaaaattaccgcacatcttaaataaatataaatacagagtaataatttagagggatagatagtgagagggagaagaaattaaaattttactgccccgtttcagactatagttgtttagattttagtcaaaatcaaattgctctaaatttaattaactttgtagacaaattcagtaatataatatttacgacaccaaattaatttcattaaatctataaaatatattttgagtaacttgcatattgggtctatattttttacttggactagaggcaatctaacctttccactatgaaccacctaattttacaatcgatttcagtttggacctccgtttcctcaagcttcctctccctccccacttctccatgttgcaggaacatcaccggtgaaagaccctatccggcaccaccgctgcactcagcatcatccctcacaacctccattcttgacatcgagcctccgtagcaccgacgcggcgttcgacctcaagtcctattggtatcggcgctggcgcaataacatccgtcagccaagctagcaccacctgtgtgccccatggctttggtccttgtcttgagctcgagctccaccggtcggcaccatgctacacctcgagctccgccagcnnnnnnnnnnnnnnnnnnnnnnnctgtccctgcaatggccaaggccaatggagaatttcttttctgctttctttctgaccgcaagtgaaaatctaggtgggggagatatcgagatgccactcaagcttgcaatgctggggagctccggcgtgagtgctgcagcggcggtggactggtggttgctcaacctactcggcaaacctgctcatggtagggaaagctgaaggtagaagaacatgcccatggtgaaccatttggtaatttttcttggtccaagttgaaaatgtcagcttatctctggtccaaagtgcgatagtggtaaaacaatgtgaccctatgtacaatttactcatatatttttataatgtatttgtcttatgttaaatatattactactctttttataaacttggagtagcttaactttgaccaaagtcaaaacgacttatagagtttgtttgggggagtttctagctgctgcagcttctcccagaatcaaaagctcccccaaacggtgcagcttttggttcagattatgagaagctggagttacagaatctagaaaaataaattgaagccagaagttgagaaacctagttttttcagattctcggaagttggctaacaaacaagtgtttatcataatcttaagctccttcaaacaaccccataatctgaaaatagatagaatatatggctctgaattccattatattgttggaatctactactccactacacgcaaattttggattaactgagatcattatttgtgtattgccctttcactagaagctactgacaggtaggcctcgctcttccatggcctggccccacatgtcaaccacctgtaattcctcctctcctaatgaatcaacccaatggcccacttgtcagtgaccctgttcccatcctaaccgcagaaaccctaactccccacaaagccttcctcccaaaccctccgcctccgccttccccttcccgctctctctctctctcccacgtgagcgcgaggcggcggcggcggcggcgcgaggtgagcggggcaccagcggcggcggaggagatggggaaggcctcgaaggggtcgcggagagggaagaaggcgtggcgcgccaacatcagcaccgacgacatcgaggacttcttcgagaagcagacgcgcgacgcgcacgccggggccgccgccatcccgtccctgccctccgactccctcttcttcgtcgacaagccggcctccgccgcgtccacctcctccgccgccgacgccgccgcggcggatgtcgcccccaaaggtaaaatcacaaggcacgtggggtcgagcgtgtggatgttgctgggtgatagactcccgagtcttctacctcgtggttcgggttgtggtagtagtttcgaatcgacgctaaagtttgtgttcttggaatgcttaatgtgaaaaatcgcttcatatagtcgcgtcaagctggttctatcaccatttatctatatatattgttttgatactgtgaagattagttaaccttcagtttgggacctgaggatatgctctgttacttttaaccgctccttttgatatttaattataaagtggttcatatcagcaatgaattatctcacttgcttcaaagtaggcgcaaagtttctaaatgagttaatgtttattgtgtctattccctcgtaacctctgtgtttcctgctaatgtatcccttggtgtgttggcacttttgtttactggctatagatattcctgtccaaaggaagattgagaagaagagagagaaggttctatatcatgagagtgtattgaagcggaatccatatgtacaaccagtcccgtcttctttaacgacaaagaaggataagaagaagtcaaagaagaaggaatcgaaagagacacaggaagcgaaaattgttcccatggtatcaattgcttttatttgagacaaaatgaatttccttttgttcaagtcccaggttgctaaggtggactcatctgttttacaggaagatgattcaggtgataagatccttgacatctggggtgaagatgttaaaggagatcacaaggctaaaaaggtgttgctatgctccgcattctgttaatctgttttcactttctctatttgtattacaaaaagtcgatttttagaactatgcagtcatatttttcaaaatttacaaatctcttctgttgcaatatgctgaatttgtgggttttgtatatcaattttaatttgttagtttctttttttttctttttatcatttttgttgcagaggtctaccgcatctgtgattcctgctgttgaagttgaggccccaggatgttcatttaatcccccattcgaagcacatcaggtatgttttgtaatttatgttccggatttggcaatgttacccatgttttaggaactgatgatccttatattagtggatatcttagcacttatatttaacaacaaaatcctgttgacattgtaggattctcttgctcaagctgttgctgatgagatgcgtaaaatctacacgaaagagttagggcccaaacctgtgccacttattgttcctggtgaagcaatcactgaagaagatgtaagtcttatgcatctctttgccaatagatggttgaaatttctatattctcatgtcttggaaatgttacacgcgctctcaactttttagttactttgcaatgaaaactgcctttttgtgaacttcgttgtgtattatgagttgagtatttttggagttggattccatatacaatgccagtatgttctgtggtatattcatttagaatagcatggcccttcaggccttcaccttactagtggattgtgcttgtgatgtctatgtagcatttttgcgtacaatcttacttataccttttttctgcatgttgcctacagaaattttttcttgatgcggatgatggagatgaagctgttgaagaaggtgatgaagaccaggctgctgatgctttggctgttcagaggttagattcgactgttctattggaagtatagttttaataggttatgcacttatgctgtacgatagacttatgcgtgatgcttaaatttccaaagcttttacatgcttttagggataacatggtcactatgcccttaatatatattttcaaagcttttatgttttaatatatctttttccatttctatatgataataagctaatggggcaaaatatgggttatccctgtttagagtttttatattcctcaattgctatgtggcacttgctaagtaattatattagaattcaggtttactgtatttgtgaaaataaccatgaaagtcacagcttataacttaagaattctggaattaccatgtgctgttcttgatgaacaaaacacactgttctgactcagtaaattttaaatttgtcttgcaaacactattagagtgtacttttgattgtatgatttattattttttcaggaaaactaaaacgaaaagagttacaagagtagaactgaacaaaagagctcgtcgtaaggagaggttaagagcagaagctgaagcaaagaagatggaaaatctttcaaaggaaatagataggtagttctttttatttttgttcactaatctcccaagatctgccatttcagtcaaagttagcttgtattattatattattctttttgcagcctgcctgatataataaatgaaattgctaaagaagatgaggaaaaggagaaaaggcacataaggcgaactgtggctaaacaggaaagactgaagtcagccccgcctcgtctgggcagacacaagtacacctctaaaatcacctactctaagtcactcatattttcttacagcaattcctttaatcttggataaaattgctacactgttttaaagattctgcaaattaacaaaatagtttagtttgcatatttcacatataatgatgccatagtatatcatggagacatttaagttagtaggcaagatgtttcatggacactcaagtagaacaataattttagaataccgtgatgtagtagtcgtattctttttggaagtgaggcagttgagtactccctccgtttcatattagaagactttctagcatttgcctacattcatata

SEQ ID NO: 58207 - DNA, 1267 bp, Oryza sativa
gatagaagatgaggttgcagttacatgcattatactttcaggatgccatgaataattttttggatggttaaactacccaatgcctcaggctgtaccatcctggcacaaattcagtgtatccacaacttgggaagcaaaggaagacaacaagattctgttgatgcccgctatggaagcttgctaacacttcagattttataaactctacatcaaagggcgccagggggcatctagtcatcccacaagaatgatccacatttcaggagaattttggggtactgctggtttatttgtactaaagcaaccacagttccataagattgttttcattatatagtttgtgcagataaactgtaggttcccaaaaaagcacaaatgctgaaggaacaatcccagaataatctgctagtagaaaaatagtttggttgttatctggcaacagttataacatggtggcaattgtccttagcaaatttatttatttaaatagaacattcttcacagcaggctactgaaagaaatgcaaaagaaccatctttcatgtgaaaataaatcaattacctgtgtgtatatatttcagtcctcggagcaactgatacaagaaaaactggtagtgttcaggagtcaagtcatcgttggcctttataacttggtgcaaatcagactccatgagttcaaaaacaacgtagatatccttgaattctctccttgatggaggaagtagaatatgcttaatttccacgatatccggatgtcgcaggagtctaagcaacttgatctcgcgaagtatccgtgttgcatcggacacatgctcaaagatgtcattgattttcttgatagcaactttatcaccggtgtgagtgtccaaagcagagcaaaccacaccataactcccttttcctataacctcttctatcttgtacctgtttccctcaccgtactcggtgaaaaaatccatctcagaaggtgtctgaatcataaaaagacaaaatggatcagaatcagactagttcttttagtatgacaaaagaatttttttagtatgagaaaaaaaatcctttgttcaattaggtcaaccatcctaaaggcattagctaaatcatactgtatgaaagcggtttcatcggaaacaacataccatgtcaatcatgtatgatgcaaaacagcaagcgttactttttttatggggataaataacatcaagtgatattcttttttatttcaaaaactgcttaggggtcagaaccgcatgattcaacgatgtgta

SEQ ID NO: 58208 - DNA, 18495 bp, Oryza sativa
  unsure (1)..(18495): unsure at all n locations
ttcgtttcttggaaaaaaaatttttctcttggtgttgtttggtctggaggtgagagagctcccactagaataagggattggagcacatggagccatctggtttctgacgttctgtccacatcttgtgtttcttttgattatttactcttcttttttctattatattaaaaaatataaaaagaattggtactctactttgtttttctaaaacaagaaatatgtgatataattattatatatatatatattgaaaaatctaaaaacaaccgttgaataaaaatgaacgtctttgtctatatcattaaaagtaaaatttttacgctaagatttaactatgagttttactacgagaagaaaaggtttatgtttgtaacgtagacaaatcatagccgtttatttttatatctatccttatatatgcggtttgcttgacatatttttccggtttcttaagcaaactaatttaagtgtagaacttaaatttaattttatgagaaactaatttggtgttgtttttctataaatgttgtgacttagggcatgttcatattgtagccaaaataaacattaccaagttttggcaatattgctaaaattttggtaagatttcttatgtattgatcaaatttggcaacaaactaaatgtatttttttttgcaattttggcaactttgccaaaaaatggtatggttgaaaatggtatcaaagtgaacagacccttagaaaacttataattacttataatatgtgacagagagagcaatttggcttaatatatttttacgccgaggcaaaaaataatttattcataacaaaaagtccaaaacgggatgtctttatctactagagaaaatacgcgtaggaataatgagaaaggaccatgtccaggcttcctgtttaaggaaaaatggaagagatgaagcaatatgaatttcaacctttcctgaaaagatataaatttctatcattgctgaggtgtgacagcgtttgtgcagcatatagctatagaaagcatctgctcttcaattatttcccgttcctgtgtactgagaatgtaggcaacggaccgcaaattgaatgaacatttgtgtagcccctatagttcctggcaagaattcaagtgaatttactagtatttacatagagacagctaagctggagtgctggactagttatgcaaggaaatatctttatctattttaacgagtattaagcaatgccctctttttgtttatgtgatcaggcaagtagtaattccatgcttgatcattgttttttttttctaaacatgtatccatgtaaagaccattaaagaataattacacgataatattgttcgtggaaaacctaggacctgttcactttgatgccattttcaatcttaccaaatttttataaagttgcaaaaaaaaagtgggtacatttagtttgctaccaaatttttgtaactatataagaaatccttactaaaattttggcaactatgctaaaattttgtcattggcaaagtttgatatggtttttttggcatcaaaatgaacaggctactaataacgtcatataatccgtcagttttgttttttaacaatattatgggtgtcatttattttgctataacttgtttcattattagagaattttaaacgtttcgttcaaaaaaaaattaaacgtgacttatattttctatattttacactaaattttaaataagatgtatgattaaacattatatatcaaaagttaacagtaccctatattaaaaagagagagatagtatctcacgtatattgatgagatgagatttccagatttgaccgtacacgttctaaacaaacatccttttaagaacggatgagagtatcagaccaaattaatgtttgttggcccatgcacagttgcatactccattatcaactttagaaacaagacaaggaaatatcaaccttccaagttccaagtaaagagtgttttgccaggtaagaaacagcaaaaggttgagtaaccaccctttttcctcttggtttcagttgattgcttgattcagttggatgtccaaaagacaaactgttgtgtacaattataaacaggtcaccaaattctgtgcaaatctgatgtctgaggttaacatgacaaaactggtaatcagatgcaacaattagcagtggacagtgtcagccatctcaggttcacaaggcaatattttccaaagcagtgatccatgaaacatcatcaactaattttgcccacttcagcactaagaaacatgtggagcaaataatatcacttttttttgtagaaatggtactttgaagatactctttcatcaaagcaaacactccacttttaagagacttggacaaagttgagtgggattgcatatgatcctgattgctcactaattataaaaatggctacagatgccattgccagccatgtgctgccaactaaggcaaaagagtcgtccaatttataacgatcaccagtgaactagatttctcttgccgaggacgttaataatcttggttcttgaaggaccctgggttaacaagacaactaanatgatgacaatctagaaaattaacaattttagaacatgtaccgatgggtcattctcctaactgaatactgntgactacatataataggatgccacataatttcctctttcacaggaatcagcacatcgggtcaccctcacctccatagttgacccacttagagatcacgacaaaaccaaagaagacttgtttctgatacgtctgtcacagagttgcatcttcagtggtcacttgctagcatttaccttgtgattcgcatcaaataaggtcgatttgcccactctcaacaaggcccttgatggacttgtaccggaggacatacaaatcatcagcaactaagtccacaacctcctcccctctacgtgaaattagagcaccacagtgttaagtagagcttgaaaaggcgcaacagcaaaaaacaagagaacttcggcacttacatatcatctagctggaatgctcctacgtcactcttggttttgcagaagacaaaggtgtcaagctgaggctctggaactgaacaaggcaaaaaaaaaaaaatcgaatcatatagtttctagaggtcaattacagtattacatcactcaaaaatacatatgtcccacatcagcgtatcttcagaaataggaaggaattttgagcaataaaaggcatgtaaataaacagtctataaataattcccaaatcttcttaaaatagaaaagaaccttttgctggaactttctttactcttttaactaaaagtgcagctcaggttcctgttctagtaaaaagcacatggaatgtatttcagctccaagatacataccatatattaaccagttggaccatcctgatcacactatttcattaaaaaaagttatgcaccggattgttagttactacacactgattaattcctaactgtatgcaacacggctctttggtggattgaagattgcaaccactatacaaggtaaaatatatctgcatggatctttggcacaactgatgatcagtaaaaactggtgattatgttagacaaggaacattatcgcgctgtgtacggttgacatttctcactctgtactccctgaaactgtgtatggttgacattcctgcatactgttgtgtcatgcatttccgtttcaaagaactaactataacagcattttactttctattcatctatgcatgcggataaatagtactaactctaggaggacttaaatattttcagggcaaaccagtaagacaccattttctcgtcagttaactgtatcaaagaatataccactttgttagtaaaaattagcagtcattagtactccctaaaaattataataaaaggattgatatatgcgaagctgattcagttctagaactgtttaaattgagcatatccgagactacaagatgaatgagtatacaaagaggtctttattgcatcctgtggttaaataatgttatttatgagtatgatatgaactcaaattttgggtgcaccaaatttgatacttaaaatttgatcatactccaaatttgatcatgctatctgatcaaatctctgccaaatagtgaccaaaactccaaccaacatctatttggcagagattgatcagatagcatgagaaatgtcgtgttttctgctttgaaatggtgaattttgtactcatcatttgcattaagcagattatgtatcgctcaaaactacaaccaccaaaatagtattgcatcccaaataaacgcactaattataggatcaaaaggaatacccatgtcatcctccgtgctcgacaatgattgcctcgtgacggagtcatacccgtatggaagcttcgacagcactgactgctcgagatgcttctccatcatctccgtacaacttgcaacaaatcaaacccaacaaatgatcatcaaaaccacctgaatccagtcaatcaactaaccagcgtaatcacaacgagtagacggtctagtcgcctgaaaaatacctcttcgcaaatcgctgctcctgctgcgacagccggctcaagagatcttcagacttggagatgtgcatcatgtacttctcaatctacatccatccgtcaaagtaacaggcaatgccaatgccaccagttcagttcagtgatcgatccaatgcgggtggagttacagagaatggaaaattgaatttaaccttttgtaggcggaggcggaggtaggatcggaggaggaagagcgtgcgatcgagatccatctggtagagcgacaccaccaggtcgtcgacgccgctctcgccgaagtcatccagcgtctcctcctgaccaaaatcacatcacatgacagtcgataagaattccggaacaatttgagctagaacacgacgaattgggcacgaatcaagaatcgaagggaaggggaggagagggaaaccgacgaggagctggatctgctcgcggacgcgggagacgaggggagagtcgaagcgaaggatctccggagacgccttctcgttgcgccacgctcgcttgagaagctccacgtcagtgctcgccgccgccgccgccgcggcggccgcggccgagtcgtcgtcttcccaggaggacatctgctttcgctaaaccagtaactggcactctcccggatggtggcctcgccggccagcaaggggcggctacgccgtttgtgtcggtcggtcaggtcgacgcggcggtggcggcggcgtcggcggcgaggtcgccggcgggaggggaggaagcggagcgcgacggcgtggtggtgggggggtggtgggccgagccaaggagatggacgtgtttgggccttggtccatttgcagagtacgcctctctgcagcgaaagcgtatttgatactggacttcctcaaagcctgatgtagctgaccggctggctgagctccaaacatgaccagagcatgaataccaagaacccatcaatggctccatccaaacgacatatttacaaataaaaaatagtttataaataatttttttatatatgtgttgttattgatctaaaggcattggctaaaaataaattacgatgaaaaaaaactaaaatcaactccaaatttaaaattgaaaatttaaatcttggcttataagtataagtataagcggaaagatgaggatgcaagatttttttttttttactaaaacatagagattccattaacctatgtactagttacctccgtactcgaataactgcccatattaactgtaagtctaaaatatctcactttaatgatcatattatatggtgagtgcaatttgtatggttatatttaccacgcaacatactccatttaactgaaaaaaaaaacaaatcctagcacatatatactctctttggaacgctttggaacggagggtgtacttcaataatataacatcttttttaagtttttataatttctttataaaacatttaaagtttaaactagaacaatagtagcgctaagagagtatgtgattatgttgtcaggatagagagtttgaaactttggaaactttggatggctagaaagttagacaaggtaaacccaggttgtcattatcctgatccatattttagtatcttacaatactatgaagccaaaatgatactgatcccacctatgatatcctaattttcataatatctcgatcttactattcatttttcacatgatcctataaaatctgaagtagtatcttggtactacgattctaccaaatattatttaaaataaggtggattgaaaataatgtgaataaatatgctcaagtttacataaaaaccaatttttttttcaaaatcaatattacatgctttaatttatacattttactagaaaaaaatgcccgtgtgttacaaagggtgaatgttcttttaattattattatacggtttagttaagttaaaattcaccgtgagaatttgcttggatttgtttatttttacaaaatcatgagcggcaattaggagtatgatcgtctcaagttagcatgcgagtttttttaaagagatttcttatacgactctctttctatattccaaaagcgaacgtccttaaaatctaactcaaacacggatatggatttccaaaagcgagtgaatttaaaaaccgactcaaacatggatgacgtaccaaagtaccggcaaaaacatcttcagtttttataatagtagacatataaaaataatgtactttccaaatctgatagcatcccgatcctacggtagatttcaatactatgatactacaaatcagaaaacgatcctacctagcatctcgatactgattaccttgggtaaaccatgcaatgttggtttcaatgtttcaatgtttctaaagattagctttggaggagtactttagaaacattgaaaccaaccttcaatattttcaatgttaaaatctctaggataatcataaaacttgaatgatctttaaaaataactccatcaaatatagaattacgatggttgcttatcatagtccttctccagtattaggcaatcgctctttaagatgattttgttgattcttagtgagcttgccatgttgatagccgctgcattgcttgaacttccacttgtattgtaactcaagaaactaaatgatttcctcttgcttcttttcaaaattacctcacgaatcttcgcaacgggacaccattgttaacttcaacaaacgcgagcaatggtctggaataagagaaaaaccgatgattttatcatacccagtaactcagatgataaggaaaaaagcttctcttggatggaagtgacaactaaccacagccaaatgttttcaatacttatcctcctcctacaaaatcaaatagaaaaaaaccagggaaaaatcacgtgacacgtattttcatcaatgcttcccattgtttaccaaatctaaaatcagctaaggtcaagatttcaaagtttttcattgaagtttttttctaagcattgacttttaaatcgctaactatatactcctatatatttacacatttaacaacatattattattgttgttactactttgggcagtgtttagctcctttaaacttccaaaaattccgtcacaccaaatgtttaaacacatgtatagagcattaaaatgtggacgaaagaaactaattgcatagtttgcatgtaaattgagagacggatcttttgatcctaattacgccatgatttgacaatgtgatgctacaataaacatttgctaatgacggattaattaggcttaataaattcgcctcgcaatttataggtggaatctgtaatttgttttgttattagtctatgtttaatactttaaatgtgtatctgtatatttaaaaaaattttggcacacgaactggccttgtgctgcgttcgggaggagggggcacgtaaaacggagcacccattattgcatgatcaattaagtattagctatttttttttcaaaaatggattaatttgattttttaagtaacttttgtatagaaactttttataaaaaacataacgtttagcagtttgaaaaacgtgcacgtggaaaacgagctagatgggttgggaagttgagggagatggtcgaggtggcagtgccaagcaagcagccaagttggcaaccgaaaatatcaaaggcttcccgcgaccaccaaccccaccaccacacacatccatcctcacgacgccctccaccgcttcgcgaatcttcctccccaaccacacgaaaaccaaaaaaaactcaccttcaccctcgccgtcgcggcgccccccaaaaaaattcacccctttttccccacgctccggtggctccacgccgccccgcccgcgcgcgaccacccgttccaccggcgaatccgcggatttaatctcccacagctccccgtgagatcacaaagaccgggcgggcgtgggctgtgggctgggatggtgggcgacctctcctccctcctcgccgccgcctcctccgcctcccccgtcgtcctcgcgccatcaaaggtgcgccgcttttcttgctctctgctaccccggttggggctgattgatgattgggggaattcttggttttgtaggagctccatggcgtgcacttgccgatgccgctccaggggaagaggccgccgctgcagccgcaggacgctgccgtccacatcgaggccgccgccgccgccgccgccgccgccttccaggggcaggtgatggtgcccggccacgcgcatgccggcgctcccgccgccttccaggccttcgctgtgcccgacatggccgcgctcatcgacgtccaaggttcgtgttgcctcttcgattcctcttcttccttcgttaagtgcatgcacaagcacaccgttggctaatttgctagagattttgttgttcaattgaatttgaatttgccagtcgcagctatggatccgaattgtgagattaggcatgctttttttcccctaaagttagagacagtaatttgctttgcagaaaggagtagaaacaaaattctttgcttgttcatgcgcgcgccttggcttgtggtttacaaatgagacctgaagccattgctttacacatcggttgctttcttctgtgtgcttgcacatagtacaagattgtgtagtgagctttgcaatggtcttttctagtaggatggtttttcatggtatgttacacataattcaggtcaagattaaaatttcctactctcactaagtggtttgtcccgttcgattcatgatttaatctgtcaaattttcagttttacaagtgtggattagaattcattttcagttttgcattttatgctgattctaacctcgatgtatctgtgcagcagactctcaccctgactcagttcaacttagccttgggattgccgagcaatgctcaaggcaggagaaaatcctgaaatttctaaggtcagggtccgatgtgaaagaacttgatgtatctttactgactgaacttacggggcatcaaactctgccaatcaacttgggtactcaaccatacatccctgatgataagttatcagctcttccaatcagcatggccagtcaaccatatatccctgacgataagttatctatctatgagtttgaattggatgagccccagcagtatctaccagaaaatcaacttgtcatccctgatcctcttgtggagtttttccagtcccatggttctgcccttaccatagatcaaaacaggagaatcctcttcaatggaaatggagatgatatgagatatttactttcgattgtcttggcattcaatatgtctaaacgagaaataagcagttgcaagacagcatatctagttccatattttgaaaggtaatactgtgaagcatcatgctccttgtagaccttctcattcatcttattcatttgttcattgaggtttaatacttgagtgatatgcaaactccgtggtaaccgtgttctcttgagcactgtaaggtagaccaatgattctaattttgccactcaggctgttttccattagataaaagctgtgttaggcacctatggtcatcttttagctgtattagcaaagatgtcgcattaagatcttccttggtctgctggacatgttgacaccgtttcaactggccatgaatagtgcatagcatatttgttcgcggttggaatgaataattccatgtctggatcaatactcccaacagaattctaaagactgctgcatcacttcacgcacaagacgctttccctgtagaaatacagaagaaagatgttaaaattatttcttaacactattgctgttctagacgacatgtttccttgtgcttcacaatgatctgttaaaaggggcattgcattgcctctgtaatcaatgttgaatcatgtgttttttttcttgtcttagtgaccccatcctcattattgatgcctcttttttttggcttttgtctaattgtcttataaatgtcttttttgataaacaggaaaaggcgatcccgagcaagcagccatgcatccaattcaaaattagcaagcacagcagttgatgcttcaaaaaggtacattgcagtcacttgtgtattttctgaacaccaaccattagcataacttctatactgttttcctgccatagtcatgataaaggttaaatactcaatggattgggttgaagtagtgcaattcttattcttcaaactgctagtgtagactttgtagttacttcgaaaagatacacaatcacttgcagcatagactagacacaagtagtggcaggcttttttgtttgaacaaaataaaagatcagacacatagaacagacatgtgggaattactggactaaactacgatgatattgctctttttacctgtttctaaaactgcatccaaggttatttttacatattaatgtgattttttttaaatactcagcactgcaaatgggaagtcaaaatcttcatcaaggaagaagcagaagagtaaaaatattaaagaacgtgacctgtacccgaagaactatttccatgctagtgaagcatttttatctatgctcctggacaaggacaatagcagctcaacaattcattcactgaaaaaagctggtcctgagatcagtgaactgctgacaaaatgctctattggcatcgctggaactggcttggctgttcttctctcagttgtgtgcaagatggctaccggtatgaagagtcctattgctgctacgcggctggtgaacactggtgttggacttgggctcttttggctctcctgggcagtaaacggattgcgagacacaattactagcatatttagaagcccaggtgacatgaacttgaaggacgaagaggttgcagtcagaatacaaaagagcatgaacgacattctcttcagagctatcactatattggcaatcactgcttttaagtttgcgtaagtggttacatactaatttaccttttccccgacccacctgtaatatataatccaccattttggttcaggagtacagcactagtgcttctgtaggattaagtgccaattgagcaaatgatccccggtaattttgtagaaaatgagaaaccgttgtgaactgtacagaattttgctggcagcttggtgtatatgaaagatgggtttttttcttatctgtagatgaacaatccaatgcccaatgatttatctatccagcagacaggttccatattttagctacttatcctcgtttgttcctgatctatcgatgtttgattgaaatgtcagtcctggtgtaattttaagagattcatgcgctaaattttctgatatgttagaaacaccctgatttgcagaatgctcgtaatttgaaatggttaaagcctgctctcttcttaaaaaaaaaaagcttctagctatgaatctggatagagttttttttttaaaaattttttttgggaaggagggtgcccatgcaacatggttgctatagtctttcttcaccaatcacatggaactagcaatgagtacatccgacgttgataattgtcattgataccatttcgaatttatgatcatagtcaactgattacttcaaaaacgaatttatgatcagtcaactactataaaaaaaatgatctgctggagttccaatcagtgtcttaggataataatgtaattttaagtagctgtacacttgatctatcatatgagagcatataaggaagaagactcaaaggagcttcactgttggtaatgttgacaacagacaacttggcatccgcagctgctttgtcaaaacagttgaatgtctcggcattccgaataactgtggctatgtaggcgacaggaacttctgtcgcagcgctactgaactcgctgctggtttcttctttgtttgcgacattattagttcctcgattattcccccttctcaatagcatagaaagcactctaataaggtgcggcacacagaccggatcatatattatatctgcaccaaggctgtcaaaagatatcaaattagtgtttatcgaaacgaaaaagaaacatatgaagggactgatgtaatctggatcatgtgtcagcaggggtgtatcctgtcatcagcttgcaaaggctatttgtatttgttcaaccagatcagttcagtttaatgggcatgaactcaacgacactatgctcaaaaggttttactctctattttccaagtcgcaatagctcgataaattgataattgattcaaacaagtgtttcatggctcccacagtcacatgtccagtgtcagatggataatggtaatggaaaaactaagtgtaaactgctacaataatacaaaaaattattgcccaaggaaatactgtactcacactaagtctggcctgcagtcccatagatcgctttcagatgtttcttcccatgaaagatatttgcattgtacctgcatgccagaatatagtacaatcatattttatccagtagtgcatttgatctaacctcaaaaggacaggtatctgattcaaggtggtgtctggtggttaaagtgcaacaagagtacaagactacaagagagactaattaagctacaacatttactggaaagcacacaactattttttctcaaatgaaatcatactgaaaaatatacacaatgtataatcttgaaagtatattctttatataagaagatagcataccttattcttgttctcttccggaagttgagaaccttcctgctcaacgcataagttattcatttccatgttgcctttcatgttttctagtgtagatgcatcaccatcagtaagaataacctgcatcatcgtataaacactgtgtcacctgtctttcctgttgaactaatctctaacctttgaagaagtttatgagcttagttaggagtaaatatagctcatagcataaccatcactagtcgctacagtcagtcaaacttaaagagttgactatatgtctgcattttcatttctcagttaagtcgtcttgacaaactatacaaggcttactttttcacagatatccatttacttgaatggagagtggcattataaactttcataccttggaggcgctgacatagttcagacatacaccaaccaaaccaacaccagaacctagctgtttatcatggaaacatttagaagggtaagacacactcacatataacttttaaaagtttcggtcatgagattttctgttgatataacaggcaaggaaaaagtatgatgctgatgagacagatgatcatactaaagtcatagcaacagtaactgcatatctatttgctcaagaaaaacatcaaggtaaagcgacacatatagtagaagggctttgcagagagctagcgacagagttcaagctcaattttacacattgtataatcactagaaaaaatgcccgtgcgttgcaacgggtaaaaacgttttttatactatacattatactcccttgattttgaaccaaatgctttcttgttttttggaccgaacgttcattctttccttccttttcagctctagtcctagagcagtccgttgcctctatctgctcgacctatctctcttcggctcagcccacaagtggagctgtagacctagcttgaacagtcctttgcctggcctacctctctttggctcagcccacaagtggagctgtaggcccatgtcgaacagtttcgtgcccgtaccatgacggagccgatcctcccaccaaatccggtaatttggtcgagctcgcatagtaccgtgcccgtacgatgacggagtcgatcctctccgtcaaatgcggccgaatctttctcgatctccaaaattgttgagaaattttgatccactcgatctcatttttcgaatttttatcaaaatcgaagcaatccgcaaaactcggaataaaaaatgacgaactaatgggaaattaaggggaaaatgatgagagagtagtggggaatcggtttttgcaatcaattggatgaggaaacgcatggagaggcaaatcgccatggcggcggcgctaggattcaggccgaaaaaaaaaaaccgccaaaaatagcgcgttggatttcgttgaaaccggaaaaatggtgaaagaaaaaaaaagaagagaaaaacaacgcaaagaaaataaaaggaaaatggacgaaaaaaccgcgaaaaatggtgaaaaaatggcaaaaagaaaataaaaccgaaaaaggggaaaaaaaaaagaaacggacgaaaattttgccgtgccgagcttcttttttgtccgcttttttagtacagataagaatcggtcaggttttttttttgccacgcctttttttttccgcgctggacttttttcgttacaatcgaacttttttatcgcttttatttattaacggacgaaggaaacatcttatactttttaagtagtagtagattagagaaatgtacaatggacttctatatatttgtgttgcaaaacgcatgcctaagcaagatataaccagtatttgctgggggatgatcaggttggctcactttggatctgtccctggttacagtaataatattttacagcagaagatagagtagttgagctgaacatattcctataaatatatatatgctagataaagataacattttccatgtatctaaactaaaacacaaaaaataatcggtatttacctcaaagcaacacttcctagagaaaatttttgggtatgaaagaataaactcagataggaataaacctgatggccaaagagagcacctgtaaaagaaaagtatgcactgacatgaattaagaatttatgcaagtagcttaatatatagataatagtagattatatattcaatgccatcataccctgtatcaccttcgagcatattgatagaacatgataatcgagcaaccaagcttactcgtttattgtcatctacataaaaggtgcatgttacaaactattataatttggaagaattcaaaattaaaaactcacttgtaggagaaataaaagatatttctttatagatcttctcagtcctatttaaggatgaattattctgcacatgttataaaataagttacttttagtacagcatttcaacagttattaactactacttggctatattacgatgtttaaaagacgtactgattttgacgacatgaactggccaaattcctcataaagtccatcaatcacaatatctgacgataactcagcttctgctataatccttttaagaatagttgtaacataactacagttttgatctccccctgcctgtaatgaaaactcaacattttagattaggagttacaggaaaatattgtgcaacaaccagaaaattataaaaatgtcaagtaaaccaaattgtgactcttttgtattatgcatctttctacaacgcacacatcatggtcgtttttttttctgttgatagttttgcgtgagataacaaaagacatttacattattgccagtacaactctccaaaataaaattttgaacgtgtggcgtgacagaacctcccccagcttttctgcacaatcaaatacacacaaatttaaataaacaccaccataaacttatcaaaaaaaagaagagaaaacaaaatagcgctttgccttgtcaagttacaatcacattcatacaactgagaagaggaagattattattttttttaagaaaaacctttgtatgaaatttcctgacacattcatataaggtggaaactgacaagttctctgaactttcctgggtctaaagatctctctgctcattggagctcaatcactagccaagtctcatcacactactgacgcaaacacagcctcctccactactaaatccaaaccaaatctctgtatcggcaacatttttctgaaggcaaccaaccgcataggcttgcctgagattggggactcgatcgatcgatgcagagcagcatacgaattcgagcgcgtggggggcgcgcgtacctggcgagggagaggacgcaggcggggggctcccgggcgaggaaggcgagcttcaggtggaggagcagctcctgctcggcggcggcgggggccatggatttcagatgccgcgcgtggagatgacgagatgagaggaaaagctgctgatttgcagtctgggccttggctttattgcagttttgggaggggacagactgaggccgtgtacgggcaggctttctaaaccgccggggctgggttactgtgccccgacggtaagcacggttaccgtgtggtaaccgcggtaaccgtgaaaatccatacaaaatcgtgtaaaatttatcaaaaattaattattttttaaatttatttgaatttaaggaggttatcgcggtatttatattaccgtaccccgtggtaagcccagtaaccatggtaaccgtgcggttaccggcggtaagtcaaatcctatgtacaagtactttttggaggatataagattgttttagtatcataaaattattactacttgtcaaaataaatctacagatattttttttcgaaataaatctgcagatatggttccttcatgacaccatcctagtataaaatcctaatataagtgcgcacctgtaccggatttgaacagttttactactacatcttctgatattatgtgcacttattcttgtggtagtaggtgcacttatattgagacgatgagagtaacatatattcaaggtaaatatatttaaaaatgtagtattatgcttaagatatttgaaatttggccataaatattttttacagcaataaggcacgttcttttggataaataaaaatgaataaatgcacatgtttcatgagtttctaaatagtttattaaagggataatgatgatggtgagtgatgaattagtcaccagtcactaccctaatcaccactacctttttggaataaagaaatgacatagggtcaaaggactcgcatgtcaaccaccactaccatcatctctacttttgtggaaaagaaaaatgatattgtgagcctatagagaccatatattagttataaatatgtagaatttaagagatgatgtatacagaaaataatgataatagcaggttaatgatcattttcatcaattaaaattccattacaatgcacgggcaatatgctagtatatacaaacatatataacaatataagaaacggtaggtcatgttcttttctaatcaagatgtagattttacctcagtttcattaacggtttttcaaactgctacacagtgtatttgtgcgaaatttttttagtataaaagttgctttaaaatatcaaataaatatatttttcaagtttgaaataattaaaactgctaatggttttctcgttttacgtaccctacttgatcttcatctttgtcaaattcaaacgggcataatttctgcctctctagctagttaagtattaccacctccatcctaaaagataagaagttttaaggatagacacataagttaaaaaagttggtgaaattaaatagaagaagattgcaattgattaaaaagagaaggtagatgggaaatcggaatggtaaaagtttatgattaattgcgaagagaacgtagatagaaaaattgttatattttgaaataaattttgaaggctttgttatatcttgggacgaatggagaactcctttcgtttgacatatattaattcagatatgaaaagacgaatattttctttattaagacgatctattcgatatttctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58209 - DNA, 18886 bp, Oryza sativa
tgcgttacggtaactgttcgacatccgctgctgagcaacaatatgagcagcgaagggttgttcggaacccagcaattgctccaaacagcagtgttcctctggggagctcataccccagaagaaaccagacctgcaagagtgaaacaggtgatgttgaaaggatcgattccagccaaaccggtccactgaagccatatgtggcgaacaaactgcctgctaccgtcgatggtcggagtggccactggtaaatttctgcagcgcaccagcgaaaacgctagttattaccacagcatcagcatgggtttattgttctatgtagtaaattcttagacatttaaaacatgtcattctgtacagacttgtattgtttcttgggggcttttccatgataaaaacagtagaattgtactgcaagccctagtggattaggctgcctgtttcttcatttcttcatagctcaacctctgaatgatctggtacacaaacaagatctcatggaattggacatcacatgattcagttcgaagggggtatagtggaaactggaagcaacaagtggactgtaacattttcttgctgagaaaacaagggactctttactgacctgactgatgctgctattcaatttattttccaagtaaatccgaagaaggatcatgtaaacagcacaatgttggacattgctttagtatttcgttctcaggaacattgttccctttgcagagctaggagctgcaactatgtactactatctgacattgctgtaacttgtaaaacttaattgcatttcaagtattttccctcctttagcctgtaattcagctctagtatttgaactactatgtttcaaattactttggtgttcaagctttgttctaagtcaaaaatttatatctttgacaattaatttctataaagagtgaagtgcacgagcggtcctcaaacttgtgcgggtgtgtcatctagatccctaaactctcaaaatgtatttttgggtccttaaacttgttttggtgtcatataggtctaaacgggtgtgtcatttaggtccctaaactctcaaaatgtatttttgggtccttaaactttttttgggtgttatataggtccaaacgagctccaaccccttcatgcgctgacgtggcatgccacgatagtgtatacgtgttagttggactcacgtgctagtcacatagaataaaatataattagaaaaacatattttctcctctctaccttataatttttatcttttttctgtctacctaagaggagaaaatatggtttttaattttaatttttatatatgtttgacatgtggattccactgacacgtagacgtcaccgtggcattgccacgtcagcgcatggaacgggttagaactcgtttggacctatatgacatacatagcaagggacctaaaaatgcattttaggagttcagggacctaatgacacaccaggcccatctactatactcttctataaattcatacagtttaacatcactagttttatgtttctaggaccattatatggttaaaatagtactatctctattctaaaatataatcatttatagttatgaatttagacaaacaactgactaagtttatagttgaaaattattacattttgaaacgagcagtacagtactatgtttgcagtgcaattacctgccctgaaccattggcgttggcgttggcgttggcgttgaccctagctagcctcgcactatcattcaacctagccaagctggtgctgatcctctattgcattctctggtgttctggtgttcgttatttgtacttgctttgtcacattaaagactcgactgctcgcttttcaatgcataaaatataattttttttctatttcaaagaataaggcataatcacatttttacctaaagacaaaaaaataataattattattaccttattgtttgaatcatcctaatacaataaaattagagatcttgagaatgaataggttaaaatttaatagtagacgctagttaattacatgcatgcacgcatgccttatattatgaaacatcttaaaaaaaaattatgccttatattttgaaatggttgaagtacaagtatagcattagtacgtactccatttgtcccaaaatggctaacctaatatcggacgagatattttctagtacaatgaatttagatatgagtatgttcaaattagttgtattaggaaaggctccatctaatactagtttgatttttttttatggagggagtaggtaggtgcagcaagacatactgaaggaataaacctattgattttgtggactaaaggtatatataaaaaaatacataaattagcttatttagagataaaatttaaactctaaaaattagtttattttgggacggaaagattatgtacctagagataaaattgtttgttttactttctatcaagtgaaacaaaacaattcatttctacatttagtttttataatctacctgcttaaacatagtacttcttccatttaaatgtctaagacttgtttttcatcaagatagaggaagaattaacttatccactatgtgacaaaagaaaggaatcatatacatgcatgcaaccaattaatattaaaatggtttattggattccaatcaataatttaatttagcataagcatactacaaaggatgggagttcgattactaatgacggttgtactcatcctattgggagaagcaaagtcgtccataattttagacaaatctaaagaccaaaatcctctataattatggacagagggagtatgtttatctaccgagaccaaggataatttgtctaaatcacatcaaccaagacaccatgtacacattctctcacagtgcatgcataaattaaaacaccataccaattactccctccattccataataatcagcacataacgaaagtggagatattccgatttgatcagcatattatcgctggtagcatgtgcatgttggatggattaactagttatcacggagatcgagtaggccatgcgattttcgagctgcatgcagcatggaacattccttgcctgtgcaatcatgcagcggcagtaacgtcgtttcgtttctccaagccgattaatatggagattaattacaaggattaaatagaaaacgggtagaggatctctccttggtcttgatgccacaatgaaatatgctgatcattatggaatggagggagtataccttagcatgcacacattcacacattctcccatgctgtactaattgtattatgataaaatccatatctatgcggttatatgatgatcaatttaagaaattttaaatttattatatgatgattaatttgggaatgagggagtaacgtggcagctcaaaagtcacatcgaaaactgaaggcgccgttcaaaattccgcattaattcattcaaaccggcctctggtgctcgataaccaatagtacgatttggtttgaattcaatgcatttactgaaaaattcaatccattaatcgcctcggagataccaaggggtgttcgtgcgctgtgtacgtgagtagtatataggagtagataggtgtgttgcaaggtgttcgtccgcgtcgtgcaggagggagatggaggggctcgccaagatcggtccatggggcggcgacggcggcgacccgcaggacatcgccctcggcgccggcgcggcgccgcaccgcctggtgagcatcgaggtcaggagcggcggcgccatcgacgcgctgtccttcacctacgctgccatcgacggcgcgaagcacgccgccgggccgtggggcggctccggcggggagaagcacaaggtgaagctcggcgaggcggagcgcgtcacggaggtctccgggacgctcgggccgtggggcccccacgcgtgcgtcgtcaggtcgctggcgttcgtcaccagcgccgggaagacgcacgggccgttcggcgaggaggtcggcggcgcggcgttccgcgtgccggtgaagggcggcggccgcgtcgtcggcttcttcgcgcggtctgggtggctgctcgacgccgtcggcgtctacgtgcacccgtgacgtgacgacgcagatgatttacttgttgttgcatgcgttctctcttctgtcagtcttctagttttatctgaatattgttgaggactatttccttggctcctgttgcagaactcgtctgatcaacagaaatttcctcagaaatttaagctgcctttccccgcttcaccacgacgctagtacattttttcagaacgttccatctagctctctagtttttttaagctgaaccgtttggttgagctttaggtagatctgagagttgaagttctactaaacatatcctcacctgttaattatgatttaagataaacttttatattgttgttcaatgtcagtgaccctatgtccctatggtacgaatttttgttgttacttaggaggtgaaattgtttttttttccttgtatgccaaattgccaactacatagttattattttcttaaaaaaaataaaatagatttatataaaatatataactccacagacataaatttaaattcgatttctataattcgtaacaaaaatgacaaatttaactgtaaacctactttaacaaatatgacaagtgaggtgcaaattctacaaggaaaagatatcaatcatgggtggttaatagccagaagggtggacgcagcggcagcgggtatcctttgtgtctgaaaggccgaagcacttcttcagtccctttctccaagtcgatgacatgaacaaaattctcctcagcggcaatattgttcacaaaattgatgcaattcccggacaaaccatggtcactagccgagcacgacgctccaaaattagaagctccgatgaaatctccaccgagaagaaacacactgtcaccgatcccgtccaccttgcaccactctgatggccccgagaaatccatcttgtacaccgccacctccgcgatcctgtgcaggttgtggccgaggaagaagacgaccacaagaaacagctcgccgcatgactgtcgagaagtttggcatactggcaggcaattcaaccatgtcgacatccatggtagagagttttacctccaggctgaactcgattactccgagagcgtctcctgagaatgtgtagtacaccttgccggcaacagcatcgatgccctgaagcttggccatgtgaacctccagggtcttgttgttcttgctgaccatggagagctcgtagctgaaagaatcccattcactgcctccgatcttgcagactagcatcgctggggtgtcaagatctagtaccaacacggcgcaatctgacgacgacgagattgggttgccggagaggaggcacttgccgcttctagggaagttctgtttcgccgttgggagatcgatcttcttgctgtcctgaggtcgccataggaaggtttgcagtgacgcaggattcagagtgagtacccagccttgtggagtctcgaagcacctgaaatctctcagtagctcgatggctgcagtgctgagtgcttggttgcagatgctgaattgcgtctgcgagtcatcgctacgggttccaagatcatggacgagcaatggcaacggcaatggcagagctcccgatgatgatgcagcttccatctcttctgcttctgaactgcacaagtctgaatttcttttctttttttttttttttgcggggacgcaagtctgaatttctgaaatcagcgctgaccaaacgagagcaaccgaccgacgattccctctagcttgggtgatccttataaagggtgagggattcttcttgtagatcgaatcggagactgaaacctccccagtgctgaaaattcagaatcgaatcggagatgaacaccttgtcagtgccggaattggactcacgatcaagaaactgccgctggttcagtgacacaatgagacagatgctagtgagcagctggttcagtgattgagctgctgctgcacaccacggaggattgcagcacatcgacgaggtgccggtgcctgacgatcttgggcggcttgtactggttcgccggagcgccgccgcggatcgcggcctcggcgagcctgtcgaacgtgccgggcctcaccacggcgacctccagcggcgcgacgtcgccggtggctctgctcagcctgtacgctccgccgaggcagccctcgagcggcgcggtgcatcgcctgaggaaggcggctgacctctcatggtcgagcagcttgcttccattgctcacctcgacggcgatcgtcgcgcatcgccgccgccgctggcctccgtcgccgtcaatgatgaacgccgcaaattcgataacctcgccgccgtcctttagcatgagctggaaggtgtccatggcggccatgacgtccctctcggtgagcacctcgccgtgttcttgcggcggcggcgcgcgggtcacgaactgaagccgaggggaggagtggtggaagccggcgatcttcacgacgtcgccgactttgtaccggtacagcccacggaacgtggtggccaccaactcgtacgtcttgccggcctccacgccggcgatgtccaccggctctgccgcggcggcgccgcggccggcggcgtccatgtcgaacgggatgaactcgaagtatgccgccctggggaggagcacgtaggtggtttcctcaggcggcgacgtgcgctccaggttgatgccgatggcgcactcggaggcgaggtagtccgttccgagcaccggcaacgcctcgccggcgaagtgcttgatcgccgggaagtactgctccatggtccccgtcgtgacgcaggagatgtacctcgcgtccggccacagttggcgcagcacgccgcgccagtcatccctctcgcagattcggcggacgcggccggcgagctcggggcatggcccggcgagcactccgtcctggacggcgcctctcatcgccgcgtcggtgacgacgtcggcgcagactgtcccgcactcgaggtcatcgcagagttgacgccacttggactggaggaggcggagggcgcgcgccagggcggcggcgtacggcgcgcggatgcagtcgacggcgtcccatcggcggaggccgcagaggaggtggcagtacatctgctgctggtggtcggcgccgaggatgacctcggcggggctgacgcaggcggacatcaccggcgaggctccccggatgccgctgctccggatgccccacgccgtcgccgccatggcctcgtatccacccttcgtcttcctgacctcgccggcgtacaagaaccacagcgccttgctcaccgccggccgtggagggaacagcctgaaagaatcagatcagatcagagccctgatcagtgtgaaacatggtgaaggctgaggaggtcggcgtcgaacaccttctgacgagggcggagttggcctgcatcacggcggcggtggcggccctcgcccccggcgaatccaagtagggtatcagcttcggccgcagcgagctcgtcccagagctgcacgtcgatcggatcagccatggattggtggagaaattctgatggaagtgaagagtggaaaggaggagaggtggatcacctgaggaagaagcagaggagggggcgcggcgagagctcgtcgggggcagcgtcgccatccgcgacgcggcggatggactcggcgtagtcgtcgtaggaggtgacggggacgaggaggcggaattcgtcggccgccgcggcgaggtcggtggagcggaggaggtggtgggcgccgccgtcggaggggatgtaccggcggaggtaggcggcgccggcattctcggcgaggatggcgcggagggtctcgagctgaagcctccgggcgtcgcgggtggcgtcgtccagccgccgcagcgcgagctcgtcggcggcggcggtcgccattggcgggcggctgggttggtcaacccggaggtggtgcagctcgaaattagctggttttgtaaaaactagtggagtggtgcatattaggtggcttgcgaagttataaatttttctcacatagcttccccagacagaataatatatgagggctgctaccccacgggattccgttactcttgttagtcacgggacaactaaaatcctgagagatttaatatgcatcgtcaatttcgtggggagacccacgctatcatgtgattccaccttatccaatcctccctggtaccttgggtaaggtatcgaggtggtatctaatacactggtattagctggtaccctggtatcgactgatacctagtaccttgggtatcgagctgatacctaggtatcaggccttggtacctgggtattgactgatacctggtaccctggatatcgagctgatacctaggtatcagggcttggtacctgggtatcaggccttgataccttggtatcgactgatacctggtaccctgggtatcgagctggtacctaggtatcatgccttggtacctgggtatcagcgtgatatcccaagagagaggaggaggaggaggaggagtcgcgggtcggggaggtcgagcagcggggcggcggcggaggaagaggaagaggaagaggaggcgatagatctggtgcctaccttgtgccattccgtcgctcgtcgtcgtgcctcgctccaaaccgccgaaatcgtggctccatcgacgccgcctagagcagctcctcgtcgctcatgttgtgcaagcgctcgcccccggtggccgcgtccaccgctccccgaccgtaggaggcgctagcaccgccaaggaagaggagggcggcaacggcgaggaagccagcgacaagaacgacgaagaggaggagcggcttgaggagattgatggggaggcttctcgacgacagccgtcgcccgtggtggtcgggagccccgccggctgtcgtccaggtcatccgcgggggctagtggtgacggcaccgccgccatcgtcgtcgttgttgccgccatcaccgtcgttgctgtcgccatcgtcgccgtcgccgcctccgtgctcatgggtgatagtcacagagagatcgagtggaggggaagagagagagagagagcgagtggaggggaagagacacagagagaggggaagaggagataaggcagtactactattccgtctccacgggatgccattaggtagtttttctgataatatatattgtgttcttttcttctaaagatgaagattaagtttttttacataaaatgagatggtattagcgtatgattgattgattttttaagtattacaaacttaaaaaatagattaatatgatattttagagcaactttcatatagaaagttttcgcacaaaacacaccatttagcagtttgaaaagcgtgccacgaaaattttaatcttcatccaactcttattggagaaaagaacaggaccactgatgaaaaaaatagattaaagtatacagacggtatttaaaaactagtgtggatgtgtcatgtaattctgtaaactccaaaaatgtatttttttttcttcaaacttgtcattggtgtcatataggttcaaataggctctaattcccttcatccgctgatgtgacatggtatgatggcacatgcattgcagtgggacccacatgtcagtcacattgcaaaaaagaattaaaaacatatttttgcatggtcatatagagatagagaagaaaagatgggaaaaatatatagtgcaaaccacatatgcagtgaaaacttataaactaccgatggatcgaaaaatggacgtctgagattcattcacatcaccatgagtaaaaatgctactcatggtgatgtgaatgaatctcaaacgtccttttttgattcaatggtagttcagcgtcctcagcggggtggtaactggcgcacgccggcctgtcagcggctgtggcggcgctcagcgttcctcggagttgaaagcctcggcgggggaggtcgatgttcttacacaccggtgcggtgccacagcgcgccgagtttgcggctattgtttcttgaagacgtcggcggcgtgtggcgcccgcaggccacaatggggtgggttgctgttggcgttcctcggagtctatgacctcagcagctaaccgtactgatgtcgcgaccgacattcttgcacatcggcgcggtgccacgatgcgccgaggttgctttttcttgaggacggcggcgtcggctcttggctgtccacgcggctcgactcccaaggttggcgcaggcgacggcatggcgtggcgtggcgagctgacgtggcctgcagatggcaacctcacgggatgtcggcgatgtctcgtcgaaggggatgacttgagttttctgagttagcgatggcgaaccatttcagatgtagatcatctatcctcaccatgcctttgttattgacacgtgggtctagatctatctggctcacatgtcagtgataaagtcacgtgacttaaaaaggtagaggattctgatccacaatttcttgatctgcgagaagaattaaatagccaacccgagccgcttttgccgtacgaatcaaaccgcccagtagctgaaccggcctcatgatttttcatcaggtttaaaggctaagtatctgggtatttttagaggtagtgatcactagttcttgtttctggtttctgtagacaggtattttgaaaggccaaaaaagacagaattgccaaatcatttgctattcaacgaaaactatccaattagtatgtactacttcccccgtttcataatgtaagactttttagcattgtccacatgtctagattcattaacatctatatgaatataggcaatgctagaaagtcttatattatgaaacggagagagtaccattttacgatattgttttatagctaaattaggctctaccttttgcttgttagcttatcagttgaaatcggaatttgaattttaaaactcaattttaaactaggttttaaggcttttatcattgataaattttcgtcattggctttcaagtagttaagaatgattttttttttatttttctaccatttatgaaggtttatcaatcatagagcaaatcatcgctcttgaatctttttggtgtcaagcattgatgtggaagattgaaattggaaaactctttttaatcttttgagagaggatttcaggtattttaaatcctatttctacttggacttatttttttcccttttcttcaattaatgtttggatctctaaacgatgagagcgaaagagatgtctcctttttctgtcactttatttctaccaataaaagaataaagccataaatacaaacacccatattaagtatatagcttgaacaaaaatgaacatgcttcatccagtaacctaaccagttgaactattgttactttacctagatgccccattgggaatgataggaatttcataaggcctaaaagagtaatttgaacacgagcctcttatggctcctttggaaagtacgatttctataaaacacaagaacaaataaaacgtaggaataaaatcttatacgctccaaaatataggaatttaagagtttgtgtgtggatggcttgtagaaaacaaaacatatgaattttagaagaaattgttttgtgggagagagatgctagagaaagaaaggaagagaatgcatacgacttctcgaaggaaaacgaaaacgtgaggtatgagctcatgcttagactgttatggaattgagccataggaagcaaatctccataggatttttgccagtgatattgctttgttccaaaagagctcataggaaaattgtctgagaattgaaattccttcaatccaatggagtgtgccctgcatttccactcttaaaaacagagctcgtagtaccatttccatttgtgctctattatcttcactaccccaatcaataagccctacattacagaagagccaaagctcggcggtcagaggagcttttcgttcgtgtcaaacaaatcccataaaagaagaggtaagcctatttgtcttgagtcttgacagcgtctcatcgcagctgcttgtctacattttacagtgggagttcttccccgtcgacttatcagttatcacccttgattctcatgtgcgtcacgtatatgaaacataagctgcaaaagtttaccagctgtgagacaaggaatcacctttattttgtagcgtcaaaaagaaagtaattagcaaaggaatcaccttaactcccacatagaatgagataaatatgaaggcaaggacaggaagggctgcaaaatagacacaggcgtcagctgaagaggccgtatgactgaatgaaattcactatgaaataatggatgtgaattcgcaactcaccatccttcccaagcattcgtgacatgagaagtttaatgccggagggtcctacaacataaccgacaaggtttgccacctgcatgagtggagcatatcagtatcaatgcggaacaaggatgtgacccatctagtgtaagactgaaaatcctagatttaatgatatatgaattactctaaaagaatctttgttgacaacaaatgctgttgcatgcatactttttcctaggagatttggtgccaggaatctttaattgtagtaaaccagtagcgaagtaagagaataatcggttgaatacatttaaatatgaattcaaatacccccccaaaaaaaagacgtaccataaggcagcttattgtcacagcaccagcaattgcacttaactcccggtgaatgaacaacccaagggcacttcttggctacatttttaaatacattagctactaatcatatgaaatttccatcgacatcaaacaagcatgatgaagaatccatcaatgcatgagaaaacaaaaacttattagtttggagtatatatggttgccatgctgttgttcttgtttgtaccttaaattagaagtatctagtattcctttccaaactcaagctgtacagactggtttatttttccaaacaaagggagtaacttaacatggtagtaaaacaactttaccatctcacaaatttccatacaaaaaatacttaagtttgtttcttgcaactaagcaaatgaatgcaacaacagaaaaagaaatgctgctttatcctttaggttatgaagtcttatcaaatcacacaagggaactttacctggaacttgttggatagagacttgaccaatatttcagggacgaaaaataagcatgttaaccatgcccatgaaataagtttcctgtttatgagaatgcaatcaaattgacatcgtaagtcatcataaaacctagctgttgccaaacaaaaataacaattataaattttacagaacttaccattccaggtcatgccaaactgctacaaacgtgaataccacccagatactaagtagttttctttgagcacccccaagaggaatgtacagatacctgcaacaagaaagacatatgtcaaagaaagttaaacttaattttatcgactattaatacttatggattgactacagatgcacattggtatgcacacataccaactctgtgtaagcatgggttatgtaataatgttgataggcctaaactctgtctaagcggacatatgacagttttttgcatgcgtttcttgagcatatgttaaagaagtgaggctatgaacagaataaagttttaaccccaaaacttcaaaatgaaatatatgcatggtagcacagatgaattcataaattagtacttaaagcagctactttaacacaaacctgaccaaccatctgttaaaagaagcatgccagcttttccagaaactctccagatcatgacaattatttatacaccttggcatattttcaggcgtctcaactcctcctacctgcaatgaaacactcagcataaaacacaaaaaacattacataaaacagtgcggatatgagaacacagttgttttattgacaatgttcccttgtatcaaaaggtaaagcatgcagggtgcatgatgaatcaatattgattttaaatgttcaaattaccagtgaccaaaacctgaagtagcgccaaatcaggaagaatttcaaccacataaagttcagcacctgcataagaaagttttgatagtcaatgcttattgatgattattaaccccaacaacaaggtataccaagttgaaaaaagaagctacagtatgttagttaagaatagcaacaggaccgtggatatggtaagcatgcaagttaacgcattaaagtagaaaacaacctaggcagacaactttggaaacaaatatacagtattgcaagtcaggacacgtattcatacaggagatcacgaaaacttgtattcaatcttgaataaaaacataataagtaataaaatggtaatatcaactgctacatattgttgaaaatgatgcaagaaaaattccataactgacaactctgaaggaaaaaccggagtatatactagaaaatgcagtatgtacaacataatcttaccccataactaatgatgaagatctcaaatggcgataattgctgccataatcggctgtcaaaagaataattaatcagaatatagtaaaaaaagaatggattgattatactatataaagataagcatgtacctaactacaaaggcgttgtagtggaaaaaatgtgtcatagcttccataagaaggaaacttaggatccacctcaccccataccaagatatttgtgcaactgaataatttttctggggtgcatctaactgcaagatcgctacaacaagaacaggttagtatttgtcaagatatttctacactatatccaactaataaaacttactaccttatatagttcctaaagtcacccaatggtcagtaccatttaagatcgtttataacaagctcaaagatatttttgcaaaacaaaaaaggaagaaacaaaggcattactcatttatagacagggaaagcaaattcataatagctagtgcccttttactgttcactacacataaattgctaatatcttttatattattacctttcagagctgaaattcgttgttaacaactatggcagataatagattaacctgttaaggaccattcagaaattccttttaatgacttccaaatatattaaagaaggatgtaaatgttgtgtctatttttgtagattagactaagatggcagtggcaaagggccctgatctaattagacgttaaaaatagattagtgcctgatgtagggaaaggctggtccctcaaccacatcaacttagagacaagttgttataatcactcgctatcctagttaaaaaattgtttggaaatacaccagttcatttctagtcaagatttgtttacagaacctcacagtgcataaaggatgtcacttgtcaattaatgagtataagaagggaaagaaagaaattagctcaaagttaagtctacacctaagccaaggtcagagtttggatcaggatcaagtcccccacgctaacccttcgcatgaaataaatccctaagtcacggcaatgcattgtacataaaattgacaggcgcacaggtcaaaaatgcattaatatatgatgtcattgtcacatgttcagcttttatgaaagtattgttttagctctactatagccaaagaatcatgtcaaatttgatatcatcttcatttcataaagcacgacctgtaaatgaaaaatagagagaaacattcatgaaagcaatatttgtttctgttcaattttgacatcttttaatttaaatggtagttctctccccttcttcctttcattttcttaaaattaatatttatttctgctgcttttagcttgaagttcatctaaccgattcagctgcattgaatcattatctataagaaacagaccaacctgggctgcaaatgcattgtagcttacaataggtccagcgatgtagagtggagcatatgtcaagtagcataaatatgttagtaatgtgtatttgtcaccaatgagcgctctctcctgccaagaacaatgcaaaattctatcaacaaatataagagtgaatatagtatgctttgtaaaggaaggtcttgtaggatacaagagtcactatcaaagctgcaaatttcaaatgataataccataaacaaaggtaaataagatacactaatgtcaagactcaagacctacattacaagtaactcagaaaatatttatattgcaactaacaactcagaacagttcaacctggtatcagcagaaatgttaaccattcatttacgcttagtaattatcaacatctttcaacaaaaccactagtttcattctgtgctgtgtcaacacttattttgctggaaactaaagggataccgtcgtaatgcttccaaaatggtaaaaccaacaatggctgtaagacactaccatgaatcagtaccacattagagcagcactatcaacaacagtatttttattgggacaagggaagtatgaaaatataagtacctgcaaagcaaagtagcatgttttgccagaataacaaacttggcatcgctgcatatgcttctgtaccaaggcaactcatttcagtacagtgcagtactgacaagacagaggtatggtcaaaaataaatttactaatttacaggtacagatctctacaagagttgttcataaacttatcagtttcccatgaggtacacaacatatatcagatataactttataatttatccaataacatttaaaacaagacaagtagacatattgttttgaaaatgtaccaagatgaataagaaaacacaagatcagatttgttaagagtgtcagatcttatggaccaacagggatgtaatgtgtgcttttaaaactatgtttctgtgatttaaagcatctgatgttccaataatgaagtacagataatgtggtacaaaaagacaagtcatcaggaaatataataccttatgatcaaactgagaagaccggagtgaccagcagtaatcgcatccaaagcttatcattcgtaatacaactgccagacaaatcaaatggggcataaggagaacacgtttatagatttctacatagtaaacatcaaaagctattcgtataaacatgatttcaaccaaatcaagatgacaaaaggagaactataccaaaattgaagcaaatgtgccaccgaaatgtaccccgatgattgtctagaaaagcaagctgttgcctatttcgataagaaaatcaaacgtcacaaaaattaaaaagaaaaggaacctcactgaaaggaattgcatcatacagatagagcagcttcagaacagctcacccaaacaatgagaatgaatagccttcatagactcggttaagtataaggacagctaagttgaagctccaaatgagcccaacacaatatttatatcgagaaaatagctgcaagagagaatactatggtcaaaagcaaaacttaaacccataatcaattagaacagagaaaatcgaacagtgatgtcaacactacagtcggaatgattgcttacaactaaggtaccacttacaggttgacaataatcacataataaacagcatgttaacttgaattccttaactgaggacaccattttcaaccaacctgactagatgtttaaccactcagtccaacaatattgtaatagttgtgttgaccagttctagttgatgaatgaaacatttggaatcaatacataaaccgaaaattcatcccaaatgaattttaccaacatagagtcttagttttcccttgaataatgacttaaaaaatccattgatctggcattcctgttatcacagtgtctcttctttagttgatgtgtactatgtttcttatcttttatgtgcttgatatcatatgcacctgtggagtagtcttcagttttctatatcacgttgagaaagttgcatccgttaaacatacacatacattgtgcacatccacaaacatatgctcgattgacaaatatgctacctctaatacctataacaagaatatgaacaaaaaagcattctgttttgctccatgtacttttgtttgtggcattgcctatctatatatttatgcaaaaaaaaaaggaaaacagaaaaacaacgactaagacaactgaaatcaacagtagttttgatcaaagatgctagcactgaccttcactatggagtagttaatcaatgctattaggagaatgaaactaacactgccatagagatagatatgtcagaaactttacaaatattggagaagaacaagcgaaaagcattggtcagtttcctaccaagcaccatgtagatagcataaataggtgacagacaggagaagccacaccaaagaggcccctcttcccttcaagctgtagcagtagcgaagcatattcgccaacatcagaaatgcacccatcacaatggtaagaacaggtaagttcccccggaaatttctccattgtgcatcggacaagtcctgcaacgacagaatgcaaggaaatcagatgcgtagctcctcaatcttcagataaaactagaacactgataaaggaatgggaggaatttaacacacgttcagatggccagcgagtgagcctgctcgtaggccgtacaacctcccagagtaatctgcacaaaccaagcgataatgtgatgcgaagcagttccaaaattaacagcaatggaagattttggaatctgagacgattggataccatgagagaggcgaagcgacttccggatcacgacgaggtagaaccccagcgcgtaggcgcagagcgcggcgagctccagccgcctccacgacatgctgagaattgagtttggcaagtgaagatctctcccaacggcggggaggctcaccgctcgcgtctccgcccctgataccaatgatgagggagcgtgatccgcccggcgag

SEQ ID NO: 58210 - DNA, 3145 bp, Oryza sativa
ggcccggcccgtcaacgaaggcccatgggctttccgtggcatcaggtctcacgccacgtggcaagttatcactcgctcgcgcttcaggcacgtgtccatcaccttctccccacttgctgggacgcacacgtggcctctcctaccaccgtatgtcagtcaactggccccacccgtcagtggctcatcagtagatatggataaatcgcattttacataaacacccccacatcaaacggtatttgctaacaacacctcttctccatcctcttctgtcttctccatttccatttccttccaagaagaggttgcagcggcgcgcacccaaaccctctcggcatccagggaaaaccaaggtgcgaaatttttttttgtgggtttttttggctgcttccatttcgcaatccactgatggagtacgttgctagcagtcgttgcaatttctcagtaattttaccgatttactatttatgcaagcttacactggtgaatttttttcagggtaaattaggcctgcgtgattcaagaaccgcacctaaagtttgtatttttccaatggattctatgggggtttatgttgttttttcgtaaagatgatctgatccgtcatccgtgaatattttgttgtctgaacgagttatcctattagtaaacaaggaagttcctgtgttcttgatagagattttgactgatgattaggtagtagtgagctagtgatattcattccaaaggagcagtagaagtaatagcatcagcaagaatgcgagggagacggcggagagctcgggaagctgaccctgtgcctgagccattcaccattgacgatgaggtctcccatctcaccaggattagatcagagccaagtcaaaagactcttggtgctttttacgccggtcgcaagaggggcatctcaacgttcgggctgttgtccgggagggagtctggccgttcgggtgctggtggattctctagagccgattgcgcttacgctgcccggaaacacctgccaacaaaaggaccatggtgtgtggatgacatgactagtgaggcgtatgtgtcgcagttctctagtgatggttcactgcttgttgctgggtttcgggtaggtgattttgctgctgcagagaataatctaccttgatatgttttcttgtggttctattagtgaaagttgtgcatacagaagtttcagagctaattggtaatgtttctctccacaaaattttgatgataagggaagccgcatcagaatttacgatgccgataacgggtggaaggttcataaggatataagctgccgaagcctgcagtggacggtttcagatattgctctatcacctgatcagcaattacttgtaagtctgtctatgatgcatctaataaacaggactcgatctaagaccttagccctgttgtttggatgaaggaaaatatataggaactgatttgtaattgttacggggaatgataaccatagtggtaacatttatccaatctgaaaaactacttgctatctccatgtagatgctatatagaaaatagaagacatgttgaaaaactattttttctcttttgcatgctgatattggtgaagttcactttttttatgatttgttatttagtttaccattttaaaattcaatgatatatcaattgacaaacaatagccgttgttttatgaataaaattatctccgtggtgaacggtctgttttgcatcgaactgggtgctgacattaatcatttagcactctggatgtttcattttcatgtgtgtgcttgttttccctcaagtctatttgatcctttcacaggcatattccagtttgtcgcctactgttcacatagtgaatgtgcagagttctgcaaaggaatcacaagctaatgttactgtatgttctatactccgaagctttccctatattatactagcttttgaaagcatgagctgcctagctttgttgaattcataaaatgctagtaatgttcttgtaaccagccatgtttcaattgttcgttttctgcaggaaattcatgatggtttggagttttctaatgatgacgatgatgaatattcttttggaatattttctgtgaagttttcaaaggatggtcaagaaattgttgttggcaatagtgatagatctataaatgtttatgatcttagagcaaataaagtgtctgttcgcatccgtgctcatgcggtataaattagctgatttgccatatgctttttggttcaatcagttgtatgactggtttttgccttgttcattccatttcatgacctagctatctcatttataccaatcttctagttttttattttacgcaattgtataacacatttatttgctatcttattttcttctcaattggttctgtaaggctgatgtcaatgcagtcaccttcgctgatgaaagtggtaatctattgtactctggaagtgatgataatctctgtaaggttagtgttcttgttaattgttggaataatgccttcttaatcttgcttcaatatgaaaacgtactctatcaattggaaagaagaactatcacaaactatgtgtataatgagcataacaagagttgaataggtgatggtgaagggtagggtttacggtttggaaatggaataatacagctcctagcatctagatgctagaatgcatttgtgaaggaacagtagtaaatccaataaatagactcttaaaacatccaatcttgtagtcagtgcttgtcctaacaatattttatgatccttaggtgtgggataggcggtgccttgctagagaaaaaccagcaggtgttttgacaggacatttagatgggattacatttattgatagccgtggtgatggacgttatttcatatccaactgcaaggaccaaacgatcaaactttgggatgtgaggaaaatgtccgcttctattaaagggtatagtttttgctctacggccattcattactttcacttctttttcttgcgaggaattacatttacaatgttgatccccatatttattatatatatttctaagactctctatcgcctgttcttgcagccgtcaaccgagattttttgactgggattacagatggatgtcattcccgttggaagctcgacactgtaagcatccaaacgatca

SEQ ID NO: 58211 - DNA, 964 bp, Oryza sativa
tctgtgctcacggaaaacgaacagaggacgagtccttaccgtcagtcgtacacacggcaccttctgctgtagggaagagaagtcattttggtttcctgtaaggagttgtgatgttgctacatctgtaatcgcctgattgcaatgctcattgcaacagtgtataggactgggtgctgccaaactgcattttctgttgtagagaggccattggtcgcctgcaaagagttatatttgtgctctcctgattgcaacagtgtatatagggtgaaaacagtcgaaaacggtagcgtttctttgggcacaattctcagtcagtcaggaattgactatacttatcaatttaactattcagcgacaatatgatgttgaaaaaaaatagaaaacctaaattttataagttgctaaaaatggtaactgtccaaaacggtaacacttgtacggttggcagcattagcatttggtgcagtacaaattggcttgtagagctttgcaactgaggcatgtttagggaagcttctagcaatgcttttcacaaaatctccagttcctccaaatagaccaaattgtcatctagattctgaaaatctgtagttgtagaatatattcttagaaactggttaccaaccagtaaattcttagaatcttaagcttcttcgaacaaggcttgagaatgtgattataaatgatttgtgtcccaatggcagtgaaaattggttctgttgcatccaaaattcacgaatatgtctagtaatactgaattgatcatcaaatacttggctgtgtttgaagctgagggttggaaaacctatgaaacgacgaattactattagttgaaaaacttgaaaattaaaaatattaaaaagatcaacgtttaaaagttctgaaaacaagaaagcaaaagttaggaggaagtatagaacacacagacttgacctccaaaaataacccaggaatgctcaccgca

SEQ ID NO: 58212 - DNA, 722 bp, Oryza sativa
tgggggttaagtggacttggagagggggagcccagctgggccggcccacgcggagaaaggagggaaggaggaaagggagaatgggccgagcccaaagacaaagaggggaagtttattttgttttctttttatttaaattggttaaatgatcttcgtgactttaaaactatttctcgagctccgaaaattcacggaaaaatccggagagtattttagggcacaaagaatattacaaaatattcccggccaatgatttttaagggaaaatttcaaattctcccattattccacttgattaaattgatttaacttttatttaatttctagaaaatgtattattaattgatttttaaacccgaacgaaaatcggggcgttacaaatctacccgaacgaaaatccagtggctcggattcgccggagggagctcgacagcggcggattgcggcagcggcaaccggcggagagaaaagaggaaaacgacgacgaggtcacgaggggccgattcccggtggcgagagcatctacgcggctacgggaatccgtcccttgtgccggattaggaggaaacgcatcgagggaggccggcgacgagaggcgcttccgagcttgggcggcgacggcggcgagcacacggcgagcggcggcaacggtcggggcggcgctggctagctacgggaaggctactcgtgctactacccgagtctaaggggaggaggtggaa

SEQ ID NO: 58213 - DNA, 1308 bp, Oryza sativa
ctaacttaagctcactttgagacactgacatgtggcccctctttactatagacccagatgtcaatgaccccaaaagtcacctgacttaagtcagaggatctcattcccttcacctaggaggtgcagatttacaccagccaaaacaaggaattaatactaatcaatgaaccaaacactagcaaaatagttaatttctaaaaggcatgttttggcttcaaaccgaaatggtcctcagtgtggttcgatcgtgaattatcatgcatttggaataacatattgatcaaacattcaattacaccaagagcttacaaccgcattgtggtgcacaacaccactctaattattacattcagtgaagccctttatttcttattatccaagtaaaaataacagtaatatatctgtccaacccagctttcaatatagaagctctgctaatgttggtggaacactactatgggtgtccaccataagcacttccagaaccacttccagaaccgctgccatacccgctaccacctggaccactttgtccaccaccaccgccaccaccttggccaccagcttgagcataaccaccaccatatggcccatatcccccggcttgaccatatccagatccagagccagaaccatatccagatccaccattctgcccgccgccgccaccttggccaccaccccctccttgagcatatcctccaccataaggtccatacccaccggcttgtccatacccagatccagaaccagaaccatatccggatccaccattctgcccacctccaccaccaccaccacctccgtctccactagcatacgatccatcaccacttgcctggccataccctgagccagagccagatccccagccagaaccaccgtttgacccaccaccacctcctccaccaccgccgcctcctccagcgctagcatatctagctacccttgtagcgttggctagtccaacgcttaggaggacgataaagctaagagccacgagcttagtcattgtgatggatggagccactgaagtgaaggatgagatgaatgttgagtgaagagttcgtgggtatttatagcaccagacagcatgtgtaacttgaagctgtcatgcaagacgcagcttctttagtcaattacaggataactagaaagtctacttcagagggcaagaaagagtactgcagaattaggtggaatatacgacttctgtgcatgcaaggcttgtcatgaagacatgaagactttgatcttatgagtagacttgaatataaatattacatgtaagttctaaagttcatatgt

SEQ ID NO: 58214 - DNA, 1388 bp, Oryza sativa
agtttgcatgcatatattattgcgtgtatatgtactacggagtatagagataagaagaagaaaagataaggtcaaaattgacggttttactccattaaaaatttgggggaaaaaacctaggcaaaattggttatatagcatcgaaagttcgcgtttttggttttatagcatcgaaagatatcggttcactttaatagcatccaaagttcaccctgatccaatttttaacacttccatcaattctcgatcgttttccgtccgccttgattgctattgatctagctatacacacgatatgatgtttctcccctcattgccatgcattttacttatacttgtgaggggtagaaacgtcatattgcgtgcgtggctgggtcaatagagatcaaggcgaacggaaaaagattgagaattgacagaagtgtcaaaaatggaaatgggataaactttaggtgctattaaagtgaacaagtatgtttttttgcagttgcagggttaattattaggccattgttggagtcttctctagcatatgtgcctaacttaaatttagtctctaactctaaaggtatgcggtagaagacacaatcgaactaatcaagggcttggctcatggtaatgatatagctatttctttttttatggcatcagcttctttaattgtccagtatgattaattgggttttgcttgtgtgccaaaagtaaaagggaaaattcaccacctggcacctggctttctcatccgaaggagtttcatatatacagctacagtgcaattgcaatttcttccctggttaaattattacccgctccattccaaaaacaaaaatataaagatgcaacaactttttttcgatgtttcataatatgcatacatgcaattaattactagcacccctatttcctctaaatttgttttttaataccctaccctctagatctctaataccatattgggtgcattatatgcatcgtatttattggagtaattcaaacaagaaggtgatactattttttcttaatctttacattagtggtggttgtgtcttatattttaggatgaagaaagagtaattagcaatataatatttcaatttaatttttgtttgtatttctgaggaattttttggccatgtctcaattctttgttcggtttaattttccacacttataaccctaaaagcatctatatccctcaactctcatgatctgatgagaattgtatttctgctttatgacgtttccaccatcgacatataataactcgatgtacatcttcatgttctagatgaaactttagtcatgtttaatttatatgagtatcaaaggttcatttaccggttaacggtcaaattttcataggaagatttcaacttctttaaagaagt

SEQ ID NO: 58215 - DNA, 13087 bp, Oryza sativa
cacgcgagaagccctttatttagttcttattatcatccatatataacaacatacaaaactagcattctatataggcttcatccatatgtcatccaggtagtgcgtaaattctatggatatcctgcacttccagatccacttcccgagccactgccagatccgctgccccctggaccactttgtccaccacctccaccaccaccttgtcctcctgcctgagcatatccgcccccgtaaggtccgtatcctcctgcctgacctgatccagaaccagaaccagatcctgatcctgatccaccattttgtccaccaccgcttccaccaccacctcccccaccctgggcatatcctccaccataaggcccgtaactcccggcttgaccatatccagacccagaaccagacccatagccagatccaccattcgccccgccgccactacctcctccaccgccgccgccgctagcatacgctccaccagacccacctgcctgcccatatccagaaccagagccagatccccagccggaaccaccccctgacgagccacctccacctccaccgccacctccacctcccgcactagcgtattttttcggtctagcataggctactcctatgactaggaggacgaggaaggtaagtagtactaccttagagccagccattgtgaagttaaggggatatgatgactgaaagattagctttgcattggtatttatagtgctggagaccttgcaaagctgtagtgcaagaggccacttgctcagtaatatatcgaatctgcaaacctcagcgagagagaaaatagcccggttagggaatactatacatatctgttcaacttctaaacttggccttattaagctggcttctacatatgagtttgacattgtacaagtcaatccactaaacctagtgaagttagtccaggcattagacttgtgcgtaatataaaaattttgacggaaaataaacgctaaattaactagccagagttgttactaacttaattaccactgctactaggagaagcagcgcagttgattggcacaaatcatgtggcgctgagaccttaaaattagattaattgttcagctagctgccaagctatagctctcagatttgtggtcttgatcgatttcattctctattgcattgggttttctcaaatacttgcagctagctagatgatcatgatgtgtgccgacgtgctcgcgtgcatcggtgcatgcccagatccccttcaagaattcttctgcaaattttataaatggatggtataatctttattatggcatgtgtgcgtgttttccttttctttttttttctttttctggtctaggatgcatgccttcctgtgcagcagtgtgctagctagggctgtcaacgagccgagctcgagcgagctcgtcagcctaggctcgagctcgatacaagctcgagccgagctcgagccaagcctataaaatgttcgagctttccgacaggctcggctcgagctcgatcaagccgagctcgactaccgagcttgtaaaaaatatatatatatttcaaagataacctttaaaaaaattaatttctagtttatcatactaataaaagaggaaaaaagaataaaataaatatattatgtcaatataagacatacaaataacatatttgatctcctaatttattaaataacaataaaaatgatatattactaggctcgttagaagctcgagctcggctcgacaaagctcgcgagcttagggagatgctcgggctcggctcgtctggagctcgagccgagctcgaatcgagcctagaacgagccgagctcgagcagctcgcgagcctcaagcttttttgacagccctagtgctagccagtgagatatatgaccgttcttagcttacagtatatatgatcatcaaagttttggcccatcaagttaaaacaaatttcgaagacaaaatcagcccatatatgtgtctcgtactccggacggacagaaaaaactgggcccataacatatgtatccctgggcgaataagtttactttcgtccctcaatttatcgccgagtctaaaatccatcctacaccgaaataccagatagaacgggtctctcaattaacaaaatcggatcatctgatgtcctaggcaatattatgtctggttttaactgatgtggtaagctgattcttcacacatgtaagtactggccacttacatgtggggtacgcctgggtcccacgctgactcagctcgtcacgttagctcaaatcagacataaaattgtctaggatctcgggtgatccggcggttttgtaaattgagggatctgttatatctgtcgtttcagtttatggataaatttcagatttgatgacaaattgagagacctaaagtgaacttattcatatccctggtttatctatgcactgtgctatgatatgggccgaaattgtatggcggccttgaataaatgggtacgtgtatcactctactctcagcctcatctttgtccaatatgaaatctaggatattttctttttaaaattttcaaacttaattttacattttttatgatttttatttaatttcgttttcataatttatctttaagtctatgagggcatatatataaaatttttactcataaattattttttcttgcgaataaaccgttttgctcataactaatcagctcatggtcaaccggtggtgccttttatcttttatttgcctgttcgatcattttcatttcccttgtaagctagcaacgaacgaattagtaacagtcatatcagtaaaacaaaagaaaatgaaagaaaactatacttgcaatagagaccacaccaatgaacaaaacattatgcatgcttcaattcattgctcttgtagagtgtcatcacatctcatttccgcatgctgggctaccatgcatcttccattacaatgatggagcccattaattattaagaaaaactgcctaattaaaacccaagtacaaaccctagaaattaaacttcttgtcggacagcataaaatgacgagaccaattcatgcattgtctcggcctcctccggctctagggtttcccgcgacaagcgaaaacctaccggaaatttcaatggtatccgccgctaccggatccggatcccttgccgctgccgctgccgtagccgccgttctcgccgccgccgccgccgccgcccttgccgccgcccattcctgacgcgtagcctccgccggaggagccatcgctgccggcgtcgccagcgccggagccagcgcctgcgccaacgccgtagctcggagatgctgctgggcctccgccgtgcccgccgccgccgccgccgccgccaccggctgcgtcggcgtagccgccgttgtagtcgccgccgctggatggagacggcgccatcgctatcgacgagccgctctcgccggcgccctggccaactccggcgccagcgccgtacccgctgccgccgttggagccgccgccaccgccgccgccgccgccctcgccatcaccggtggcgtaattaccgccgctgctgagagcaaccggggccgacgccgacgagccggagccgccgctcgagccactgcccatgccgtagccggagccggagccggagccgtacccgccgttggtcccgccgccgccgccgccgcctccgccagcgccgccacccctcccgtagttccacgtgttgccggagtcgccgccgctctcgccgtatccggcgccggcgccggcgcccgagccggagccccacccgccgttcgtcccgccgccgccgcctcctccgccgccgcctcccccgccgccggagtacgagttcgtgtacctggccaccctcgcggcaccagcgaacccgatgctgaggaggacggcgaggcccagagccacgagcttggtggtggcagccatggcgatcgagagagagaggtggtggtgatcagcggataggtttgcgcgggtatttatagcgagcggcggatggcgggagatttaatttcctcttcatgagatcgacttggcgccatgtgcgacgatcaaattaaaggagattcgataaccattaaccatgcatggattagagcagatacaatagcaggctataagccagctataaatatattttaaaaatataaacaatagcatgctataagctagctataaacatattttaaaaagataaaggaagagagagaagagcagcgagctacagatctgtagccagctgcagcacggactccaagacataatgtgtgtatgacaggtagggccaggtattaatagtatagtaagcaattattgtatgaattggctattatattgactatatatgatttagagcttgtagttggctatactattaaacttgctcttagtagtgtagtgcatagcatctgttgattgttgagtttgttgaccaacatgactgcatcgatcaagatgcctgaatttcctatgcgaactttcgaatcgatcaagatgcctgaatttcttatgcgaactttcgatgtggtaatatattttgttggcaattaattgatgcagaagtttatataattcggtgtggagttaattagattagctagctgtgttgcttggtttcttcgaagcctagtgagctatactagattcgattcccttcatctgatgacaccgattagaaatttctcctactggaacagtgtgcctgtgcatctcaatccttaattatgcaggtaatgctaagttcacagtgacaattaagcggtgctcttgcactattaacttccctctaacttgaatatgcatagttgaggttaaacaagtgaaaaatccgtatgtattgcgtcatgctaaattacaaaattattcgtatacgtatgtaatgccagtcctgattcgagccagattatatataaacccattggccagctgcctagctcgatcaaagtgtacgtagatgttaagcgattcgtatgaatgtttcattcgtcggtgcagcaactcggtcgagttgagattatcttctgctaagtagtccatcgtggtaattaatcacaatgttgaccagcatatggattgcggatttgcacacggcgtgtagtgcatcgacctggggattcaacgcgtcgccgacggcgaagtcccggaaaattattagccacattggcagggtgagatcgatgagagggcctcatggggttttttgtttagtttttcctctgaaagtgtatacttaacgtgccttaattatggctgtgcagacaccgagggagtaatcagcgacaagtcgcagtgttcgagttgacctcgagctctgcatgcagtggctgcatatgcagcattcgatcgatcgatcgattctgccaaatagatagtacacgagatgtgcccccagaaaagatgaacagagaagtatttgaaaaccagcaagtatacttgatgaaaagaaagatccaatatatccatctttagcaatgggaatctcggatccgatcgttgaaagtacaacaattgcagatagtaattaaacaagtagtagcaacttgatcagtagactattaagctttattattgtgagcttttgatttggatttgactatttagctaacagtatatgtgggcaaaggaaaggaattggatcgtcatttctacggcagaggtacagcagcttgtatatatatatttaatatttgtacccaccattatgtggtaaatatcgagaaaaaagtaatctgtgataaattacagatccaaattaaatactacaattaatatttgccatggtcgtaatactaatttatgatcggtaaatgtgatctaaaccgttaatatatgtgcgaaaaatattatactaccgttagttaatttggtattataaatagataggattcattaaattaagaaagttgacggtctagattaattctaatatcagttaggaccatcgtaaaaacatcttatacagtggtaaattgatttctctctgtttataacatatttataatatgttttgattttcttaaatcaaacctctttaagtttgacaacatttataaatatatatatatatatatatatatatatatatatatagcaatattttttacactgaacaaacataccatcaaaatatattcaatgttcgatttaatgaaactaattcagtattataagagttgctatatttttctataaatgtggtttaaatttattgaattttgacatgtcaaaacatcaagatgtcttataatgtaaaatagaggaaatattatttataaatgttaaaatagaaagtaaattggtcatcgatctttctctaccagcttaaggtttttggttgagctaatcggtacatacatatatcaaagccaaatatctcgagtttagtcttggttggctgtaggagacaaaagaaaatcgatccagtttagcaaaatacagtaatcaatttaccgcttgtatatatattgccacatattgtttctctgcactaataacgcagaggatccatgcccaattgatcgaggcgaggagaccaaggaaattaacgcggcgtttggttaattacgcagttcgagatatatatgtggggtaaacatagtaggagtattcaatcgactcgttctctgcgttgaaattaaagcacgcatgcaacagtagcacccggcctcatcaattttcagtgatgttaatgtctacttgtcgcgagagatgatgaaattaatggcatcaaagtctcgtccaggttgaccgcgtatctgtgaaaaacaaaataccagttgatgtgattcacagataattaactgtgcaacagtatactgtagactgtaattaggtctaatcatgttgcttgattcttccaaactctgacatgatctatctaggaatctgccgtgcctctggctcgatttttgttgtagcctagaacgtaacacgccacaccaagctgcagcaggatctgtgcatgcatctcactggtcaaaaacagggttttgtacgtgcatctcaatgaccaacatggattgatttgatcgatccaaaataaaaaataatggtcaccttttttttaataatagaatataatattccggcttttgctcaagaagagctacagccaattattacagagtaacactcgagataagagtatagctcaaataaaaaagaacacacttaaataggaaaagccaaaataatgagaacacatttattccagtctatttatgaatctccatccatagttgacataaagttgcataaccattgtctccaacttgcgacatgcaactttcagaaactctccatcttcatcacacctttgtaattgtgcccaaaaccggagccaatgagttgccctgaaaattacctgcatataggaaatagatggtgatttgtcaaaaatcatatcatttctactcaaccatagagcccaacaaatggccgaagctccaacaagtatcagtttactctttttcttgtcaacccccaaaagccacctatcaaaaatatgagatatactaattggaagattaaaaccaaaagaaaactgaactgctctccatatgaattttgcataatgacaatccataaagagatgttgaatagactcattattcatacaaaagcaacacctcaagctgccgttccaaatccgtctcgccaaattgtccttagttaacacaacccctttaagcaagtaccacataaagatcttaatcttaagtagcatcttgagcttccaaatacacttatttctctcaacatagctattattaattaaagctaggtacattgatcttaccgagaatctaccgttctgatggtagttccatctgaaacaatcaaaagaacgattcaactggatatacacaatagaagcgcacaactcatgccaataatggtcacctagcaaagcaaacagagaatgggctggcttatgtgcacccaaaatgttgtgtgaagaagtgtgccctcgaaaatatttctcggaatactaaagtggatcgattttgttttgtctcctgcagccttaattaattacgagtatcaattaaatcatcacattatcaaatcgatctaagcttcatcagcaagccgaagtagtagttgggcttaggacaggcctaattttgtcttgctttgggcctctatgcctggtccaatccattttgcatctcacgtcctttagacgtggcttggaatgaatggataatttatggcttattttgctttttaatttctaccgagttttgccgtggcaattggtaaaccatcaacatttcaggcccagcataagaaaatgaatccatcgatctatattgggcttgctattcatcactcaactgatttttctaaaaaaatatatattagtcactttttgatacccctaaccacttctaatttttttaaaaagatattaattaactaactggtctcatctcactcactgtcgatcgagtactgatcaccacatatgtgcagcactatagcatcttcccctccctgacctcctcctatctagggtgctctaccattcgtcttgtcgtcaccaacacgagcgctagtagtgaagcttgtcaaccttcgcgttcccacgtcgtccctcactccctctttctgcttggttgtagtcggtacatctcatcatctttttgttgctcctgctaccagatctactgtcgctgcacccgcctcctaactaatcaaaagaatcgcacctgcctctaacactagcacacattcttccatccccgtggctttaacatcgccttgtcacctactcgtccctgctgctcatcatcggtcttctaccaccttggctatcgctctaaagttatcctcattatcccctacctcccacctggccaccacctctaagcctgaaacactaatccaaaggaagtttgtttgagttaatcgtcaccggtgggaccatcaaccctctccctctcctttcttcctatctcccccgtctaggtgttataacgatgcccttgttattaaattgtgatccaatgactagggcgaggtgtaacaaccctagtttgttggtagcccttgtagggatttgttcggttaatccatttcaagggggattgaaaggccctcattgagaagtgattaaccaaataaactatagtaatagtgtggtttaggtccttatggcccaaaagtggttggcgggtgaggatgagtttataaacctttatgctcccgcaatggtacctttagattaacccttttacatcatatacgacaggaggacgggaatataaatagggtactactgatagatgggcatgtttgacgtgtaaaatgaactaatgcagatcttaaagacatgatattagagtagctaggtgaatttcagtgacctgatttaactcttgctcttttttatgaacacaagaatggggtacaaatgcaacttcctcacttgagagctcagcacaaccatcaccacccccaacagaaccggagatctctacatatggtctttgaagatattatacatgcagctggttcaacatatatattagagcattaattgagatcatgtatgtgcccacgatttactgtgcggggacaggcacattattgtgacttcaagtgcagaaaattttaaagctgatttctagccattaagtgcggatactttgaaataatcgtgtggacatgcatgaggaactatatattatttttaagaaggcattacattcatgaaaaaaatccatttatttgttcctccctggcaggtacaagtttaacaaaacaaaaatcatgagataagaaagctaggttgagctagctccaatgtagctaagaacgatggcacaaaactaaagatctaagggtttgcatcaccataaccagatccaccacctacgccattgccattcccaccattttgaccaccacccgttccaccaccgttagcagaggcatctgcatttgcatatgatgggttcggcgaggagaagccgccagctccctcactagctccagatccagttccaaaaccactcccgtagccactggatccaacggtgccgcctccttgcccaccaccattgcctccgccacctccaccagcgctagcatccccagtataaccttgataatacccgctgctcgtctgactagagcttgaacctgcaccaaatccaccaccgtatccggtaccatagcttgttgcaccaccacctccacctccaccacttgaatgcgcgtgcgctccgtggccactcgtagccaccccgtacccgcttccggaccctacaccacccccattcagatacccaccaccattcccccctcctgaacctgttccctgagcattggcatacctagccaccctggcagcatgggttaagccaatgctcatgagaaggacaaagctaagcactgcaagctttgttacagccattatgaatatagctagctagctaggtgctagatggaatggacggcaaatcaagaattgtgtatttatagtgctggaggtcgttttacaggttctacatgttactagtatgataacatgatggaagtgtctagatggtgagggtcgacagtcaggtgtacctacagttaaatttttttaattaaccagatcgaatcttgtgttgactagcagaaatgataaattaactaactttgtaatgctcatcccaatgattcaagctagctattgttcagtggctgcctctgtttccaaaaactatggtacactttgtgaaatgcttactactgttaaaatgcctagctgtaagatatatgagaagcaaattcacatgtattacactgttcaaatatttcttatgggctctttctccttcgaattcgtttgacaaactcccatctatttgagaagttatgtactttttttaagataatgggaaaatttcattaataaatgaaattacactaggcttttgcatccatcagggatgcacagccaaaaaacaaaagagaactaagacagtctcaacaaattaagctcaaaacctcatcttaatgttagatgaaattagcataatcactcacatagaacgtcattatttttacagtcaatttttataatagtagagattaatggaaatggagggctaaggcccttcgataaaaaaaaaacatagaacgtcatagggaccgtctgtacactagaccagttttagttagagaaacttatctactaatttagcatctattaagcacgttatgaactatatactcggcatatgtaaggcatgatcaacagagcagctgtagaatagagcaacaaactagcaggttttcagtatatgattgattggctttcagtttcagtttcagtcatttgagttctaggtagaaaaggcaaataggcgatcgacgaggcagagaccgttgctgggtgtaaatttgtcgatgatgcattgtctttgtgactttcacaaagaggcaaggcaacgacatgacagttcagactgctgcaccagcgaagatgctcatgtctacatcacgttgtagctctgatctacatggagaagctgtctcaactctcatcacgagccatcagagctaccccaaggagacaagcagatcagagctactccacggcatattgggcacaaacagttacacaacccatacagatgacaactacttttacaacaagcagagagccaaaaggccgcaaattttgttcaatcgccatcaggaactttgaatgggatgctgctagcatgatttggctagaaaaagttgtcacactaaccgggggtcatggttcattcaggttgcgattacttggacttggacgatttgtgcttcttttttgggcgtgacccttcattacttgcaacataagactcgagtctcacattttcctgtgcttcactctttctgaattcctttgctttcttctgcaaattgagcagattcacatattatgagatgaccattctaattacggtaaacatgtcacgctcccaagaaattaataagaacgaaacagtgtttacctttagggacttagccatatcagcaatctcgtcgttgttgctggtagacttggcagattcgtatggagttgcagtgtcctcctgaaacaaattgttattatttagaaccaaaatgaggaagataatcctgaaaatacacaaataagaatattctaaacctttggaggaacaaatgcagcttctctctttcttttgttctcttcagctttctccgattgcttttccagcttctcttgccatttctttgcggacttctttttgtcactcatgaaatactcaccactctcaagttcaagatcaatctacaacacccagaatgaaacgttcaataaaatggtattgcagtacccaaagcaaatagccagcagtagctacacttgcactacaagcatatcattaggcaacgaggaaagaggaaaaacacatgacccatggatgctgttttcaccaaattataatgtagcaaaagaaatacactaatcttctatacaaataaaatgaatatgaacagagcaacctgcataaatacacaagttgtaggaagcaaggaaggactactaatcacaactcatatgctggtcaaaaccagtataacaaacagtacaagtttgacactacaaacgagtttaaacataaagaaattacttcaccttgctaggttgctgaggaggtggaaagggtgtgtatggcttcttctcctttgttatcggtttcttttgtttgacatttttcctgaggaacagcaaaagcaatgatgtataaggcctttagaataattgtcagtagcactaaacgtcttaacaaagatgatgcaagttccttacttcttaaacttcgggagaaacctgtcccagctttcattggctagcgcaggatttttggccagctcacgtttaattaggagttcctatgtagtttaacagaaaatataagtaataatcaacaatagttctgtaggaacattccttgaatcaaacatctgagaaacaaaacctgttaccttgatgtggtacacagggtgcttgatgttctttatgcagtcctccacaacccttcggacttgtttcaatcccttccaggaa

SEQ ID NO: 58216 - DNA, 1874 bp, Oryza sativa
  unsure (1)..(1874): unsure at all n locations
taatatagcaatagcaatcaaatcagttgatataaagagtaaaaaggaggttatcccacaatgaaaatttaaatgtagcacataaagtaagaagtattggaaaacctgaactaagatgtacgcagccagtcaaaatctcgatggcctgcagttcataaaacagcatgagaacaaagggatgttttttctaaccttccaataatgagatgtatcaaaattgaacatattacaagcagtttaccttgagagtagataaattagggcccagaagacgttctctccttttaacgaatctttcctgcagatggcacattatgagcaggctgtagagtaagtaaaattcatcaagactgagtgaccgacaaacataggatgaagaggtgatgattgcattatttaccatatggcaagctgtaatcatgtaaaaaattacacaataagttaaatcagactaattaaagaaaccatatgttgtaggctgtagctcgttaaaccagtttgtctttttgtatttacaagacaatacagataacttagcacagaacccgtgaatatgtgatgcaggtgcttcagattacgtatttatgtacaacaagaaaatccataaacgtcagaatagctaaatcttggatcaaggaacagagtcctaatatgaaaatacaaagctgcaaactataaggtgaccatcttggcaataacatcatgggaaacattcataacagatgtagctatttggaaacaagaattgagttgagcctcatgaggaatgggcagaatgttttccaacatccttatgcgctcggtatcatgattatattacgtgactaacaaaagctggtatttaaacgtacatgagtggggatatttgcaactgatgacttactcaaagttaatattaggaggcaaattgatattaaaccatgatggaatagcctaccttgttccgtataatactaccaatcttgataatatcacagctcatctcatcgttgagtattttaatcgcctgcaaaattcatcagaggtttagcgacaaaacaagtcttacacaaagcaagcgtaggtcagcaacacaatattagcatcatgtggtaaggacatattatacctgaatactagaaatctaaattagctctcacattttcctataatctaaatgactcaatgcagtggatacaaagagagtgattaacacctgtggagcggggacgctcctcgacaacaattttatcagctccttggccttaacgataatgtagggatccctggtcttgcgcgtggtcgaaacggtcatggatccttccacctacacaaacatcaaaaaaggatatctcaaatctcacccgcagaataaactgaagaatatcaccaataatgtcttatcactcatcggctcatcgccgtaccagattgagctcgcaagcgaccccaaactccttcagcgcgcccttcacaatcggccacgcctcctgcaggtacttctctgcatccatccaatccggacaagcaaaacctcgtgaaattttcacatcatcttgggacttggggatttctatcaaatcgaatcgaaccgcgacttgcctcggtactgggggaagagggtggagaaggagctgacttcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58217 - DNA, 711 bp, Oryza sativa
ctgcaccccacatgagcctatgcttcaaactccatatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtatagtattgttttcttgatggtcatgacaatgtgcatgtcttttctgttgcacaattttcttttacttaagaattactgaatgtttgttgtctagattatgctagctgttgagaacaaactatccagtcatatcagagtgaattgattctggtggtgttaaagcacatattgttcttttattcagcacatgaagttttttcttctcgtagttgacatgctgaagttctcgttttgtaaatttcttgcaaaatctcagttttatcccctttgtggtatggtaaacccaattttgctatttcttgtcccaaaaaaaaatcatgagcaatattattcagtgcagcatgagtgtgtcaagtttgactattggtctgcactatgtaataacatcatgtcattgattcttcatgcaggtccataagcaaggcgttgcacttggcagatctgtggatctttcaaagttcagtaactatgatgaactcaaagctgagctagacaagatgtttgaat

SEQ ID NO: 58218 - DNA, 7940 bp, Oryza sativa
cctgcagccctttaacaacgccgacgagctcctgctcctgtgcggccacgcactccgccgtgcgacgcttaaggcggccctcgccgtcgccctctccgcctccaacggcggcgccgcgccgccctagcgccgctcctctcttcgtcgccctctccgcctccaactgcggcgccgcgcccctcttcgttgccggagacaactcgatctagggttcgcactgagagaggaccagaacacgcgcctttttttcccctcgctgctgactgtaaaaccgaaccccccacggacgctgactcagcgacgcgctgaccgtggtcaaagcgccacgtcggactaaaccgctagccatactgccttaggacgaaatttgcaccggttttgtaagttaagggacccgttgtatctggttttgcggatggaggacgaaaatcggattcgttgacaagttaagggacctaaagtgaacttattccctatttatatagatgcagcccacaacctcgtaaccattctgtccccccgtttccaccaaaccggcccaaggcatcaccgctgcctcgcccagcgcccgcggcatatggaagcccacggttccacggcccgcggccgcgacgactgtttctcggcggcggagttaggccgatcgatcgggacaaccggtgggcagcaggtcgtcgcacgccccccatcaaatctgcgtgggtttctgtcccccgaaaccaaaaaacgacgccccatgcaacgacgacgacgacgagacgttcgagcgacggtggtgccggtgtggtggtcgctagctagcgcgcgcgtagcttatcccgccggttggtacatactctcttcatcgatgccgttgacatttttaaaaatatatgaccgttcgtcttattaaaaaatttaagttattattaattcttttcttatcatttgatttatttttaaatatacttttatgtatacatatagttttacatatctcacaaaagtttttgaataagacgaacgataaaatatgtttaaaaaagtcaacgacatcaaacattagagagtactagatactactcctcctatacttggttggttgacgtgccaccaccgcacccaaccaacaccgccccgccctgacccaacctaacgcccgcactagctccagagaccgcgcgcgatcgatcgatcgtcctagctactccctccgtctcgaaaaaaaaaagtcaatccctgggtttgcgtgttcaactttaactgtccgtcttatatgaaatttttttataatttatatttttattattgttagatgataaaacatgattaatattttatgcgtgacttgtctttttaatttttttcataatttttttaaataagacggacggtcaaacgttgggcacgaaaaccaaggtttgtcttttttttttgggacggagggagtaagctactagtcggcaccacacacacatagcacgtactacacgcacgcgcgcgcgtctcaaggtacgcagctacagcttagctagcgcgagctggagcgcacaatttggttatcgccatctcttcgatcgcggcaggtcgcggggcgtcacgtaccgcgtgcgactggttcaattctattaattctcgcatgcatgcagtagtagtagtacgtactggggatatgatagtgcaggtgcggtgatgtgcatgtgtcgtcgatcggttaggcctcagctttcgtgggccttaatatatatagtacatcaatggtcgtcctcccttaattcagtgtttagtttctatcattattatcccttagtttctaagggcagtcccaaccctccatctagaatggtgtctatggcattaactatattgccatgtaggacttttagcttatgtggcactatattaattaagagagagtgaagagaggaataaactgagtctcatgcaagacacagtttcaacacgagaacctatgtactagacactatcaagttttgcattgggagataatagtgtctttataatagatgaagactaaatatgattggtagagaagagagatgatgtatttattaatggcccactttaaaaaaccatgggttgtagagtatagtttctattatgatgtcttattgacatggcaccatagacactgtttatggatattatgggttgggactgccccaaacactgagttgatcgatcgattatcgaccagcagcatcgatcgatcgatcgatctccggtgtgttttgtcaactgtcaaataaagcggggatagagttgattgggggtgtctgcggttcagctggccatattaattggttggttattagtacccttctgtcacccgcacaaatcatatcgttgaatcagtgtacgtacgtacgttcatgcatactatgccttgtaacttggagtagattgcctaccagccctttttgttgactcggtacgaccgtagactgttgtactgcatgttgttttcaggacataaaaatgatggcctgactcgatcagtccagcccagcctcagacaagttcggttggcccagcacgaatctcagtacatatgatctgacgtactgtgcacacagtgctcctgtgggtgccatcgtatcacttattcgcgaaataaacgtgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatcttttacatattacatagatataagttatcccctataactagtcggataaccatgccgtgtgggtatggggtacccataatctccacagtagcccctgagaccttcacagtcggaaagataaccttctctcgaactagatactccaaagccgagtgcttcaatcatcttcgccatggtctcccgagtacttttaccaaatctgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttaataattatagtcaaccaagtgacttgataccaatatatagcatatgcggtgtgaatccccgaataatatgatccaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttaaaaacccaaacagcaccatggctatattaaaaaagccagcggggcagctatataaagctttactgtttgacaccttttaagatgcattgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaatatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaagatgccaccaatcaaatgtaatgaagttgcataaccatggaggcgaagaaaccagtcggcaacagtcaggttagccagcaatgaatatgaaggcgctcagcgataaagttgtgtagctatggcagcgaaataatcagtcggtggtgacaaaagcaaaccgacgatgaagacgtagatgcgcatcaacgatgatggcgaaatcaaccaatcatgaagatgaagaaaataatcggcggcgacaaacgcatccaacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcaatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacaaaagacgatgatgtccatcagtagtggtagctgtataaaccagacgtagaggtgagggcactagtcagcagcagacgagacgaccggcggtgaagaagataaggccaatcaacgctggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagctgtgcaggcagtgacaccagtcagcggcggatgcggcggccggtcggtgaagacgtagacgcccaacaacggcagcataaaggccagccgtgcaggcggaaacaccagtcggcagcggtcgaggcggccggtcggtgaagacgtagacgcccaacaacggcggcataataagtcggccgtgcaggcggaagcaccagtcggcggcagacgaggcggccggtcggtgaagatgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcagcataaaggccagccgtgcaggcggaagcaccagtcggcggcagacgaggcggccggtcggtgaagacgtagacgcccaacaacagcggcatgaaggccagccgtgcaggcggaaacaccagtcggcagcggcgaaggcaagccggtcggtgaagacgtagacgcccaacaacggcggcataaaggccagccgtgcaggcggaaacaccagtcggcggcggtcgaggcgagccgggggtgatgttctgactgatccattcctggagcgtaagagataagcttaaagccatgaatcccttttatgcatatctggatctggatcctgcagaacaaacatataggatgagtagtatctgatataaatataatactcgagaaaaattcaagcagtttataaatacgtatttcttctcttgttaattttgatttccccgagcagatgactcattacgtttaaacactctgcccgactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgatgtagtgaggcaaagaaaaagacaaaatatcatataaagaataaaataaatgatgacttagctttgtaatattccctcggtgacagcagaagtagccgatgtgggaataaagcagtccatcaatggtgacaaaaacaccagtcggcgccagtggaaccaagccagtggtgtagatgatgaggcccattaacagcggcggagtccgccaaccgtataggcaaaaacaccagtcagtggtggcgaaggctagccggtcggcgaagacgtggacgcccatgaacggtggtgtgaccaaccaaccgtataggcgaggacaccaatcggcggcgacggaggcaggccggcggtgaagtcgtggacgcccaacagcggcggcataataggccagccgtgtaggcggaggcaccactcggcggcaacggaggcaggccggcggtgaagtcgtggacgcccaacagcggcggcataataggccagccgtgtaggcggaggcaccactcggcggcaacggaggcaggccggcggtgaagtcgtggacgcccaacagcggcggcataatagaccagccgtgtaggcggaggcaccactcggcggcaacggaggcaggccggcggtgaagtcgtggacgcccaacagcggcggcataataggccagccgtgtaggcggtggcaccactcggcggcaacggaggcgggccggcggtgaagtcgtagacgcccaacagcggcggcataataggccagccgtgtaggcggaggcaccactcggcggcgacggaggcaggcggcggtgaagtcgtagacgcccaacag

SEQ ID NO: 58219 - DNA, 6969 bp, Oryza sativa
caccactcggcggcaacggaggcaggccggcggtgaagtcgtggacgcccaacagcggcggcataataggccagccgtgtaggcggtggcaccactcggcggcaacggaggcgggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcgaggacaccagtcggcggcgacggaggcccaacagcggcggcataataggccagccgtgtaggcggaggcaccaatcggcggcgacggaggcaggccggcggtgaagtggtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccaatcggcggcgatggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgaattcggcaataataaaacggggtagcgcacgagacctaaaagtggatggatgtggagacaaaggatttagacagtttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcttaaatcaggactttaggccgttccgtaatatacaaggaaacgtaacacccaagtcatgatcttttacatattacatagatataagttatcccctataactagtcggataaccatgccgtgtgggtatggggtacccataatctccacaaaacgaaacgacatatttgcaaacgaaaattaatttgtaataaaactttatatacgtgttcttaacaatttaaaagcaaaggttaaaaaataaacttcgataaaaaaaaccctcaaaatcagttctaaatttaaggttgaaaatttaatttttggctgataagtataagcataagcaaacatatggtaaaatttgctcggatacacacttgtttgctacatatgacacccttttatggttttggcttaggacatttttgtggttgttggctaaaatgtgctccctccatccctaaatgtttgacgctgttgatttttttaaacatgttgaccgttcgtcttattcaaaaaatttaagtaattattaattcttttcctaccatttgattcattgttaaatatacttttatgtatacatatagttttacatatttcacaaaattttttgaattagacgaacggtcaaacatgtttaaaaaagtcaacggcgtcaaacatttagggaaggagggagtactacacttcaaccattattgtagtatatatattttccaatgaagagataaactttacaaacaacggttctatccttgggcatcatgtaagatttggatataaacaaatcaatatacatttgctgaatttaaacttattttcaaaattcaaaaaccgcctccaaatgtggaaattagacaaggtacaaaaatttaaatttcacgaatatttgttcaatttgtttcattttttcctcaattctcatttcgtaatttggcacaagttttaaatttcatggaatatgttttaatttagtcaaaatttattcgaatttaaatattgcagggtggcctaagggcgagatcgttttgtataaagtaatatctctccattagaaatgaatacattaaaataattaacggtccgtgtgtatttcagaagacagcaaaaaaaaaaaactgaagtaaatcccacagatcctaattagatctagcccttgtccatgtgacacgtggtacatatatactccggattttacctcgtgctagttaagggaaaaaagaaaaaataattaactaaacggcacgaaaagcatgggagagaaaaaaagtagcctacacattgcagagtgatttgagatcaaggtgttgatgtactagtggcgctgatgaagaactttgattaaccgttgcaatcatgcttggccaacagaattaacaaaaaaagtaccatcgttaattgtaactttacaccaaaactatcacactgtcaattaattaattattagtctgcagatatatccatcttaattaattagctagctagtgaaatctgtcactagcacccagatattaatttagcgtcatgtagcattatatccttgctggattgcattctatttggtttttcatttttacatccatgtgatcctcgtagttcgttgcaaatgacgattattttcagtgatgtaatcccgcatggacgcatttgtaggtaaattctaaataaataattcggcgtccgtatctaaaagctatcgctcagtgcatcaatcggataattgttccacgcccgtttctcagttcatcaacttgagcatgttgcgatttaaaaaaaaaattaaagagccaagtcaggagcatgcataagtgccttatcccatttcaacaggattcagataattaatccatgtcaattggttccattccattttcataatatcttaaaccaacctattacattttaaggtggattaattcacgaatgttccatgggaatcaacaccgtaaacactgtttaaaacaagtttcaagattaataatttcaatgaaagtcctgtgatttgatgaaggtaattgtgagttttttttttctgtttcgacaccttaaaattctgagaaacgtttaaactacatatgaaaaatctgggtttcctagcttctagatcctatagcgatagaaatttaaagtatatatgagaatcttgactatttaggatagctgaaaattctaagaaaatctactgcacggctaaaaactttcgaaataggaccttaatttattactttatcatctcttctgatggccttctcggtgcttccaaaaggttaatttcactgtagcacgttagttggcacagcatcgacacccagcgagtccatcctgtcaagaacgccaatgacttgcacagatagcgtcaaattatttggtggagacgggcgacgtacgcgtggaaatcgcatccatctgctcgcggcgacttggaagtaagcgatcgagacgagcgctcacagacacagtacacatccagctgtagtcggcacaagcgatcgatcgaggctgtgtctagttcagcgcaaaatttaaattttggttgaaattaaaaatgatgtgactgaaaaattgtgtgtgtatgataggttgacgtgatgaaaaaggactgaagtttagatttaaactttggatctaaacacagcccgagtagcagtgtactagtgttcttctcaggacatgatggccagcgattgtcttggcatccagaaataaaaaggttctctccttgatgatatatctctgtgtagactaagggtctgttcactttaataccattttcaaccttaccaaattttggtaaagttgccaaaaaagtggctacatttagtgtgctaccaaattttggtaactatataagaaatcctatcaaaattttggcaagtttgctaaaattttggcaactataccaaaatttggcaatgccaaaatttggtaaggttttttttggcatcaaagtgaacatgccctaattcaaggtagcctagccatagctgtgtgatgtcgacgctgactttctttgcctcttcttatctgcaaattaaaaccgttaggtcatgatcattttttagctatttttattttcgtattaaaatgaaaattccttacgctcctaagctttctttctttctttataaaggcaatacaaatgcaagtgcttacataaaaacgcgtgtatacttacccgtatgaacacgcacacacaccctactttatgagtactttcgaatacggaaccggcttatcttgagattaacctattgcctaccactgaaaaaaaaaactaggcataaaatgctacatccatatatactaattaagtctaggacttttagccaagttgaaaagttccaccatcagaaacttgactagttaccattagggtttgaagtttcagaatttgttttcttgccgatggggaccggtaatttcataatttttttggctgaaattatttgaaaatttgactgattttgaatgaatttgaataaaatttaaccaaattcacaaaaaattacaaaaaaaagaagaaaatttcgggtgagatgtgagcttgccggtggggttcgaaatttcggaaatttcgaaccgaaatttcaaaccctagttatgatacgctcacttcgtgactctcttgtgttcatttgatttatgttccccgaaatgactatattaccattctctcgtatttatacattgtgaaaatttcatactttattataaaatcaaacaggatagatatattaggtccttataataaaatcaaataggatacaaattcataaatgttagtgtttttttataaacttaaagttaaagaattttgacttaagaaaaaactaaaacactaaaacaacttacgatacggaacaaagggaacaataattgttgttctagatacagatatttgggtggcatgcttaaaataaatttcagtaattacgccccccttttgaatgggcaatttgtgaacttcatgaaaaaaggcgggtaccttaggagcataagtactgaattttatattctaattgatcaaatgaatatcccctcgtttattacttgacattcaaatgattataaaaaaaataatatgatagattaatctatatatgatatatcatttcacaaacatgtaactaaataacaaattaaactaactattatgcatactcatatttatatttgttttttttataatttatagaagttaaatttggtgttgaatgttaatttctagagtgatatatcatataataatctatttcattaattttatttattttttctaattatttgaatgacatgtaaaaaataaaagaacattccctcaagggattagatagtttgctggttcaatgatgcatttttatttgactagtatatatattattccctccgtttcataatgtaagactttctagcattgctcatatttatatagatgttaatgaatctagatgcacatatatgtctagatttattaatatctgtatgaatatgggtaatatgctaaaaaagacttgcattatgaaacggaggaagtatgtcgccaggctcacttaacatgtaggtctagatcggtttaaaatgctgcatttaagtcggaatcagatcatgtatacatgtaacacaatactggtaagtagtaagaaatgccgatctagggatgaaaaagaataactgagataataacttaccatgcaattttattattgcacaaatttaattaactgtttagtttgatacttggcctcatatatagtacgtagtaattaattaaaccatctcactaggctccaactagaaatcagatccacgtctactagtacagatatgtgatgagcagatataagtgcatctgccacacatcactgaaccagcacatggatcacattaagcacgtcaatgtatgctaattaattgattaactataccatgcctaattgcttaattagcagccaacggattcgattgatcccattcgccaaaaccggccggagtcgctctcatgaaaacagcctcagatgaccttgaagtatggacagaatacaatagcaaaccgatcgaataattctatctctgcttacataaaagcaaaagcaaaagtaaacacacacacacaaagcaaaaacaataaatcagtattctaaaaataaatcagtaacatcaccacaccgctctccaagtgtcaaaaagaattaaaggacaacagctactggcactctccatgaactctcctggtcatcatttcacacccatatactgtgtccaaagtccaaaagctctaacgtctctagttttggaccatgcagactgatgaacatctgatgagatagccatacacgagatgcaccctataaataccccagctccccttcactccaaccacactacccagctcactgaagtagcaacgcagctcatcagtgtcaagatggctactactaagcatttggctcttgccatccttgtcctccttagcattggtatgaccaccagtgcaagaaccctcctaggttatggcccc

SEQ ID NO: 58220 - DNA, 1812 bp, Oryza sativa
gtggtggttatggaagtggtggcggtggcggtggcggtggaggccaaggtggaggctccggctctggctctggctctggatatggctctggctctggcggaggcaacggacaccactaagctcattcctctatcagctagctacaatatagcctgttgttataagtgaaccgtgatcagtgatgagtctctctcgctgctttacaaagagcttgtcggattgtatcgatatagcactgtgtactggcttgccgtttcatcacataaagttggcaaagcctagtaaataaaacgaccttttgtactcagatcatacttctgttattcacggagctgatgttcactaagattgatatgcaagaacatagatttaacccttgtcctagctagttgtttacatagtaagcatgcagaatggacttgttaactctcggtgatcttgagttgtaaactggacttgttctcagtagggctgctagctagcatttctagattccaacatgttcgcttacacggtgttaaaaaaatattgctgcagattgtaatgaaactacccagataaagtttcaattggtcagcaccattttgaaaaacttggtgattagctatgcatactctggttttggggaaagaccgcttgagtaataactttgatcagtgatatttgtagtacaaagtacaaacgagtttggtagaaacaaactcaaaactaactactcctctagctagtagaagtatatcgatctctaactctacgtacgttcagttagtcgtttaaatatctgtaacacgtacgttcaacacaagatccagagcatgaagggtatcgatcggctgatttctcggaacttcgtttctgcatgtttatttggtacatcgggtgtgtcatgaaatttgcatattttctcctctggctatgatctctattagtgtggcatcaccattgtgaactgatctcctccagattccaatttaggtgtgtaataataatctgctctgctacacgcctacacagtgtgatcgaggttaactaatggtaaaaatgagtgtataaacatctagatctagttcatccctacgttatagattaaagtaattaatttctaaccgtgtggtttgcagtcgcaagagaacggtcaaatgcatatagcgtcatagcgagtcacaccttatttcaggtccagttctttcagtcgcaagatatgcgggtaatgcaggtcaccagtgctgcgttccactgtcattcttggcagcttccttcgttttctcttatgcgttttctcctgtacaactgtaattttttttttcattgttacttgtaccgccggtcactcaaaagacaaaactgatatttgtaacaatcagacaacacagcagtcagtccatggctatcagctagtagatgcacgtgttctttgtctaagacttatcttctctttctttacaaattatcgttgctcgaccactctcccaatccaattctgaatttgtttcctgggaggcatgtaacgcaatttgtcagacgatgtaacatgcagtttgtctggcggcttgacgactgctattactgatctctttgtttctaaatatttgacatcgttgactttttttaaacatgtttgatcgttcgtcttattaaaaaaataagtaattgttaattatttttctatcatttgatttattgttaaatatacttttatgtatacatatagttttacatatttcacaaatttttttaaaaaagacgaatggttaaagatgtgttaaaaagtcaacggtgttaaatatttagaaacgaaggaagtacttagta

SEQ ID NO: 58221 - DNA, 1819 bp, Oryza sativa
gtggttattatggaccatatggaccttactatggaccttactacggaccttactatggaccttatgctagtggcggcggcggcggcggtggtggtggcggcggtggtggtggaggcggtgggtatggttatggtgctggcggtggatatggtcaagctggtgggccttattatggaccttatgctagcggtggtggtggcggcggtggcggtggtggtggaggcggcgggtatggttatggtgctggcggtggatatggtcaagctggtgggccatattatggaccttatgctagcggcggcggtggtggtggcggcggcggaggtggtgggagcggtccaggtggtagtggctacggaggcggctcaaggaagcgggtctggtggtgggcacccataaaaccctcatctgaattaaagtactgaattaaagttttgtgtgctggtactacacatgataaattagatgttttgtgtgctgcaactaatatatggaataaaggccttgcctttggctgtatatgaatgtgtggttgtgtaatcaatttgtaagttcttacttgttgtcttaccatatgatgatgaagcataatcaatctttgctctatataataccactaaattaataagtacctcacacaaaccatgtctcctactctactgccgttgaattccgaagaaactaaatgaggtttcatgttccagcacggtaaacttaccaaaacaaaccagtatagaactttaaatcttattgtcaacaatataagttgaaatttgatcaaacagatacactacggttttaattctccaacatcgatcatttaagtgctgatcaaggtttacattaccggttgaccactaaatttcgagccctatcggtgtcacagtttttgataaatttcgaccaaatctactgtttaaccttcgaaattccaatcgaaacttaattccgagccatatcgaaacgtcgaaatttcacggaatttgaccggttttcgtcggaatcgtgaacccggtgctgatcatgaactggatgagctggtcgatcggcttttctgaggacacacatcaactgtggcgttcagccggtcagttattgggcttcggctactatgggctgcttttgcaaagaaacatgcatgcatggctacatgggccgttggatccttgggtattacaaattttcaaatataatgttattgggttttttttattcaagcttcgatttttttttcggcccaaccaaaggtttctcacgttcaataagcgtataccgacaaaaaaaaatggcttatatataactacttagaccgatctagatcctattgttttggaacatagaaattcgtaagaagcagatcaatttatacatgaataagaagaaaaagtcagcgttgcagatcgtcttcattgtcagtctgaacaatgcacgtctgtgcaggggactctatacccagggatcctacgttaagtagacaaattctgagccattctgtttgccttcttggtcggcgcctcccttatacatttgacatctgaagaagatgctgctttcagtactaataataactagtactccagtaaacaatgcactgatatttcatcacagtaaattaacaatctagtgctgtgactgatcattaaattcttactacatcagatgctcgatcgctgtgatattcgatccagcactcgtattaatgatttgattctttccttcccaaatcaatatcatcaactgatcatacttcattatttaaaatatctcctttgtaggcgctgcatttatgtaattactctcactaacactatatactata

SEQ ID NO: 58222 - DNA, 7212 bp, Oryza sativa
gggagaggaggaggtggaggggaaggtggcggacaaaatggatatggagatggctatggatctggggttggatttggtcaatttaacggcggctggccatataataattgatactataaggctggtggtcgagggagtggaggtggtggtgggtacggtggacctaatagatttggacatggatttggttccggcgttggtataggtgaggctggtaatcaatacggtgatgagtatgcgaagagtaaaggtgacggtggaggtgccggtgatagcgctagaggtggatatggtgaaggtttaggtcatggatcgggatatggagacaccggtcctcaacagccatgaaattaacctttgtataatttgaataagatagaataagtgaaagcccaacaccaatataatgtagcacatagttttcatagtcagtatattaaaaggcttcttgtgttttggttatatatactccgtaagttgcaaccttgtacactctaatcgtacatcggatattttcctggtaacagttttaacactgtttgcactagtaacctatcgctcatgaataccacgtccatgtgagtacgctttgaatatgatattaatgattgaggtcaggaatttgttgtcgatcttcattctttagacatgcgttagaggacatatttatagatgtgtgcacgtggtatacgtacatatataatgccctttttttgagcaaaggatcttggcactccatttctacgtacataatgcgtatgcacacatgtatatctatctattatattatcaaaacagctttgaaaggaggcaccacgttcgctgtgggggctaaaaattcccacattaatcagagaaaaagaaaaaaaagaaaaagagagtccaagtaggaatacaatttaaaaatagctgaaattcggaattaaaagtaagcaatattgaaagaaatttccatataggaacccaatacgagattaatcaaaattcgaaataaaaataaaataaaatccgaaattagcaaaaaaagagtctaagtaggaatacaatttaaaaatagctgaaattaggaattaaaataaggaatattaaaagaagagtccatacaataacccaatacgagattaattaaaattcggaataaaaaaaataaatatcgaaattagaaaaaggaaaagaaaagaatagttcaagtaagaatataatttaaaattaactaaaattcgaaattaaatataagcaatattgaaataagagtacatataagaacccaatagtagattaactaaaattcggaataaaaaataaaatataatctgaaattaggaaaattaaaaagagagttaaagtagaaatacaattttaaaacaactgaaattcaaagtaaaaataaaaaaaatctaaagaacacaatacgaaaaataaaataaattctgaaattagaaaaagaaaaataagatatcagctaggaatacaatttataaataactaaaattggtgataaaaaaataaagattactaaaagaaaagaccatctgaaacacatgacgagattaattaagtaacatgcagtagagtggtggcggttgatggaacatctaaaaactattaataaaacatcaaatagaatattaatgacgactaaaaagaagtacaacgggcaggtcgtgaagcaatcggtcaaggcgtttggcgggtcttctaaaaagtaaaaaaaaataaacccaatgataattatatttgatttttacgttcactgtgggggctagaaatttccacattaatcgaagaaaaagaaaagaagagtccaagtagaaatacaatctaaaaatagcttaaattcgaaattaaaagtaagcaatattgaaagaagagtccataaaggaacgcaatacgagattaatctaaattcggaataaaaataaaataaaatccgaaattagcaaaaaaaaaatctaagtaagaatataatctaaaaatagctgaaattcggaattcaaaataagaaatattgaaagaagattccatataggaacccaatacgagattaatcaaaattcggaataaaaataaaataaaatctgaaattagcaaaaaaaaaagagtccaagtaggattacaatttaaaaatagcagaaattgggaattaaaaataaggaatattgaaagaagagtccatataagaatccaatacgagattaattaaatttcggaataaaaaataaaaaaaatcaaaattagaaaaaagaaaagaaaagaagagttcaagtaggaatataatttaaaattaacttaaaatttaaaatttcagaaaatttgaaggtaggtggcaggacttctagaaagtaaaaaaataaacccaatgataatcatatttgatttttaaaatctcaataataataaaaatgagaggcagcggtcgagtcgtataggagtacaatggcaaagtcgccgatggttggtgagtcttctataaagtaaaaataaataaattccaatgatagttatgtttgacttttacaatcctaataaagagtatgcggcggacgggtcatagaggagtatagtggcagcgtttaatgggatttctagaaattataaaagaaaaatgaaatccaacaagacaataaactccaatttttaaaggttcgggtttctaaaaagtaaaaaaaaataaaccccaatgataatcctgtttgattttaaaatctcaatgacaatgaagaagggcggcagcgggtgagtcgtagaggagtacagtgacaaagtcgctgacgttttggcggaacttatagaaagtaaaaaaataaacctaaacgataattatgttcgatttttaaaatagcaatgacaatagagagaagatgcagtggacgatcatagatgagtataatggtagtgtttgacgggacttctagaaattataaaaaagatgcccaacaggacaataaactctaaaacctataagtttttagatccaatttttaaagattccaaggagaatgaatagaaaactgtgatagatcgagcaaacaaataaagaataatatgacagaagtaaggggtagcaactgttgtgactttagaaactaaagaaattagaaacgcgaggataataaggtttagtctttaaaaatcttaagacaacgagataactatttaataaatttgaagtaaagtcatattaaaaatatataattttatatgggtgctagccgcgcaattgcgcgggccatccagctagttccttgtaatgtgaaaaaaaaatgatcaacatcatattgatatgtagtattatatccattctaaaatatagttatttttagcacggtaactatttcttcacctactatctcctctcaaccaatcgcaaccattctcttcatctactttatcttattcaccaatcgcaatattctccaatcttctctactcactctcttaatatcgatatctaccttaaaaatacttacgctctgcaacgaagaaagtagataaacaacactacacatttccattgaacagtttcctctctaataaaataatagtaacacataccagctcagacttctgtttggtcatctcgccgtcacatacacggacacgctcggctgccccgtccgcatgtagcggcagcgcagtccccaacgatcctcgcgcgtggtctcggctgataatagatacaactacctttctagcatcaccgatatttataggaataagttcactttaggtcccttaacttgtcaacgaatccgattttcgtcctccatccgcaaaaccagatacaacgggtcccttaacttacaaaaccggtgcaaatttcgtcctaaggcagtatggctagcggtttagtccgacgtggcgctttgacttgtcgtacgtggcgctttgaccgctgagtcagcacggccgttggggaataaaggcttctcgcgcattcggcgccaatcctctcacatttcagaaaccctagcttttcggcgtgtaggttgcagcgattcagacggcggcggcgtcgtgattcggacggcggaggagcggcgatgggaagctcaaggagtgaggggtcgtcgtcgtcttcggccaggcaaccgtatggctcgcctattccctatcgcgttggtccgttcgagtacgaaccagcggtgctgtgtcggtgcgaactgaaggcggcgaggtggatatcttggagcgtcgacaaccctggtcgtcggtatttcaagtgccgcaatgctcgggtgagtgaatttgccgtgttaattttggattggttttatttcggattgggggcctaaatattagggtttttgacgcacagaaagggggctgcgatttttatgcttggcatgatggcccgacaagcagctttctgagggaggtgttgaatgatttgcgaggtgctgtgcattctctaaggagggagaaggcagatgcagtgaaggaggttgaggaacttcgtgtgaagtctgaagagcaatgcagggagtttgcttcagttgggagggagttggcttcagtgagggagttggttagtgagttggatgtgaaaaatgctgttttaattgatagcaaatgtaggttagagaaggagcgaactgtgctcatttggtgcatcctgtcatgtatgtgtgttgttattctattagtgctgggcaagaactgatattgtgtgggcatggcctcaatgtttgatggaaaaaaaatgtgtggcagaactgtgaggtgcaaaaatttatcaatgaaatgtgaagttctgaatgtcttgccaaaattgctgaatgcaatgtcatgtatgtgtgttgtgtacaaatatgcagcaattatgttttgtatgatagaaaaacaaatctcagcataaatgtagccaatataaattaggaaacatcacaggaaccaaatgtcagtcaacagagctgcttcaaatgtggcattgcatcaaaaattgatttgcatcacattgtcagtcaccaaatctggtttgcatctggagtaacaaatgtcatcaaatattctttctcagcagacatgcattcactaaacaagtgttatgttttgagcacacatgcatataatgaaaatctggaagacaaacattagcagtgcaaataacatatcacagtattggcttaaaggttgccattacatcacataggtcttagtttgcgcaaaacacataatagatggcctaaagtttggcattacatcacagaggtctcagtttgcacaaaatacatcatagctggctcaaagtttgccattacatcacagagctgctatacacagcattcctaaaagcttggcattacaaatgacaatgcatcatagtttgtcagattcccatggagggagaagaagcagtggtactttagctttgttctttgtagttgtcctggcaggttcttgagctgaaactatagttggccatgtgggccgcccggctcggcacggcccaggcccggccgtgcctgggccgaggcttgtcgggccggcacggcccgaccaacgcaccgggccgtccgtgccagcccacgtgccgcactcacggcccaggcacggcccaacacgcctcgggccgtgccgggccggcccgaaggcacgatgggccgtcgtgcttttcctcagaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccgtgccgggccagcccagcgtgccggtggggaggcctaggcacggcccgacggtcgggccgggccagcacgggcccgacccaagtcgggccgtgccgtgcttgggccgggccaaaaaggcgtgccgtgggccgggccttcgggcctcgggccttatggccaactatagctgaaacagatacagatgctttccctgaagtaacagtgacaactgcacttgtagagctgttggagcctgcaacattggcctgcaaatcaaccctagctgagccaccagaaggtgtagaaatttttgcccttgcattcactctgacaatttggaggggctccatttgtgcctgtagaatcagatgaagcacacattagtttaaatcaaaatatgcacaatgaaatggcatggctgatttagcttacctttttttgtcggcttggttgcctttgactgagaggctgaagtagtggtagtcaaggtgccagttgccttcctttttctactttgtgcacaactctggggggtgttggacagtacaagattgtggctgggtgttgcaacctgctgtgaactgccacctgcagtttgagctggattgtgtttgtgacagcttgatttgttgtggccaacctgcttgcaagtcctgcatctgaccttggtgccaaattttgatgccttagaaggcttagctggctcatgagcctctctccttctttcagttctgggcctgcctggcatctttatatacccaggtgcagtcagtggctccctatcatcttctggccatgcattcatgccctccactggtagtaggcaatgcttatatgtgctcttgaaagcatccactttgtagcaatcagcagtgaactcatccagtgtgttagttctgtaaaatatacatgcaattgcatgggggcatggaagaccagagagttgccaatacctgcaagaacactccttcttgtccagctgcacagtgaacctattggtgtggtgttttacctcaaagctgtcagctccattgcatatagcatgacagtatgctgactcagtgatatacacattcaatttctttaggatccctggacagaccacagtgttccatctagcagaaacctttctctgctctgaaatcctaaccatcaccttcctccttattgtctctagcatggttataattggaaaaaatcttgcttctaggatccatttattgaatgactcacacatattattatcaactgaatcgcagtttgagcctaacttgaaccatgcacggctccaatgttctggatgggtattaagtatggcctgtgctccagcaggtgtcacctgtgctagctttgcccttgccaggttgaagagcatcctacatggag

SEQ ID NO: 58223 - DNA, 3142 bp, Oryza sativa
  unsure (1)..(3142): unsure at all n locations
tgccttgccgacctgatattttctcaatgagaacactgattgtttggataaattaactaaattaaacaagtgacccaaaatgtcacttcgctctacacctagctttgtatggtctcctacactacgcggctacacgtactagaagttcgatcatgagccaactcgacacttcgcattcaattaatttgacgaacacatatgcttattctcgatccgctgttttttaggtcgtatttgtagtagtttacagacactagctagttcagtttattctgctcaatatatagtttatcaaattatatatagatatgatgaccaatatatttgcattccaatacgctttcggtcactattaattggttttaaatacatacttttttttatctgagatcaatataggagtacctaagatacttgaaattataatatgaccaacatacatatcgggtgcattaatatgcaagaatatatatatatattttttgagaaacacagtataaacgcaggcgctcacaacgtgcgcacactcacccctatgaacgcacacacgcacaccctactcctatgagcacctccggaagactgggccggcatatcttgttattggttagacgtcattaattagacgaaatgaggttatacattcagttaaaccttatcatgatgcannntcctgcatagctagtatatacaatgggcgaaacattgtcacctatatatatatcacaatacctctcatcaacttattaattaattaatatgtggaaatgggtgactcactttatgacaataatgtagtagtactagccattgtggacttgaggatgcctggtgtgttgcaatagctacaatccaatatgtgctgctaaattttgcctcttggatgctcacatacctggattaagagtacacggtatatgcatgtttctctgcatgacctagagttagccaaattatatcctggcctactcaaaagagagaagaaaacagcatacctgatagccatcgaaagtcataatccatctaattccgctgtaatctttcctgccaaactagacttagcagtcagccagtcatcatcttgtaattgatcagagatcaagtggcatcttaactgcaagacacagctagctttgcatgccttccggtgctataaatactgacgagccccatcacttcgaattcatctcatccttcactagcttctcgctagatcaatcacaatgggtaagcttgtggctcttagcttcgttgtcctcctaagcgttggactagccaatgctagcagggtagctagatatgctagtgctgggggtggcggtagcggcgagggaggaggtggtgggtcggacggtggttccggctggggatctggctctggctcaggatatggccaggcgggcggtgatggatcatatgctagtggaggtggagaaggaggcggtggaggcggtggagagaatggtggttccggatatggttccggttctgggtctgggtatgggcaagctggtgggtctggaccatatggtggtgggtatgctcagggaggaggtggtggccagggtggcggtggtggacaaaatggtggatctggatatggttccggctctggttcagggtacggtcaagccggagggtatggaccgtatggcggtggatatgctcaggctggtggccaaggtggcggcggcggtggtggacagagtggtccaggcggcagcggatatggtagtggctcaggaagtggttcgggaagtgcctacggtggacatccatagaagtgcttcacctaaataacctagcagtactgacactatgtgctgcctggtttgagaggtgttgttattagtttgcgtgaataataaccaaataaagggcttcacttggatgtaataatgaaagtggtcttgtataccactacagatgtaagctcatcagtgtaattgaaatgttcgatcaatgagtgtattgtatcctatatatatgatctagagaatatttcactagtagtagagaaagcctaatcacactacggccggtgcataattgcgaatcatgcatgatcgatcgtcttaaactgtcagtgggtttcatataataaaaaccagtagtattgctaccaatcatggctagaaccagtagtgataattagtttccaggatttgatttttaatatgccaaactaaaaaagaaatatattatatctcgtgtatatataggacatgtcacaagtcatatgcccatcaatctttgctcgcggttccccccacccctcattgtattcgtgcaagtgaatttagagtctggccgtcagtaaaaaaatagtgtgtcacgatgaaaaaccctttttctagtagtatgtagtatatgggagtatgggactcgaaaccaacacagctcccttcatgcatcgccagtttaccatctccggtataactcaacataccatgttatcatatttgtttcattaatttggcccttccttgctaaaactttaacacatttttgggtagataaatcacttgaaataaaaagttattaactaggtttcgtaattgtctacaaacttatatataaaaagtttgtccaaattcatgtatatgaaaaaaaaaattatggattgtcttttgatattcattgtcagttttaatgaatattagagcatataataactctaaatcaaaaaggttttcaacctgtcaagagctataacttttatatatatgaagtttgtgttcatctaaattgtcatgaaaaaaataatgattttttttaagattggctctgagtgattcttatatatatatatatatatatatatagtaaaggcctaaaggagttgtcttcaagctacgttaagtgggtcgcaagaggaaggaagcagatggtataaccacaccggcagcaacgctgacttcttagttcatgccatatatatactccctccgtctcaaattataagacctatatttatatacacggtctttaatgatatactttaaccattaatttataccatattatgttcctaacaaatataaaattagcatcacataaaattactttaaaatatgaatatagtgatatactccctccattccaaattatctatatatttcatgggtacaccaagaccaag

SEQ ID NO: 58224 - DNA, 943 bp, Oryza sativa
tagtagatgatgatgtggtatatttgcatcttgagttttagtttctaataattactagcgggcactaattatatacaaggtattgattccactatcacataatattgctatcactatactattaaatgtatattctagaaaataatggtcgggccttgagcactacattgttcaccttgttgaattataatatgccctacgaaaatcaaagggtggataagcacaacacggaaaagactaattaatcagatgtcatacatgcaagaaattatatttagtgcatacagctatgcatcttgcatgcatacactacacagccacacattaccacacatgaaaggtatgtacgtgtagcatatataacttaattattaacatgtgacagcgactcattttatgatatattgtagtactagctattgtatctataggcttagtccagctagctgtgatctatatatcatcctgcccataattaaatttaatttgcccattggaagtgctcaattacttggactcagtaagtggtattattatttatgtttctctagctatctaaatatataatattatacgtatcaattcacacgttatctttattcaggccaactaataagaaagtatgtataaccaggcataaaagtcatagtccatctaattcggctgcactctttttcccctgtgaagtagactttgtaattatgtagtactacgtaattgactagagatcatgctagtggcatcttgcttgacagcttaatttacatcaatcacaatggctaagctagtgctataaataccgacgagccgttcgcttgaaatccatcccatccatccttggcttacttatctagatcaatcacaatggctaagcttgggctcttaccttcgttgtcttggtgagcattggactagccaatgctggaagggtggctagatatgc

SEQ ID NO: 58225 - DNA, 2312 bp, Oryza sativa
ggctagatatgctagtgcaggcggtggcggcggtggagggggaggtggcggtgggtcaaactgtgggtctggatggggatccggttctggctctgggtatggccaggcaagtggcggtggagcatatgctattggatgcggaggaggaggacgtggtggaggtggacagaatgcggatccagatacggttccggttctgggtctggttatggacaagctggtgggtatggaccatatggtggaggatatgctcaaggagggggtggcggacaaggtggctgtggtggacaaaatggtggatccggatctgggtatggctctggctctgggtatggacaaactggagggtatgggccgtacggtggtggatatgctcacgccggtggccaatgtggcggtggcggtggtggacagagcggtcctggtggcagcgggtatggtagcggatcaggaagcggatctggaagtgcgtatggtggacacccataaaaacatgtagaatctaaataagctacctccacaagccatgtgtgctgattgcatgtttgataaatgtgttatttacgtaaataatgggtaataaagggcctacgtggaatacactgtaataacaaaatgtactggtcattgtacaccacaattctacacatcaccaccggtgtaactagatgtttgatcaatacatagtagtgttgacagtgttgcgtcatactttaaagtcaagagagcatttgaatctctggttgctgttgcatgctcttctgcagatcagactccatacatgtgctttgcagcagtatgcatggagaggcattaggttactatgaaaaaaagatcgtgcaaataaggttaagctgacctttgtctggacagataagtttgacttaaaagaacaaatctttgtggttttaacgatttaaaagtaaaataaactacgataaaaatataaaaaaataacttttgaattgagttttaaaatttaaattttgaatgtagcttaactaaaagacatatataggagaaacaataggggagcagaaaaatagttgatttgtattggtgtcttatgggtgctctaggtccatctctcttgccgacaacgtcgaactacttgaacccgagtaattagcttccttaagccacacgaatggtcttgtcggacatatatgaaaatacgttttcacatgcagccgtcgatgcagggtccacatagcatacagccatatatgtttagcgaaaaaggtttccagagcagtgattaccctctctattctaacttattttttattcttcactcctctctttctcccacttgtatacctaccccagcccactcctctcccctctccaccctcccgacaacgggcacaggcgatggcggttgaaatggtgggtgtggtcgaccggcagcggcggcggttgtgggcgatagctacggcgacagtgggcgtgggcgacggtggtggccccctcggctctcccccgcgcagatccagggacgggttcgagcgggaggccggtggcggctctcccctgccctcccctttttagttgtggatctacatgaaacccaacttgtgagcacactcacactatatacccttttttttttcttcctttgctttttagcctttcttcatatgagtgcaaagcaatggaaaaagctttgccatccgccatatagttcacatggaacgcatatcaggtcctactcacatgcatttagcatcctccgtccctttcaaaatcaatactttttatttttatatatatgacactaaaacttgctattcgcatagctttctacctagattttaaattttggggcaattgcttatttgacccagttttgaactctaactaccaatttgaccctactttttgaagtttgcttatttgaccctccttttcaaaaacgaagctacggtatgaccctattctgttaagggcatctaacggtgttaactgaagcacaaaatgtctcttctgcccttactcatttgaccctattacatgtgggacccacccgtcagttctcttctcctctcctctcttctctcttctctacggattgaccacagggagaggcggccaaaggcgagacggcgagccgacgccggccttggtgatgacgacgacgacgacaagtggcggcggcgcgttcttatcctctcctccacgtatccaccacagggagaggcgacgaaaggcgagacggcgccggccctggtgacgacgacaacgaggaatggcggcggtgagtccgggcggtggagctcgagctgcggtcagcggatccggcgccgccaccg

SEQ ID NO: 58226 - DNA, 8120 bp, Oryza sativa
cgccgctccctccctccgccccctcagcgccacagccgccgcctccctcatcccgtgccggcgccacctcagccgccgccgctccctccctccctccctccctccgcgcccctcagctgccgcgccggtgccacctcaaccgcaccgctccctccctccgcgcccctcagccgtcgccgccgccgctccctccctccaccccctcagtcaccgccgccgccccctagcaccgccgccacaagtcgagcgagcaggaaggaggaaggagaaagagagagaaatgtggataaggttgggtggatggatagggtctcctaagggtattctgggtattataaatattagttgcatttctttttttattttaaatcaaaccttaacggactagtggaaacagggtcagacgggagcttcgtttttgaaaagaagggtcaaacaagcaaacttcgaaaagtagggtcaaattggtagttagggtttaaaacgaggtcaaataagcaattgcccttaaattttcatatctgaacttttagtttaggcttttgactatatgggtatgacttacactagaaacgtactaattatttccgtagaaatactctctctagaaccattttggataaaagctttaatttccatagaacaatgttctacataacaacgtatacccagtatgaaaaaaaaatcaactgaaaattaagaacttttaatccagcatcgattctttttctctttagagcaaattaaaattctatgaaaaaaatcaaataattaactttttattgaaagttgttatttaatttaaaaaattaactaagtagtgcaaatttgtgctagaatttaaaagatattcaaagtaattattaaatcaaattttaaagaagcccacatctcgtgtggcgcatggccacacgggacacgagagcacacgtgcgaaatagcatgtttctgtgtgggcatgataatagtatagcttgccaaagtgcggttgtggtgggttttttgtgtgtattgtgatgtgtatttctttgagacatgagtcattaaagtgttgatcgacgatttattatggcaaattggttatcttcattttgtcagcactaacaggcatacccccactggcactgcctatccttccttcgataattatttccttataaagctgcttcgtttagcctttagcttataaatataaacgaaaatttaaatttaaaacttaaatttatttttttgaattttcaaaatatattttaatcttctttatttgtttttaaaatcactaacaaacacgtatataaatgttttactcataaaatattatttaatcgttaaataataaactgttttgctcgtaactataatcgtgacaccccgtttatagtctctgggcaactcgacccatgatccatcgtgcagttaattagatccattgttttgattgggaagcacacacacatatcgagtgttcattgcctttttcgttttttttccccataagcttagattcgcacatgctaaaaacccacttgattaattagcccaaaagtaatgcatattgaacgtacatatcccattccatgattcttcgagatcattgtttatattttttaagccacttcattgtttttttaattgttaaattagatgcaaagtgctattctggcagaaatctacctaataactacgggtgaagacagtgggggtcacttgttattaccgagaggactaagtacaggccttctgcaagaaacacgtttcagctcaagtcacaaacgcgtgctctgctcttttctttctcttatttttttttagaattacacaatacaacgcagacactcgcaatgcacgcgtacttaccccctatgaacgcacgcaaaccctacctctacgagcatcttcgaagactgggccggcaagtcattgagattgacgaagtcaccacaggcgtctcgttgtcgacaggtacattgcctaccactgaatctttccatcacattattgggatgtgctccctccgttttttcaatatacgatgtcattaaccttttaaaacactttaaccattcatcttatttaaaaaatttatatgattaatatttattttcttgatttgaattattattaaaagttctttaaacataactaatattttttatgtttgtacaaaagacaacaatgttatattgtaaagaatggaggtatatatgttgtgacaaagtaataaattaacagattgtcaaactgtggactcagagtacgtggttttcatactttccctgaccatgtagctaccaacaatttcaacccaacatacatagcccacaaagtgatagtcaagccatgcctgaaacaaaaaagtttgcttaactaactggcctgagagtcatatcttgcctactcgttcttctttttgttccctgaagaacactgattcagataaaccagagaccgaatgtgtcactctgtgctagagctctgcatggtctccaacactataaatacccaagcaaccctcacactctgcacccatctcatcatccaaacacatagagtacttaattagcaatggccagaaccaagttggtatctcttagctttgttgttctgctgagcgttggtctagccaatgccgcaagggtagctagatatgctagcgccgagggtggcggtagtggagggggaggtggtggagggtccgaggatggttctggatggggatccggctctggctctgggtatggtcaggccggcggatcttccggtggagcatatgctagtggaggcgggggaggtcaaggtggtggaggcggtcaaaatggtggatctggatatggttctgggtccggttctggttatggccaggctggtggctatggccctcatggtggagcgtacgctcaaggaggtggccaaggtggaggcggtggtggtggggtgaatggtgggtcaagatatggttccggctctgggtctggatatggtcaggctggtagctatggccccggtggagcttatgctcaaggaggtggacaaggtggaggtggcggtggtggacaaaatggagggtctgggtatggttctggctctggctatggccaagctggtagttatggcccaggtggagcatatgctcaaggaggtggacaaggtggaggtggcggcggtggacagtatggcgggtctgggcatggttctggctctggctatggccaagctggtagttatggcccaggtggagcatatgctcaaggaggtggacaaggtggaggtggtggcggtggacaatacggcgggtctggttctggctctggatctggttctggccaagctggtggatacgggccttacggtggaggatatgctcaggcaggcggtcaaggcggcggtggcgggggtgggcatccatagaacttctatatagtgaacaactgcattttatgcagttaaataatatcaaagaggcccttgttatgtggtaaccgataatagaataaaagtagtggtaatgtaaactactatgtaatgttactggtgcaatgaataacctcttgccttatgcttcttatactattgtaaaactattatgttagtaggtcctagtggagtgaaaaaaatttttggacgacaactttagaagttttgaatgaaacattttaaaatataaacagattctcactgacattgaatgttgttttaaaggaacaaaaaaaattgaagtttacaaatgttgtaaccaagaaagaatgaggaagctaagagagagcattatttcatcctacaaacatgtaagagataatatcctccttaaagaaccaagccccaaccaagcataatattctgaaaattattcagccttattgtcgaaaaattgtcgatgtgctccaaactttgtacaatcaatcaatcactaaaattacaaatcatctatcactcgcaattaatattcaaaacaaagaaccacaggagaaacaaaattgacatatatatatatctggtagtgagccagataatttgcttaattataggagttaaataggctttttaattttctcccttttaatataagtagatcatttttttttaccttacatatttaatttaagattgatgggcagtaccttactctatgttaccaaatattatcttaatttatcataactggataaatggttttccaattttttccttctgcgtggagtaaaattatatgttgttcattttttttcattacatcttaagcatgcatgcagccatatttgtccagtaatcatacctctatttgtagattaaggactcgtgcatggtctaatcatgttggagagtcagcgcttgcatggggtgactgacaagaacactgcacatgtagacatgtagttcagtttattttgccacgtaattaagtttcctagcttggtacactgcaaagtcacaaactgacaatatcgacaatatcaaatacagtaggtagtataaatattacgacaatgttcgtcatagagctttgtgatgttgcacaaaaagctagggctagctgccagcgttcttaatgatattgttgacaaaacctcacttccctgaattcagtaacactaaaaagggatatccatgtacagatatatacttgcaactaaactagagatggtcaaatgcatgggcttatgtacgtccatggttttgatactttccctgaactagagaacaaactgcaaaatcagacaaatctttttttccaatcccctggcaatggccttctagccatttgcgtcgtgtaaccagaaccctgttttcttctaatataccgacgtgcaattctttttgtgcgttagcgaaaaaaaagtcagacaaatcttaaacaccctggacgtaatagtcaagccttatgagaaaaacgctggctttagcgagtcatcccttacctactccggctattgtttttattcctgaagcacactgcaatatatgctcactattctccaaaactgattcgatcgtggtttatttacaattataacttccacacctattcatttgtcatttgggatcatttcctatcttatgtcattggctgtagaagattgatagataggctatcagtgcactcttccgggtgggaccagaacttcctactcgttctcgcaccccagcgcacggaaagaaaagtaagttgttttggcgaacatcaaagaaaaaagaattttggctctacgtccggtcgggtatgttcgcgctgcacaagtccagagttgtgtgtacccctagtgaaagcgctggacaaagacactcgcccaggctttatacctatatttgccccgccctatgacccaaaactaaaaatgagccttgcgacgagacgccaatgttatggaagttcctggattgtttgaaatcagattagtaccagttcaatagacattctgctggaactcacctttatctttagagatgatgatgggtgcactgcgttttcaaaagcttcctgtcgaacactattgaccaaaatgtcattatgcaccatgcaattcgttccgtcatctcatccttggaaatacatacagcacatcatggccgggagaaagttccacattttgcaaccaactcaaagcctaaatttgaatcaggaatatgattggttaatttaacagcaaggaacaaagctaagcattgtgaattccagaccaggtactgtttatcagttaactaaaggggcatggaaagaatgcattctgaacttatcttgagcttctagttcgccctgcaatatctacagactctagctactaaccaccaagttattttttgggatgaaaaacagcagagagccagtgtctgagcaattataaatttctaacatcacaaaataaaaactatctcagcgagtacaattaacaataaacagctaaagattgcatagggaagaattttcaccgaagctacccaagctagtgctcaggttcatgtctcactactaaaatgcaactgtcaaccctgtctacaaatgccagattaccgtgggaattcaatgttacattacgattcaacaacatttctgtggaggtaaatataatacagtgaatcaccatgaaggcacggagaatacacacaccctccagattcctaaccaccggtgagtttcaaatccaaattgaatcgtccgatgcatgggtgagttcaatcgaagcaatcaacagaactacgaattgggggtaaatacagaaacactcgaagactaacctcgaggaagtcaacaacggcgtgggcgccgctggcgaatccaccgcccgtcgctgtagcgttcggcgccgccgcgggagggggcgcggctctagacgaggtcaccgtcgccgacgccggcggcggcgtctccgcccccgcgtctgctaatgggcaaggtagtactgtgggccggcatggacgaggcccaatatggtagcgatccatctcagtgtgggcctctagttaaatcaatgggccgtcaagattggacccacgtttcggccgtcaatttcttttgcgggctgaatgggctgaattctttcgtccagaagagatgggctagatttatatatgggctggattgtatcgaggataagaggtagtaggccgaatttgtttgtgggccaaattctctgatcccctccggcgccggcgccggcgccggcgaggcggagacggcggcctcgtggctgattgaacggaggcgctttatacttctcttcgccttgtcaaattcagttaaatgaatggaacagtattctgtcactgaaagagagatctacgattattctggccaattctggctagttaattagccatgcagatgttggagaattttcgttttagacaagaacaaacagatgcaggtgaattggtctatgcaaacatatactcctatatattgatcgattgtgtatttgtgttttgatgattgatagtgtttcgatccagaagatagtttattagtttggcttatgtctcaccgtgatcatctcttaacgcaagataaaattggttgttggaatcaactagtcagcatctgcgtgcacacggagaaagcaagcagattgctgcagtgttttggtttcttttgcaacttccaatgctctctacgtatctgacctaacgacaaccagtgtaccactaaaatataaacttgactgtgtttttgtagggtatgtcctatgctggagtacaatggatggtcaaatgcctgggctcatagaacatggtatcgactatcgacaggctactttccctgaccatagggcatatatacctgcgcccaaccttacaacgtacacacatgtagtcaagcagaatcaaagaaaaggttgcgtttgattgtcccaatagtcatacgatgccaacctcttcttggacttgtactcacgaagcacacggcaacgctgctctgctttgataaaaccagtgaccaaatggcacagattgcatatttgcacagcaactttgtatggccttcttttttctttttttttacactcactttgtatggcctccagcactataaatagagacacacgcttcgtactctcatctcaaccttcagattcacatctgtgagataacaatggctagaagcaagtttgttgctcttagcttcgtcgtcctccttggcattggactgaccaatgctacaagggtagctaggtatgtgagcgctggaggaggcggtgggggaggcggaggtggtggtgggtcagggaatggttctgggtggggatctggctctggctcagggtatggccaagctggaggctctggtggagcatatgctagtggaggtggtggcggtggaggtggtggaggtggacaaaacggtggatctgggtatggttctggatctggttcaggttatggtcaggctggtggatatgggtcccatggtggtgcgtacgctcaaggaggcggtcaaggtggtggtggaggtggtggggcaaatggtgggtctggatatggttccggatctggctctggctatggtcaggctggtggctacggtcctcatgtggagcatatgctcagggtggcggacaaggtggtggtggtggcggtggatacaatggtggatcaggttatggttctggttctggatctggttacgg

SEQ ID NO: 58227 - DNA, 10317 bp, Oryza sativa
tcttgcttgtgttcttcatctgtgatgggaactattgttgtttgttgttgatgatttgtgatggagattgttgatgttcatatctgtgattggtgatggattgaattagggattgcttgaatggagattattattgttcatctgcttgatttgtgatatgtgaaagcatgcttgaatggggattattgatgcgcatcggctcggcttggagccagcttcttttttttttttaatccggaagagcacaaaggtgacggttctatgactggcaccaataacactaggtcattggtgctgaccaattggtgtcggctaggaaaccggcacctattacccgttcccaaccggcacctataggggaatatgtgcttcgatgcaaagcactacacacgagtacacggtacatggctatgttctttcccgatctttcctaactcaccttcttcgttttttgcgcgcatgcttcccaaagtactaaacggtgcgtattttgaaaaaaaattctatagaaaagttattttaaaaattaaattaatctatttttaaaatttatttcagctaatatttaataaatcatgcactaaccgccactctgttttgcgtgttgggagctagggttgtcaaccctcactcacttccgaactcagccatacagggcagttgctctgctcagaacagaacagcatgtccagcaaccaggcttcttcatcaaagaatcaaccaggcaaggcacctgcaaaatctgcaatcactttcagctttttacagagctgctgctgttgaaacttcgttcttgttagttaacttctctgaaaatcctgaaacttggtactcacatagacttaaatctgaatctgtgtacgtttacgcggtacatgacgggatgcgttttaagcattctcataattataaatttataacatgcagagaggcctattatgttttattatacatgtaaattggtttttgatgatgaaagtgaagtgaactgaaccggtgtcaggatacgcgttgacgttgtactactcgtacgttcgtagcgtgtggctgcatatgcaattgcatttatagtatgctatattacacgttgacacgcctatacccacgcggacttgtattccgtcaacgggacattctctcgatcgataaagctccacattaaactctatccattttttaatatatgatgccgttaattttttttgatacgtttgattattcgttttatttaaaagaattatctaattattatttattttattgcgatttgattcatcgtcaaatattcattaaacatgacttaatatttttatatctgtaaaaaagttttgaatatgacaaatagtcaaacatttgtcgaaaaatcaacgacactgtatattaaaaaatagaggtaatatgatgtcagttgccaaagatcgatgttctaattgttgtctttagtattatccataaaaggtagctgtctcaagtgttgaacatactcatttacttagtcctacataaatcgtgcacatgttgacttcgtaaaataatacacacggctgtgttagatagtgcagaaatgctgagctagttagttgcacgggaaccaaaacagattgttaacgtatgattaattaagcatgaacttaaaagaaataaatactaactattatttacttgcaaaataaataaatttatttttgaaacagcttctatataaaaagtttttcacaaaacacaccatttaatagatcggccgggaaacatgcttatgataaatgaggaagtagcccactcaataaacggttaaaaacacaatctaattaagcaagaacagtatgaatgttattttttctttttttcttccttcattagtataacatattttgaaacagaaactgtatgctttaatttcacaatattaattagcccaagcctatggattgctcaaaatcaaggggtacaccaaacagataaagacaataagaaagactaaacatatcttgacacgatttctacgtatatgtaagcatgctttgctttcgtcaaaatgtcacgccccgaactagtcccgaccggaactagcccgtgacgctccaaattaacctgttaatcgataccagtcctaggaaacagtgctggtatcacaggaagacagaatatcacagcaacagaggtctctttaatatagagaaggagtacagtcatattgggctgcagacagatcccgagctcacaactgcattacaaaaggaaagcggaagccaagagttggaccaaacaacacaggcgcgacttgggaactaggccgaaaccctaaaactcaacgtagccggcttgctcctggaagaactcctcgtcagcgggatccgcttcatcttcttcagcaactgggggggagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaagcatcgatcccctttccacaacagcaatttcacaagcagtagtcaaacaaaactacgctaggaatcacctcacatccgcgcatgaccgtgggcacggctgttcgaacagtttgttaacctctgcagaggggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggagtcctctctgacaccaccccggcgaatccacatgtctcttggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagatgtttttttttcagattttaagtttgaaggcggccgtcgatactcgtgcagagtgcacgatttccgaggcgcaactgggtggttacaagggaacatggtataacaattaacaaatgaaggatcaaatgcaacaaattaggtaggtccgtcaatctgccttgcagacgggacaagcagattaagtgcgatcctatcaatgcataataatctttcaagcaatataattaagttcaaatataggctcaagatattcaaaggtggcttgccttgctcgagatctggagcttgatcctcgaaatcctcgcactgcgggtcttcgggctccgaaactacacgcaaaacgggacaactcaacaaacggcgaaaataaagcctattaatgacctctaagcgtgccattagatagatctcaagatttgaggaattttggaagttgaacggagtcaaacggacttacggttggaaagatattgaatttctaagattattggatttttggtctaaaggaaaaggatttacttaattcctttttttgaaaaagaaaagaaaagaaaagaaggagggggaaaattagacttccctcgggaggctagggcgcggcccgagagaaaaggggcggctcggccgagctaaatgggccggtcggcccaacaaggcggcccagagcgcgcgcgcgggcggggaggagagagggagccggtggaccgggctcacctcgcgtggtcccgagtgggacccgcttgtcggtgacacggttcaccgagcggaacgcgcacgcggcgcccgctagggtttgggggagggacgcggtgcacgcgcgcggttcgcggaggacgcggatgcggcgggcccacgcgcagcctcacggctcgcggtggaccgcgcccgcgagcggggccgtggggagcggctaaccggggtcggctcgacccggtcttggccgagctggcgccgacgtggcgcctacgtgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatcgcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattgaatctccactgatcaacgctacaccacgttgaacaggcccaaccaacccacctggactacggtgcattgggtcgatttattagggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatattgtaattatcccatcaactgagctagtggtaattaagcatggctaagcatatagttctagctaggtcacataagtaacacaagctggtcgatttattacccaaggttgacaaagaacagatatcaagtaaacatggcacaagcgagcagataggtaaaccctgatcccgtgtaattagcaaaacatgcatatttatttgcaaacagtaaaacatttgtaaattaggatcaaaatgctcaaggggaatgtgtgacttgccttgcttcttcaaacaatcttccgaactcttttcctcgcgaccgcggacttccgaaacgacggaaactacacgctggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctataattatttacgaattattgcgcaattattatttatttttacaaaggaaatggatctcgctgacgtcagcaaggggcggccggcgccgacacgcgggccccacacgtcagcgagtcaaaggggcggcgcacggtggaccaagtccacacgtggcctcggggcgcgtccaccacgtggatggcccagatcggcccgaagccgatcggacggccacgaggcggcgcggctagggcacaggcacggcatgaaaccggctcggccgagcgatagcgcgcggcggcgtgcggccagacgaccgccggcgacagcggcgcgtcgcggcagcgggcacggggagcggcggaggaggaaaaagggagaagggacggtggggattcttaccgaggacggcgacggcgagacgaccacagggaggcggctggcggcggaaagggatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgaaaggcggctgtggctcggtgcacggtgggaatggtgctgcgggggtggaaggggaggacggagtggatgccggggtgtggcacgacgcggcgaagctgttggaggcaaaagcacggccgggcgaggcggcgctcgccggcggggagcggatggaggcggctaaaggcgaaggtggctcggggtggcggtggaagcggcgttgcggcggtggattggcgaagaggagcggtggacggggtgcgcacggcgactgtggtgccggggagggcgacggcgcagtgcggggttggcgagaatggcggctaggggcggccggagctcgccggagagcggcgacggctcgattttgcgtggggagggcgggggagagtgcggggagtacgggaaaattggggaaaagggggagggtggcacggggatcatttttataggctcggggaggagaaatcgtggccggacgggcggcaacggccggcggagtggggaggtgaagtggagctcgtggggaggtcaaaccggcgccgtttcttgcggggtgagtgggggagatggtggaggaaggggatgacgtggggtggaccgcgcccacacgcgcgcgggaaccggaagacgcgcggggaggggcggcgacgtgggcggctcgggcggccatggcagttgccggcccgggctggaggttggggatgaccccgacaggtggggcccacctgtcggtggctcgggggaaaggagagaggaggagacggttggggggacgatgacaggtggggcctcgggtccacctgtcggcgaggggaggagggaggaggctgggggttaagtggacttggaggagggggagccgagctgggccggcccacgcggagaaaggagggaaggaggaaagggagaatgggccgagcccaaagacaaagaggggaagtttattttgttttctttttatttaaattggttaaatgatcttcgtgactttaaaactatttctcgagctccgaaaattcacggaaaaatccggagagtattttagggcacaaagaatattacaaaatattcccggccaatgatttttaagggaaaatttcaaattctcccattattccacttgattaaattgatttaacttttatttaatttctagaaaatgtattattaattgatttttaaacccgaacgaaaatcggggcgttacaaatctaccccccttacaggaatctcgtcccgagattctgggatggctagaaagaaagctggagctggcgggcgatctaactgatttgcaccctgcactgttcctttctgattcaactgaacgattcctcaatggtccaaacctgctcgactgaactgaccggcattgaccattctgttcttttgctccaaacaactgaactgactggcctcattggattcgaccttggagttctggcgccccacaagactgaactctgtacgagtgatctggctggtttcagctctgcggtcctgttgctcccaaaactgaacagattggttctgcttgaactgacccagattaggactgcggatgctcctgaaacttacttatcttggactgaactgttgaggttggcaattttggtaacctgagaactcaccacgctggctatgagaggatgaaaattgaatctggcatttgtaaatcatttaccctatgtccgcttggattggtcccaactcaaaagacaagtaattccaggaaacctgcttgacccgtcttttgtctgaactgcaaccgtctgcttgacctgtctaagctaagcggttgaactggcctcatgggtgtaccttagaattcaacctgttgacttgagattgggagactccgctagtggctcgcaacggactcctttaattactaaccaaattgctacactgggttgaacattcaagtgaaatgccgacgaggtaagccaaaagtcatctctgagacctaccctccttacagtgggtagtcttactttcgcctgactgaggacctttgaactgttgttcttgaagaaaaatcgacacttctcgaatttacgaatggccctggctttgaaaatagaaaacttcaacgatcaatcaaaataaagcaatgacgatgcacttccatccaggacaagacttggaacttaacccttagttgtcgataggaaattccacataaagaaattctcatttagctcgtgatcttactaactcttgactacttccccatcagttctattgctggcatatctagcatgcttcaggcccgacttcggtgtcgtccacctaaatgggttgtgtagttgatatctcaaaactaaactgaccgactcgcattggaattgacacaacttgaggaactggggtgctgcgaatagagctgttgtcttgatgacgctaacgccttgccgacgaacaaccttgcaagaactgaccttgtaaaccataaccactataggtagcacttgttgcctctgggattggtggtgacttagctgtgctagtctgctgaagacttggtggcgtactgtctgaggttgcaggtgcttgctcctggaaaacaaactgactttcgctctgatcctgattccggcttgcatctgagcttgtacttgttggtgaagacattgtcgttgcatttgctgctttggactctgcggttgcggtatcaacatctgacacatccatcattagatcttggctagccaggatcttaccagagcgtggtgctccgactcagctggtagtttgtcgtcttgaactgatccactgactctgactgcaacacactactgctagagttgcttccgctacattcgaccttgcatcgggctttgcatcaatacacccatcttctgatcctggataccaaatgttgatcacgagcagggattcttctagcatcgggagtaccttgtagctttcgactgatccattgatctgtgactttcatacaccgttgttgttgctcttctctctgatacagaccatctgctaccagaacggaggagaggtggaagagaggggtggctaaagataaggtactaaaccacttgcctattgatctgctgtgagtagatttttatggtttaagttgcttaagcaaacaacctagtatggtcgcatccccaccaatgatgcaaaccatacccctgcacacaagcaaacaacacacgatctagaagctaacgaaactactcttctgggacagattgggtttaggtcatctccggggaaactcttctttaatcttcgcagaacgacgactctgaactgatcttctcgctccttgcacgaagcttgaggctcgacctgacttgacttccgaacagacatgacgctggcggtttgtcctccaggtttgacaactaaaggaattggaggggcagggaggagaattttgaaaaaccgtttcgcaaagaaaagccgaagggcgaggggaggcatttttcaaatagggttttcagaaagcttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttccgaaaagggggaataatcg

SEQ ID NO: 58228 - DNA, 1008 bp, Oryza sativa
ttcctgcaccccggaaccgacattggacggtcaagccggcgagctggcgcccggctagcggccaaaacgacgacaggaggtgacgccgacgagaggaggaaaaagaagaaaggaagagggaaagggggcttgcctccttgccgctttgggaaaaggaggagggagcgggggggtgatgcggcagagggaggaggagctctgcctcctctccttggaagctagcgcgtggaggggaggggccgagtcgatgacgacggcgatgacggtggggcggtttggagcggggcgacgacacgggcggcaggcgcgggcaggcgcggcagagctgatggcggcggcgaccaggcggtcggccaccacggcacgcgcacgcggaaagcaacgggcggcgcggcggtttgagcggcgcggctcggtacgcgtgctgactcgcggggccgagcgcctgcgcggctacaggcgcggtagggcagcggggccgggcggcgcagacggcgcaggcgcggcacgggcggcgaccacgcgggcgcgcgcacgcgagcaacggcgcgcgggggccgattttggggcggggagctcgctagggatggaggcagggagagggagagcgagggggaggggtgctcggcgcggcttacgcgcacgcgcgcgcggcgcgcgcgcagagcgagggagagagggagagagagagagagaaagagagagagagagccggggagggaggggaagatgggccgagagagatttggcccatcgaacccgagggaggcaaaatagacttttgcggaggaattgatttgggaaggatttggattcgggattgaactcgacgatagatcggggatttgagatctgagaaggcacggacacttgacaacaagcaaagaaacagatttcgcaaataggatttttaagagataatttttcccgctaggcgccacgacggaacaggcgctacacaaaatcagttattttcaagccattgaaatataccaaattcactctgaa

SEQ ID NO: 58229 - DNA, 1271 bp, Oryza sativa
tatgtaagtctattttggttccccccaactatttttctttgatcgtgttgggcggggccggtccaccgtgccaaggcatcggcccaggcacggcccaactatcgggtcgggccagcacgggctcgacaccagttgtgccgtaccgtggttgggccgggcctagggcctagggccttgtggccatcttgaaggaatcctatagcatcgtgggaagattggaaattgaatgacctaccactcaaaatggatacatgtaacacaattatgcgattaacttttcatttgtgtggttatttggaattgtatctgtaacatgaagaaattggtgtttcttgttagccaacttaccctctaagaaattatgaacactctccctccaatggtgtggtggatcgcatctagcctccttgtagatctgtcggtgcccacatgcatgctggtggaacgacgatctttggcctccctcccattttcaatccgtcagtcctcaccttctccatggtgtgttggccataggtaatgttgccagctagagggaagcggtggtggacaccctccaaggctatcattgttgtcaccaccaaatccacccttgagttcaggtcaactggatccaagaccactaagcccgtggtgatcgggatctaactccaagcttgtggtggtcaaatttgaccgcctctaagcttgtgcagggctggccagaggaaagggaggtggtggcgccggaggagaggggagtagtggcacgtcagtcagattcggatcatagagaggtgagggcactcaggacgctaggtataggacatagagaggacagagaagaaagaatagaggagagagcggtgtcatgttggcttaaaattttctagtctcggcctccacctcgtcttgttcttacttaaagtgacgactatacttgctttctttgcagcaatggcctagtttcactctcagttcaatccttgaactggaaatgatattgagtaacattgtcagttcatattggtttggaaaaaaaaaccagacaaccaatagtaatactcttacatcaccgtactagtacggaacaagacatctgtgtcgggaaccttcatctgtatcggagggaggctgcgtcacggattattggacagtgatgtgaaaagttatctgtgtcaggcactcaggctacataccatcaccaatgatagtgatctatgtcgggccgacacaaaagaccattaccaataggtttgacccaacaaaggagtgaaactaggggctgcagg

SEQ ID NO: 58230 - DNA, 10395 bp, Oryza sativa
  unsure (1)..(10395): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcaaggctggtaagaactcccagccatacgttgtaaaggaagaaaggctggaaggtgcactgcaagctaattacatagtcgcaagttgtatttcaagatactgtgcctatctgcttgtctcagagccagatttgctacctgatacctacttaagttctgcggaggtatttgaaagcaccgtgaaagaggcttcagatgttctaaagggatctgacaacctgcagagcatatacagaaaactgatgtatcatggggatgttgtgaatgtcgataatatgaacagacgtcacccaagtgtgatactcgcgagaagtgcacaagttgctaagtccttggttgaaactgaagtcatggatcgttgggagatgttggctggggtgtgggccgaaatgttagtacatatagctccctcttggaatgcagcagctcacaagaaatgcctttcaaccggtggcgagttcgtaactcaaatctgggccattctttctcattgcaacatacaagaaagcaatctctggccacagcaggaatctccaaatgataatgaagcagagcagcaggaagaaagtgtaagtggcaatcaggcatctttttcagcacaacagcgggcagctgctggtcatggtggagtaagggatgatgaagctggaccgagtgggacaaagccaaatgatgaaacaaaagacgatgacgaaaagaagatgtcggttaatttgagttcaagaacaccaataaaacgtgacagtgtgagttagtataatattgttgaactcgagctttcttatgtcacatatatgttcctttcttaagaacatgtctgttcattctccatgtgtagtagtttatatggttgttgcttgcatgtactaaggtgtggtctcttgccgtactatgtactttaaacagctgcaaatatcgtgttactttttttcttatgagtgttgatcgatctccagttatttttctgcgagtagtcccagtaaatcgctctttgcaactcgtaccagtatttgcacaaggagattgaaatcagaagagcctacttgagttgcatgagcttttaggctttcatggaggttggagcagagagatgttgatgagctgatgacaaaagagaaacgctaccatgaacttacaagtagtagtagttccatggtagaaactagtactaggtggcaggcacggttcacgcgcacagttcgcatctttgggccgcgataaggctgcgccgcgcgttatcctgcgcgttatcgtgccacaaccttacaccgagttcccttatcctcaataccagaaatctttatccctaaacaatacaaaaccattcaatttaggtcccatagcagtatagatgtctgatttcgctgatgtggtatcctagtcagaaaaaaataaaaaatatatgtgaggcccacatgttagccgcccttttcttttcttcccaagtggcagcggcaggcagcacatggagggccgcaaagacatcgtcgacttcctccttgccatccagcttgtggggcccaccaagctgctcgagtccacgaccttcatctggttggactcacaggctgacaccaacaacggcggcggactttatcggtgcagcggcggcggctagcggccagcgacaatggcagcgggggtgacaccagcggcgagggtgagtaggacagccgagagcggcagcgcggggaggaggaggaagaggcggggggcaccatgtctttggcaagaggtcctcctccatcttcgatgtcccctccctcccccctcattcccaccactgccgccaccatcaccatccgcccaagaggtcctcacctcccttcaccgctgcaacgggtgaaggcggaggctcacctcccttcgtcaagcgtggcagaggcgctcccttcaccgccgccaggaggctcacctcccttcaatgcgatggcgggtggaggcggaggaggaggcatatgaggtgtgcagaggtggaggctgctcttcagatctcgggagtggcggcggcagctgaggagccccccgccggccgcttctcgcctcccctatctcgcgccggccatccctatccccatccccatccctatccaaaaagaaaagaaaaggaagaaaagtgcggctcacaagtaggacctacataattttttattttttattttgcttactagaatgtcatgtcagcgaaaccagatatccatactgttgtagcatccagattgcacggttttagtacagtttaggggttaagatttctggtattggggataagggatgtcaaaccaactcggtgtaaagttgagggacaacaggtgaacttattcttgcgcattttcggctatcacatgtgggccgtgtgtagctttgggctccgtatttagacgggagtttcactcgacgatgctccctggggcgcgagaatgctaaagcgnnnnnnnnnnnnnnnnnnnnnnnnnnnnnnnnatcccacaagctttttcgttttcggcacggaatttttattgttggattttgtgcaatggaaataagttcactttcagctcctcatttttgccactgagtctgaaatttgtccctcactgcatgtaacgcttcgcttttcgtgaggcgttaaaaactaattcggcaaaattctaatttcaaaaattttgttctttgagtgatagtctaagttgtgccaagatctcaattcaaatccatccttgatccctctcgtcaccatcaaaaattgcctcctcgaaattccccttccgactcaagtctccaaatcaaactccgaaattctatccctctctttgaatcatcgccaaatacttccccagatccaaagtatccaaaaccccatcttgaatcctccttcgactccttcctctcatccagatcccaattccaaagtctaagtcaaattccaagttcaaattctcttcgaatcaatctcctctgcaaaagtttattttgcctccctctgtttttgtgggccgaattcctttccctcgccccatccctcctctcagcccgtttcccctccccagcccatctctctcctctgccatctccctcccgtgtgctgcacgagccgtcgccgagagaaggatctctctctctctctctctctctcgttttctcgctccctctctattcctctctcacgccaacgcctcttcctgctatcgctgcccaaaacctccaccgccttcgcccaatcccgcgcgcgctcgcgaggtggccgaccggccgatcgcagccgcgtcagctctgacgccgctcggccccgctgcccccgcgcgcgtgcgtccaaagccgggagggcgcgcctctctcacgcgctctccctcctccctctgctcgcccaaatcggcaaggagcagggctcccttttcccctcccttttctgctttttcccctgaccaccaccgccatgccctgtcgccgcctggtcatttgcgcccgtgtaaacacgcgccttgtcagaactattcaagctatccaacaggacaaggagccagtcaggcccagtcatagcaaacttcctttccggcggtagcgcccagaactctctgatggcttctcgcaacgatctcgccactgtacattcaacagtcgcatggaaaccattttcctcctttacaccacagatagggcagatgcctactggttgtatccttcttttccgtttatacctataaagtttatacaagtaaggtcccaaaagcagtttggacgacggtttcggcagatgtggtgcttacgtggctggtttgaattggtcattgtcctacgtgacggtgttgtggcgttggaagcaaaatataaaaattatatatttttttaaaaaaagtggcgcacatatatcagtcagacaaaagattaaaaaatagtgagacctacgagtcactagatcccaccctcccctccatctccatggatggcagcgcctccttctcccctctctcctctcctcttgtcgccattggtccaaagggaggagaatggtcggaattggcgaagctcggcctgagcgtcctctggatcggcaagatgatgccgcgtactttgccgccatcctctaccctacctacccgtctcctccaaccaatccctctcctcgacccccacctcttctcccatctcccctccttgtcgatgtcgccacggccgtccccaactcgctgccaccaccaccttcatctggtcggcttcccatcaacgttgacgagactagctagctagtcgacggaggctgggatagccctggctggatgacaatccaagatggtgtgtttgttctccacctccggaacggcctccacggtttttgaggggatccacctcgatcccatcctcgatggagggcgaggcggcatcggacaatctcacactgctgccacctagactgctcgagagtgggtgtgcgacggaagtggaggttgaggacgacgtacagggtgcgggaaggctggttggggatggcacggtcggtgtggtcgaggaggatgacggctggtccgctccattggtcattgccattgagtcatctatctctctgctgcccacgctgcttgggagagaggagtcaaggcgacgcttgagctcggtgacgccgaccgtcgcccttcttctctccagtatatgttgtgccctcctcatcgctaccaccatctactgcgctcatctccgcagtgaagtctcctccctcaccgcctccacaaattgccaggggatccctcgtcctgcccctcctccccttgcgatgggggtgggtcaagtcgccgccgccatactctacttgtcggggatgagcgggtgttgcccatgttccacgaggtggagaggcatggttggtatggatttggttggtagccgaggctatgggaggcccccctcgccagtcttccggccgcctctctcccgaccccgctcaccggcctccccgccttgtccctctctgtgcgctctcaccgacggggagagaggagatagaggtagagagggtgaggtggaggaagtgggattcacatgtcagtgggtcgtactatttttaattttcttgtttgattgacatatgggccgcacatattttgttttaattttttttagttttcaattttgctcctttatttctttcggatcaaattgctacatgggacgaatacctagtcaaataagccacgtaggtgccacgccagccaaagatgcagacaatactaccgagggatctcatttgcacaggttttataagttggaggatgtatcgtatccggttttgcggtgtcacaccccaaactggtaccgccgtacaacggcacctgacaggagcgtgtcgtagggaaaacggcgtgaaccgcttcctacgaaaccgcgatctcggtaccagtcccaggacatagtgctggtacccacggtgacaaataggaatcatagcaatccttaaaataaatagaggacttatttaccttaacttaggttgcagctcagaacagcccgagaatgcaaccgacgacacgaacgaggaaacaccaacaacagcagcagcagcagcggaaccaacgaactaacacccaacaccacaggtgacggctgggaaccaggacgaaaccctaatcttcgcttcacttcatcttctcttcaagacggaggaactatatatatatttatatagagcaagggtgagtactttcgtactcagcaagccatgggaattaagtgtttaatgcaggcttcaaaggaaaggctgttgtttttgcaattgattttatttaaactcctttttggaacagctaagtgagtgcttctcaaatgacacggatgagacggtgcgtctcgtccagtcggagtatgtgcaatgtatcagtctttgaattgattcaaggttggcacccggccaacaactttcaaacggccactcgggcctagctgatcccatcagctgcagattttccaaacattgatcccattccacaacatcaatttcacaaagcagtagtcaaacaaaactacgctaggaatcacctcacatccgcccatgaccgtgggcacggctgttcgaacagtttaataacctctgcagagggggtacactttacccacacgacgttactagccttggtcacctagcccgtgtggatcagacacgtttggtgacttggggctttcacgacaaggcatttcgaaagccgacacaggttcaccatatgccaacgagaggggtcctagaccaacaccaggttaggtcccagaccatactgtgccaggaaacccgggggttctccccggcaccaccctgttgaatccacatgtctcttggcatcatggctccccagattagctaattactcagccaggggcgtcccattacacccatgtggtcgcacttgtcttatgttcggatgaaattccaaggaaaaaggtccttaagtgcaagagtgggaaaccgtactcccggtacgttccccggtccgcgattttggaaattcatttagttcgcaagcactgacccaggtgtcgggttttccaagtcttttataaaaccccaagttttacccatcgttggatatttaaattttaggggaggtgttccaatgcgcgtgcccgaaggctcgtgcatcgaagcacaacagtcgacaaaggaggtttgagtgttcaataattcaaggagggtaattgcagctattaggattagggccggcaggttatctcgcaagccgcgcccgatttacttgtgtaaatcctattgatgtaatatttgcgaaaaagaaatacttaaatttaaattataggtgcaagatgatcaaaggtgacttgccttgctcaagatcttcacgaagcttcacgaatctttgagaaaacccgcgatcgacgaaaatccggtaaccacgaccatacgcaaacaatcaaaaacctaaacaaggaccaaaagagaaatcctatttaggctaattaatagtgccattaaatagatctcaactttagagaattactggaagtggaacggagtcaatcggagttacggatcgggagatatgaattttggaagtttaagtggaatttctgggcgaaggaagatatttgtggaacaagggggaaattgatttattaaatcccttggaaaagaaaaggaaggagggatgtgatttagacttcctagggcggcttgggcgcggcccgagaggagaggcacggctcggccgaactaatgggccggccggcgcgaggaggcggcccattaggggcgcgcggaagagagggagcggtccggtggaccgggtgcacctcgcggggtcccgggtggagcccacatgtcggcggcaaggttcacggtggggagagcgcacgcgggtgcggtgctagggtttggtgggtgcggtgtgtgggcggtgtgccgggtggatcagatggcggcgggcccacatgcagctggttggcgcaccgtggaccgcgcgcgcgcaggtggggaagggaggcggcggctgactaggtacttgacccggtcgcggccgatgtggccccgacgtggcgccttcgtggcagccacgcgggctggcgagaggaggaagaaggagaccggccgagacggacggcggacggcggtggtttcaccgggggtacaaagcgacgattcgagagggagggagtacaccggaactatgggacggacgagaggaagtgagccactggctcggattcgccggagagaggccggcgacgacaaatcgcggcggcgcacgccggcggtgagaaaaggggaaaacggcggaggggcgacgaggattcaattcaaggaggagggagcatctctggggttcaaggagtccatttccggcgtcggataaggcagagcgacgccgtggagggctagcgacgacggcggcctccgggagcgggcggcaatggcggcaaggccatgccgctcggcggcggggcttggggcttcgtctacgcgtgttcgagaggctagccgagctaccacgcgagctggaggtggcgagagagagcgaggaaggggaacggaaggctatcgcgtcaggacgggcgctgggagatggccaacggcgcagggcgggctctccggcctcgggccagggaaggggaagaaggagggtgcccggagtcctcttcggctcctcgcgcgcacgccggcttcaccagcacgtgcggcggcgaagggaggcgaggtcggcagctgcaacgcggtaacaatggcgcggtagcggtggaagagagatgccgagagagaatgagatggggaggctcggcctgggctttatagatggaggagaggtggtttgggagggggaaccgacatagggcggtcaagggcgcaaggaccgcgtgtggagagcatggttcctcaggaacgatatgatcgatggaaaggggacagccacaattgcagagtctgtaagtttcctcgtcaactatgagaaggtacagttgccgatccgacaacaaagcgatgacatcaaaggaaaaggattaatgtatgatgaaccaatggagaaattagtgcaggtttagacaaccaatcaggttgataaatggcacgcccctcccgaaggttcagcaaaggtaaatgtggatgctggttttatagaagacacaggagtttcagctgctggaatcatcattacggactgcaggggtttagtgctgtttgctgcgcaaaaaactctgaaatcctgtgctactgctgtccaagctgaggcattggcatgtctagaaggattaagggcagccatggaatggattcatatgccaataatcttggaaactgacaacatagaggtgttcaaggctctgtcacaacaggagctgtcaagatcaccctgggcagcgacaataaaggaagcgagagggatgatgtagtgtctccaaagtgtgcaggtttgcaagatcaagagggaagcaaataggattgctcatgctctcaaatggctatgaggtctagatcgtgtgtggagtggtagttgtgtgctcccgcaggaatcttagacttgatagaccaagaatgtaatcctctcttccgtaatcaataaaattccctctttgaagtcaaaaaaaaagttgggcttaaattagaaatacataaaaaataggcttagcttcaaatacgcatgtaggttttctttaaaaagaagttgtatttttttggccaaagatgtgcttgatactgttatcatgggctcgatgactttgatgtttgaacggctgaagataaaggctggaattttcatggactccaaaaggcatgtgggatttgctgggatgcatgcgcgcaggccttttcttgtggttgtttcctgatcacacggaagaaaaaagagcaaggattccggtctctcctcaggcgcgagcgatcactcgggcatcaagggacaccctctctcccacttgatgctgctcaactcatgtgactgactgactggattaaaaaaaaaaaaactcaagtgactacagtttgctcaggaggaaaataaaaactcgtagcctatcaaggtagtggctactctccagttatgtattattgagaaacgcccatggtcttttggctaattccacgagggacgggctagatgacctgggtttcaaagtctcactccttctaattacttaatattagatccttttctaatattagcgtcttttttagttagataattattgacgttttgaacaacaacaaggtcttcaagcatatctttgactataattttctattacgatataatatacaatacaacattaaatattactccccctcctaaattataaggtttatagtgtttttacacagtctttaatgacatactttgaccattaatatattccatattatgttctcaacaaatgtgaaattagcattacataaaagttactttaaaatatttaatctagtgatataatatgcataatatttagcatatatataatttgtatgactattgatcaaaagttcccgagtttggtttttcttaaaagaggacgtcctaaattaatttaggatggagggagagtaattaacttttgttataataccttttaagaataatctattgttctagtggttttaaactaaatactttaaagttattgatagttaaagttgtaaaagtttaatcacaaccttgatcaaaacgtaaccggactagttttgaagaaacataaagcccatacataaaagtttggcgtttcccgtactcgaaatgcaagcgtgtaccactgccagtcgagagttcaggatcaatctgaacaggga

SEQ ID NO: 58231 - DNA, 980 bp, Oryza sativa
ccatacccaccaccttgaccgccgccgccaccaccaccatgtccacctccaccaccactagcaccacctgcacctgatccatatccagagccataaccctcacctgagccatacccagatcctgcaccaccacctccgccaccttcaccgcttccataaccaccagctccaaaagcaccagagccatatcctgatccagaaccttgtccagaaccatacccggagccagaaccaccaccttcaccaccgccgccgcctccaccaccaccatggccatacccaccagcgccagcaccacctccctcgccataccccgatccagagccgtaccctgatccaccataaccacctcctccgccgctaccacctcctcctccaccaccgccaccttctcctccatgccataacccaagagagttctagcactagtggtcattcctatgctaaggaggacaaggattattagcaacacaaaatgcttggtggtagccatctttacttgcaagctctagctacttcagtgcaagtagtgcagctgtgtgatgagagtgaggagatggccattggtacttatagggcttgctctagtgctttttgcatggcttgatccaccagtagctcactgaatggtccagagctaaagaccacaacaatgcagcacgtagatagcacacaagagtttggacgcgtttggtgtgaaatgaggaccagtagtgtgttgtagtgctagtggttatcgcctttcttgacgttttagagggcggtgtgtgatgttacttgtgttgggtttggtttgctttatgctttctttcttttttttttcttgcttttctggaaccaaataattggtgtatgatcagtgtatctcagtggatgccatacactaccatacacacattcacacccagctagctagtcagctgatgatcattagtcactcgattcagttatagcttcacactggcaacatgattaactgg

SEQ ID NO: 58232 - DNA, 4644 bp, Oryza sativa
cccaaaatttcctagcactggtgaggggataaatgtacaggatacttcaaaatttatatcacgcatagaagaacacaatattgataaagatactgaaaaatggcaagaacaggagaggttttatgcgatctttaaatattgataaataatacatggttaattgaaagtactaagaataaattaactcaacattctgatagtcctgatcagatttgtagccttatttagcaaattttaacttctttgctatgagcaagcattgcctggtggttaaagtcacagattgcacacccgtataaaaataaactgcaaaggagcagcttaaatacctctgttcatttggtaagttcaccgtatgctatatgtagtaatctccaatatgggacctttcatgatatccaaacctgaacaattaaaaaacagaagcctcccaattagctcctagaaaccacagttcacaatagtacactgaaacaacacggaaaaagttgctctttttttcctaaagtaattatttagtaaaagcttgtaatgcttcttctttacacattccacaataattggattgtcacatgctatagctaacaaattcaggggagtgtacgtcttatgggacaaagggtctatgggagcactattcattacatggtacagtcgacatgtaatataacagctataatgataatgaccttatgatagtaatgaaaaacagatgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacaccttgtcgattgcagactgccattgcgcgtggagaaggggagtcggcgatgtaggccaccgcggagtgcagtggtgggcccaactttttgaacctgtgtattcgaaatgggaagggttaaaaaaattgttcatacacctaaaagcctaaaaattagcttgtatagttctgaaaattaaacaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgagatggcgtgccggcgccctgcgtggcactgcagcgccgcccgagccgctgtggcgctgccgccggtgcgcccctacctggctgcctcacgagtcgcgccgcgcggccgcgccgcagttgccactcgccggctcgccgcagccgcacggcacgaagcgccggccggtcgagcccgcgagccgccgcctccctgccgcagccgcaccggcacgccagagtactggaggtagttgtgaggtgggtggcggagggaggccggcgcgaagaaggggggagagtcggcgaccacgggatggaggtggttgtgaggtgagcgggggcggggagatcggtgaggcagagggacggcagcgcgagtgcgacgcggcggaggtagcacctggcggcgcttcgtggaaggagatcggcggcggcatgtgagaaggagagaggattagggcgtggaggagagagagagagacggcgagcgtgaggaaggcgtcacacgcagaagagtagccgttggattaagatgttaccgttaggtggccgagatgtaaattgtactccttctatccgttggcacgcttgtacttaagaagtatcgtatttgtttatttattcgcacaattatacaaagtacgtgagtatataataaaagttttttttcgcccattaaaaactaggtatctgttggttactccttcatatatttacaaaagaaaaatcagaaatcatctccttttccgtaggacgtttccggcctactccttcccttttgttcctcgtgcatagagatggcaacggagaattcaccgtctggggttacatccgcgtcaccgttcccatggtgatgaaatttcaccgtccctgtccccgccaactatgacggtgctacattttatccatccttgaccttgcacggtccgtcaccgcatgtgctcatcttgcttcgtcaccgtcggagctaatgggagaggtcaaagccatggccagtagccggcaagggagagaaacggtggggtggcggcggagatgggttgcaataggtccctagctacaggacacgcgggtcaccgcgggggacgaggacggggagtggagcactgtccccgcccccgcccctgccatccccgatggtgatgagttttgcaccactagatttcctgtggatggcagatatcatccatcctcatcccttaggccttgtttggttaatcccctttagagagggattggaggggatttatttcacacctattatggtgtggaattattccccctcaatcccctccaaaccgaataaggccttaatgtgtgatttcaccgtggggaatcgatgatcgtccccattgccatctctaatcgtgcggcccatccggcatgcctttgtttcaggctgtgccctgcctcgtgttgacaagtagggttgatgggaaggcggcggtgacggaggcagccctgcgccggcggcggagctccacatccttcgatctgaggtggggaggagcggcgaacttgcagtcggatccagtgtcgccgccaagctccccgctatggtcgccgcccttgagttccgcgagctcctccacactgacgacctcctgctccccggctccccatcgcctgcccctgctcgcccgccgcgacctcttgcttcatgccactggctcgacaacacttgcaagctccaccaccatgaccttcgccatcgctgtcgagcgacacgaggtccttcgaacctcctcgctaaggtccaagtcctccgatttgcccgcgatgcagaaatgacaccagtcgacgtcgcttgctgctccccgcgctagcgaaccccgcagcgtggccgtcaccgttgagggccattagctccatcgcgccgaaaccacactgttgtcgtcgtctccatgcgacgtggggcaaaggtcgatgcggcgccggtgcccatgcgaccggagggacgactggcgctcgcagccaagtccgtcgccgccgccgtaggtcccattgccggcgtgcggagggggagagggaggacaagggggagagagggctggcgccggctctgacgcacacatcgcccatgtggtgagggagggacgacagcgctctcgcggcgtggggaagagatgggacgggcagggaaggaagtagatggatagagtttggggataggagggaaggggatagatttggttgtttttcggaaaaaaaaaaaccttgtgtttttcatgtttacagtgctgcccctaagagcagaattttctcttcttcgtgtcgcatttctttaaaagctaggggtgtactgtataaaacggaacatggtgtcagtcggtggaagtacgtgcgcgctattccgtccaaacacgaggagtctttttttttataaacaccaccatgcgtcatttactacaagaaaggttctgcgtgacacacatgcaggacgagactggcacaa

SEQ ID NO: 58233 - DNA, 3088 bp, Oryza sativa
tcttttaccgtacaattagttcagcgatttgtgcatgtccaaaactgctaacaccatcattactactattgttgatactatacatcgatatacactatccaggacatactaatatctaatcattacggagtaaaatccaagatgccatgcacagatggtaggcaaaaggacaagaaaaggagaagccaaggaagatagagagctcacgtcaatgtctgtttttaaactgcagttacatatgtaattatagtgtgattctattgtagttacatatcacttacacaccacttacatatgtaattaatataattttaggatttacatatataattttagaacttacatatataattttgggacttacattgtaaatacactaaaattacatattagaaatttataatataaatacatgccggctatttttttataaaaaaatatggcgtcataaatatagctactccctagagtatatggagagtctataattataatgtgtagttgcacttgaacagtgcctagaagcactctgccagtcatacttgtcactgcagcacccttttgtccatctaacctagcatgctttttgttggaggattttggtgagttggactgggccattctatttttgtaagtgtttggttgaaaaactccatgggttgagttagacccaaaagggaatactatgtatatatccaggttggcttgatccgtggaaaaattggtgaactgttttacccacctcctttagcgcagtacacatgaggcgtatgcttgtgaaaaagaagaagatagtgaaaatacacgaaacgagatgagacgttatcgcatcattaagtattaattattttaaacttaaaaaatagattaatatgattttttaaaacaactttcttatagatcattcttttataaaaacacacatacttcgggaagcatgtgcttagaaaacgtgaaaattttctactccgtgtggtgctggtgaacttgcttgagctttttcgtcgacacataaaatgatacaggagattagagtatgattaatcaactattaattattataaacttaaaaatagatttgtttgtttctttaatgaaatatatgatatttatttatttttaaaaaaacaccatttagcaatttagaaagcgtgctaacaaaaacaagaaactttcaatttggagttgataaaaggaacgcagactaaatgaatgatgacaatcaatttcgcatcctccagaagtatctaaagtatcaaacctcatgacctcatcagacaaaatggtcaagcctgggttagcttgagccttagaaaatcttattggcatgagtataccaaattagtataacaatattcacaacaatttcagatcacattctctatcgaatatcgatcccataaagattgcatcccacattcctttgaattctagtgaataacaagggaccaaaagcatgccacattcctctgaattctagtgaatagcagaacaccaaagaagcaatgctggcataaacaaatcttccggttctcttctctctccttttttttaataaatccccaaagggacacgaatagcttgtttgttagtccaaaatatttgtgccaattgtttgttttcactctgccttttagcgcctaggcaacttttctattttatcaatagagtatcagggaaagcttcttcaacttcagccaagttattaccaattatttctgccccaagggcatcaatctcatagcgcacctcctccatgtgctcgtttatgctggtcactgcctcttgaacaccttgtatggcctctttaagagcaccatcatactcagcatctgcctctgcatcctccgtgccagcagcctcggttatctctttgacatgcacacagacatgttgagccatattgcttgacctgcaatctgcatggttcaccaggcgttccgaaggacgaccagctttcttcaacacctgaattcttgccgtctgaaataatcagagattaaaaaaaaaactttgttcagtgaattgagaaatttccaagctgagacctacagatagattgtgcgtcagatcaaaccaaaacgtgattagccacaacagctagaaacaatcgtttgtcaggcttctggactagttttgagtttaattttatttagcagcaatgccatgcgttgattaatgaaattacttttccctcacaaagaaaagatgatgaaaacaaaagtatatcagaaaatagttcaatattaaatcaaggtattgctgctagttgctagacaagcaattcaaacaccctaagtaaacataacaggctaagtgcaaaatatttcaggggtcatcagtaagagagtaataggtgtagttttcaagcaggaatatgccatcctattgcaattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccacaattaaaagcaaaaaatatagtaggtaaccaagtaatttggtttttgaaaggaaatcagttttcagttgaaaataaagcataaggctgaaccatgtcaaatttcataacaacacaatggagtcatagacaggt

SEQ ID NO: 58234 - DNA, 19168 bp, Oryza sativa
  unsure (1)..(19168): unsure at all n locations
ttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttctagtttaaaaacttacatacccaaaatggcttgctcttcatattcaattcatcgcctcaaaaatcacattcagagtgcaatttatcactaaaaccacaaagatcctgcctacaggaatcacatacacagcactctaacctcggcttaaaagttaccagggcaatgaaaaatccccccctgattctaaaagttactccaatcctagggttttaggggcgggactgcacaagttgcacggacccagcaagcagcgagatagtataatatataccttcggagcgtggagtacgcctcggcgcggcgctgctgcacggcgaggaacccgcggagcactccggccaccctcgcgttgctccgcccgccgccgccgcagtccatggcgtcgctgccctcagcggcagccgccgccggagggcactccgccatcgggtcgccgctggcgctggcgctgacgctagcaggatccatctccgccacgctacggccgcctccgatctctccccccttgatctcagctcttcacgaggtgagcgagatttttgcgtgctccggccggcgtcccgccctcccctccccttcccttctctctctctctatctttttccggcccagagatcgggtcggttcaggagttttttttaaaaaaaaaatcagttaagttaggaatcgaagagcaaaccgaatggacatttaacttgccacttttaacatgtgctaattaattatttatacttattgtatatgacatgtgggtccttatatgtatatgatatgtgggttcagtgacaattcttttatcaccactaatagataggagtgacaaataattaattattccgaatcatttctctcggttgttaaaaaagaaaaatcagtctctctccttgttaagccgtttttcttcttgttatgaatttcgcgtgtcaaatagtataagattggggatttatttataggagtataaattactactgtacttgtaagtttcactagcctggtccagacttaggctgtgttctttcctggttgatctgggtgattgtgagtgagttttgtttcgttttccgcgtgcacgcttcccgaactactatgttttttttaaaaaaaattatataggaaagttgctttaaaaaatcatattaatccatttttgaagtttaaaatacttaatagttaattaatcatcatgtgttaatggctcacctcgttttgtttttgtgtaacctaccaatctcctctatctcttctcctcaaacacacccttagactattaaactttatcacactttatactttatgacacagttgcttatttcgttgtcacgtggtggcttgccacagtttttttatccttcgacctgcatacacattcttgtgcaaaaatttaccaaatctatattcactaaggccttgtttagttgaaaaaaaaaacttttcacccatcacattaaatgtttagacacatgcatagaatattaaatgtggaaaaaaactaattatacagtttgcgtgtaaattgcgagaaaaatcttttgagcctaattgcgccatgatttgacaatgtggtgctacaataaacatttgttaatgacaaattaattaggtttaataaattcgtctcacaatttcttaacgaaatctataatttgttttgttattagactatatttaatacttcaaatgtatgtccgtatatctaatgtgacaactattcccaactaaataaggcctaatttgttagccacaccatagtttagcatagagaatgaagcaggggcaaaatttgctacgggttaggtcatgtttaatgtaggttaatgagtggattattcaaatgaattatgtatttgattatagaataaattaaatattttaagaaataaatatagtaaatactccctcctctatataatccagatttataatatataatccagatttataatggtaggttatatctattttaagacggaggatttgtactgatgggttatctatttttgagactattggagtagctcaaaacaaatactagtctaagtaactcagagcgtgaaataaataatccatttcaataatccaataaatgttcggtttcatatgcaaaacgatcacaacaaaaatttaaacgttaattttaggccctttttttggggtgtgggtgcttcgtgttagacttttaaccgcttgtaagacatatatatatatatataagtgctaaaattattcttcgttgctctttcattttcttccccgcagcttatcgccttcactcaaccaatcagagccttgttccgtgaggatcgaaatgagggtataacagaaattgcttcatctgctggtcctgaacatctcacgattagcaaaatgaatccttgttacattggccagtcccccaaatgataatccagcggtatacagttcgcaagtgccatggaaaaaatggctgcgtcgctgccgttgccggcttgccgcaacaacgtcgcaactcgttcacccgtccgatggaacaccggttcctcgttcctttctgggcggatgtcccatgtcgcttcttcatccatgcaccgtttggctgaccccattcctaaagaaagatgggatggatatgcatatgctggagtagattatctggcaaaccagcataaaagcaaacacaagatggaatttgcgtgacaaaacaatgtcctcagtattataacttgacctggttaaataattggaatcggcttaagtaaacaagcatgagctacatgagtttctgtcgttaaggctagataaccaagctaagataacaagctattagacaactctactatcccacatggtacaatgtcatgaatgccatgaactctaattcagtgcattatgatgcatccatgcaaaagagggaagcaatttctatttgcttgcaacagcaatgaggtgcttagcaggcaaatgttttgcctcgctgaatttcaccaatagaagccatattactggatttaacttcaaactattacagctagaaagataagtgataacagcactgagtgacagatcactaatctgaaaatgtcttcaagaataagagaaaagaaaaaagaatggaaggccggctagttaggagtttaacagaataaacactaatcgatgttagaatagaacacaggtgcaacagttcaacacaaagggcggcatgcatggcaacatagccaactaccatagcacagcagtgcaatttatgaaggaaaagcacagtttcatctgttagaaagttctaaaatgcaatatattcctgtagtcaagattacctgtatgcagaacaataatgacagactgggttgaaaatactaaggttactctacacaatgaaaaaagatcaactctttgtttagaaacatgtctgcatgacactcccatgcgggttaggataaaataagtttcgcaaatatgtaaaaaataatagaaaaggagctctgtacataaagcatgtgaaaaggtaacctgcattgggttcacaggtcaatttaaataatttaaaaggtaacctgatcttatgctgaaaatctgcacttatttagccaaaacgatgtagaaaagatccatggttctttaaatccacacaagctcttttacaataaggtcacaagccctgatggccattcgaaaatctaaatagttgtacatactgcttaattttgaaagataggattgaggaaacaaagttcttgtgaaaactttgaccactagagtaatcgatttgccagaaacagcttaaaacagcaagtttataagtgcgaagcaggaacacgtagaatcatctggccacagtaaaatagttataagcatcctgtaaaatagcaaggtgaataaaaataagtgaaatgggtctgcaaaaagttaaaatttgtatgtacaaaaaataagtttctgaaaaaatgatatacatgtactatggtgatttactagcagttaaaaaaacgttatggaagggttatgaaataactaatatgttacaacctagctgaacagttgcactgcatacgcatcaaaataaggttaggagcaaactgagtcacatgagaatgacaaggcacaacatgaaccatgcatgattgcgaataattgtgaatgactatggatagtgcatgtaaatatctttggatacttttggtaaatccgagagccagacatgataaagaaataaaccagaaatcaagcatcatttaactaaaaaagagaccagaaaagcacgtgatttcacctctagcaaccagcctacgcatatctcctattattatttagctgtacttcaatttcttttgattaatagaatatcaagcttcccaaatctttcccaagctatgcctaatatagagtatgtgcaatagaattattggaaacgattcaactaacactaacataaggcattaactccctgaaattttgattgcaaaatgcagacttcagattcttatggcaacaattgtggcattaaagaaattaacacaagatggcatgttatcctaactttcattgtgcatgcgaagcatctacctaaatagcaataccataaaaagagtaccttggctcatgcaaaagcaaactcagtttaaaagcaaccaagaagagataaataatatagcgactcataaagggaaagctatttctttaccgatgtaaaaaatgcaagatcaatttcttggcagaaaacacatgtgaaaactatttgtaggttcctatggttgggacacaatcacctatccggatcttacctaatgacccatgtaatttcttcctgggcctcctggtggagtactgccatacccaccaccacccccatagccgcccaaataaccaccagcaccaggcatcccaggcaaaccactactacccagtcctgcagaagcccctgggttaggcaaccctgaaccatttgcaccaactcccaggatgttgttcagacccaaccctccaccctgggaggcaaggatagctgtcaaggcctgccccagagcaggattcacccctgggccaccagctacacctggcaatgaagtcaaactggatactggagatggcatcacatggcccccaacagcagcaccaggcaaagaatgactatgagctccataaccaccagcgcctttcctcccgcctgaagtgccagcaccatacaaacccccaagtcctccacctttgttgggctttggtccatcaattgccttctggcagtgcagcacaaccccctcgaattgcttgtgtggctcctgaagcgctttcttagcactatcgagggtcttgtagacaaatagagcaaagcccttcggcttcccggtaaccttatcgagcccaagaggaccctcctcaatctcaccatactttgaaaagaactgcagcagtttctgcgggtctatgtctgcgccgacattgctgacaaaaattttccgctgcgtgtactccgacactggcggcaatgccagctgcgctggggctggggctaccgctggggcagggttagtggccatgccgcccggcggcacaggaccaacagaggcgagctggcaggccgtggtgcggttgccaatcttcttctggggctcacggagcgccgcgcgggcgccggaccggcggctgaagaggatgaaaccgtagcccttgcacttgcccgtggcgcggtcggtgacgaccctgaggtcctcgatctcgccgtaggcgctgaacgcctcggtgagggtctccgcggtggcgtcccagccgaggccgtggacgaagatcttccgcagcgccgggtcggcgtcggccgcgcggtggacggccgtgagcacgtcctcgtggctgagcgccgcggcgctgagcagctcaacgagctggtccttggggaacgaattcagcagcgcctggatcgagtcggcgtccctctccgccgcctcctcctcctcctccccctccccctccccatcctcgtcctcgtcgacctccacctcctcctccacctcgacctcctccacctgctcttcctcgccaccgccagcctcacgggacatcatcctctcccccgcgccctcgctggataggcccaggggctgcgacgagggggccgggtcctcggctagggcttcgggctgggatgagggctcggcaacgncgncgacgtcggcgacgacggctgcgactgctgcggccctggcggctgcggacctagcggcggcgggggatttggaatcgagcttccgcttcttgcccatggcgacggcgagcgcgaggcgtgggggaaccttggggctagggtttcgacggctgtggaggggaggggaaaggggggctgtgtggtgtggagtctggggctcgcgactcgcgaggccacgcggtcgtggggctttcttggttaacggcgacggaacgggggctacacaccgtttcccacttccgtgtgtggccagtttcggtcgtttttcccaagacaacaatgccacaatgatagatccaaactataaacagtacttgtactattagaacgtaagttcatcttttctttttctcaatatataaacttgactttttgagagcggtagatatcactatacttttgtattgttaattttgtctataatttttaacaatcatctgccttgaaccattttttttttgaaaaaatatatatacaagagaatatccgaatccattttcaagaatgaaggtgttcaacaatcatagcaatataacaatattaacaatagaatatacgcgagtcgaaaaattgtgcttctttagatttatcgaacctattagtgtacatatttatctttctaaattagcgtggaatcattgtaataattaagtacggctttgtgcttcttatttgcagcggccggtttatccattatgtaaaaaacttccgtgcacttaaaatagaaaacaaaaatacaaaatatccagcaaagttgattttgccccaacgtatgtacagcagtgcgaagaacgttgaaaatcttattgtcaagaagtgtccaatccaacaagagatgtaaagattaaaagtaaaccgtataaaatatcagtaataatatgggtttagctttacgctattttttctataatggaaataattccctagcttggtgatcttttttttatttagattttcctttatttctattaacttaaatggagatatccaagacgtcagacaaaagcatagatattggttaatagaaaccattggagtggagataacgaaatcctaatttaagtttataaaaaaacaatcttccaagctccatttaacacattccatgctgtagtacaccagcaacgatttcaggcggtgaacaagctggaagctaagagcaatagttcgtctaacatgtcagtttggggatctagcttcaaaggcttcattggtcaaagtctgaggcaccaaaaaaagagtaatctggatcagcagatgagccaagcaaagggatgtactctgatcctctcacatgaacactgaagcaagctgcaaaatacataaacactgtcaaacgtctacaaacatctagcgatatagtatcccagacaactgcatatgtcaaaaaggtaatactgtactaatcaactgcggacacatgaaaaaaaatgatgctagcccatatgtaaatattttcacaaatgagtggaacccgattcacacgatacactgaaataatttattttccagctgtaatatcaagtttgtgaattttgtccatactaaaacattaaacaaggtagaacaattgctatagttcaatacggtaagccgaggcaaaatcaactactcaactacagtctaacatgcaccccccccaccccccctgcaatcattcacgaggttaagaaatgactgacgaaagtcatgttaagcattttctattttgaactagaacatttggattccatcaatccatcacattaaacacttaaacttgactagtacatgcttccaagttccaaaaaaacttaaaatcaacttagttagctagttcaagtgggggcgtccttagaaaacaaaggattcaacaaaatgtcagagttatgaggttctccgtgcatagagaactaagccggttaaaaacgggattcgatatgtcagttgtaccaaaaagaacactagatcttggataaaggaacacgtcatcaaacaaaagtgtgccattttaagaatcgggaaaatatagttagaatttagcagatatagaaaccacatctttggttggcacaaaaattattaacagtcatttactagtataaatgagcattagaaatgaagatacctctgaactaaggaaagtgcatgttaactactaatctatatagcatgttaaagagtacaagtctatataacatgtctgtatatagtttcacttaaggaaaagataatatgtttcatctattattcatgttgtgataagtattgatacgtccaaggattttatgtattttcaaataaaggtcataaatgaggactctggtataaagttgatattgttgggcatcaaagaagtgataccattctcaattttcactacactttgcagcatagtctccatcttcttcttcatctcactattgtcatccatcagaggcaccacaagggtcagctccctgtatatatcacgtacaaatgcacaaatgtttttggcatattcaacttctccatcagatatacggccaattgcaagcctcatcagctctcctgacagatcggcaacctaacatattgacagcacagaaataccctcaacaacttcaagcagacaaagaaaaggatatttagcagaactaaattttggacagttgcatttacccctaaaacatagtcgagtacatttatctgtaagggctcaacagatttgtcacccagctctagcaaagaatcattgatttcagcaagacttaataaagtgccagtcttgcaaaatctgcagaatgttgcagcttcaacatattcttgtacctgaaatagtcatgacaaacatattggatccgttacaaacctagaacagaaccgatgtaaaggaacaacatttatactaacaccaaaggtataggcccttctgagcttccagaagtcggtcccttgcagttcttttaccaacttcccaatgtattggttaaccacaacagtgagatcattttcagcttttgaaagaacctcttccttgttattcttacttatcctgaaacaaatcagttcagttataaattaagtatagcagcaaataaaattgcaaagcagtataacagagagtaggtcaatttggttattaactatgaaatcatgaaagagacttttgagatgagtatgtatagttctccaatgttgtcagatgaatggacaattttgacactaaataataacttgaatgtatcatttgcacatacagcttttatcaattgccaaaggttgagactagcaataacttctcacaacgtgccacgagatgaaaataagttcatctaaaatcttgtttctgatcgccttcgatttggaggaaacaaatactccataaagcttagctcatggagagttcctgattgtccgtacagtgagagtaataagttttgcaaaaccagaatgacgtttttacactaagaataaactagaatttactggttcattgacattccacaataattttagtatcacatggcatactaattcataacaaactaaggtaatgaatgatacaaggggccctaagaatcacattatctgtcaaggaaacatacatggataattctcttcctttatttaatgaagcaatgtaatgccactagcacaattgtttgcttgtcaaattacctgtgaacctgaaagatggcctttttgctgttcattgtcaaatcccgacttgctttcacaagcctttcccttttatcattctacatatggaaaactgatgagataatataaaaatattgctaacttaagaaagatacagcctgctactaccataactgctttcagcatgtacaaggggaaaaaaatgttcaactgaagaattacacactaagagtagcagtgccgtccatatcacacactaaaccaaatatacatatcttaagcagagctacctagcatctagttcaagcagctttgaggatcagtttggtacaaatgtccaataacaataagttttgcagtgtccacaccccgtgagggcagtaatctttacttgtgaaaacacttctcctaccctacaccactaaccggcactccaaagtgatcgacaaggctatctcgtcaataatgcactcattagcagaagccagtgatcgcataggctcaacgggaatttctccgagcacctggcccgcacaagatcttggcaccagatcacaccaacagtttccccaaaaaaaaaatcatgcctctactctactctaatatacgacagcgtcctctttgagcgcgccgctgcaggggggaggaaatagctcgagaagagagaacgtcgtcgcacgccaaggaggcgagggacgagcgctctaacgcgtgcgtacaacgtaccagggtgttgaggtactcggcgtgcttggcgaactcggccttcatcgcggagcaccccgccgaggccgaatgcgccgtcgccgccgcgtcggtggccatcgtcctggacctcttgggcgccgagccggcggtggaggctgcagaggagggggagcagagagggtgagaccgcggagaggggagaagaccgaggaggagagggaggggagtgtccagagcgtacgcggaggagggctcgcgcggagggttttggcggggtgggagtgggactggggcgccgccatggacgtggtgggggtggtggtgatgggaggaagaagggagggggcggtgacgccgcgcagggagaggaggcggcggtggcagccgcgcaggggcaacatctgtcagattgtgggccccgccccgtctcggcacttccgtttcctttgcctcacttggtgcgatttgtatttgtaaggcataatatgcttttttttattattgtttttttagaaaactaaaaaaaaattcgaataaggccttttttaatggtggtgtttgaatcagggactaaactttggtccctgtcatatggatgaatttggagtattaaacatagactacttataaaactaattacataaatgagagttaattcacgtgataaattttttaagcctaattaatccataattagcgcatgtttattgtagcatcacataggctaatcatggattaattaggctcaatagattcgtctctcgaattagtccagggttatagaatgggttttactaatagtctacgtttaatatttataattagtgtccaaacatccgatgtgatagggactaaaaagttttagtgccatctaaacagggtcttagttctcaaaaaaaattccaaaaaacgtcacatcgaatctttggacacatgcatagagcattaaatatagataaaatgaaaaattaattgcacagtttgcatggaaatcgcgagacgaatcttttaagcctaattagtccatgattagccataagtactacattaacccacatgtgctaatgatggattaattaggcttaataaattcgtctcgcagtttccaggcgggttatgaaattagttttttcattcgtgtccaaaaaccctcttccgacatctggtcaaacgtccgatgtgacacccaaaaattttctttacgcgaactaaacaaggcctatgattaagttcaggagaacccacccaacccaagtacatcgacgaagagatacacggaaagtattgaaccgtcttatcataaaagaggctaactgaattaaagaaacaaactttctaatgaaactgaagagtagcataggagcagatcgatagggtattgtgtcatttgtcgcaatgattgcgtccttaggccttcgttaacgtgcaatccgcttgacatacaggtaatttccttctgttgcctccacagaatgtacacgcattagaggtttgttgttgatgttgcgtggtgtggtgttcatcgttaaatctgaagagcactaatcgcaaccgcttggaccaagggtgcacaagcagtctatactcaacccgaacaatgaaccctgcatggttaccgttgcatagaaaacgtcgagaaagatgttccctaaatccaaccaaccttaatcaagagagaacttggacggtggcagtagaacatctgtcttgctagatcaagctggagtacatcatatgaatattgagagaaattaacctttggaaaccttaaaccattaaatgctataacatgtagacttggttcaccacattcagttgaacaagcatgaaatccacaccaacgtcatagtcttcgttaagcaatacctatctactcacctactccatcttgaccaccgaccatcatccgtagcccatccatcaatcgagggagctagccaatgagcagcaggtttggatcaagcaactgttggttcgggcaaccccaccaccagtggaagggcgcagaagtctccagccaaccccatccaaatcaccgaaaagaggaacctgaacctagcattgaggcatcggatccatcggaatatggctgcaccgaaacaacagcttcaagcctccatgatgatttagccaataaagtcgatgaagggactatccaccatggtctagcatgcatgacacttgagatgtcctgcaacacataccgccaccatgggtcctaccaccttcagcaaacgctatggacatgacaccaaaacaggattaaccttaaaacacaagaggacttgacatggaactcgaacactaaactatactacacttattaaagaagaaggcccgacccctcgtttgaccatcaccgacggaaagctgtcggaagcaaggtggaaaaggggtcatggaagggttttactgtagctctctctctctcttcacctttgatgttctccagaagcctcccttgtaaggtaggctgtttaaatacaagaatatgggtgtggaaaaagacacaagatttatggaatatataatattgtttatggagtttttatattgaatattgttcagaactatattaactcatctgtactacctgtctaactccgtccatactatattaactcattaatactacctgtctaactccgtccatacaccagtgtatagctgtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtcatgggggccaagtcgtggcccgcgctggaggaggctaggcagaaggtcgccgccgcggaggccgcggcgaggccgggggcgggcaatgctggcggcggtggcgaaccagcgaagggggcgcaggcgcagcagccgtcccctcccccgccacagtcgcaggtataatctggtgctcgtggccagccatatgcttgtttgctatggctttctatttttgttagtttagttcttaaggaaattttagtgtatggtaaagtttgctcacttcggtagatgtttatagtatttgtctctctatacgaaataggtataggttgggtctgggtatgcattggtctactggtgagtagtaaagtaaagcttggctgtttttggaaccacgtatttcaggttcaactttctcgagtgtgttcaactgtccatgttagtttttttgcttgacaagaccgcttgtccgcttatgttcaaagtaggttacacatgcattttgcattatgatgtaagtttgctatttgtcttagaagtaatgttctctctcaagtcaaccatgccccgacagcaagtggttgatagattataggtgtcatattttgatacgtaggatttgtgcattttttgtaacctattatcagattttgtttccacacaagttgtgatccaattggatctttgtatgattttgtccactgtgtctgtagccatcacattattttaggtattgctgtttggtcgcaaacttgcaatcattccaatgctatctagacggttattcaatcttaactgaacatgccttttatagctatctcctttgtaagactgctgggatggttacctaactgactcccatggaagcactttcttgggtgctatggcaatgcagtacatattgaacttatttatcatcgtgggggtaaatataagccttgcatttgtggcagttttgtaacgatcatgatatacatttatcattgttaagatgcatgggtggtctatcccatgaaactgatttgttccaaggtccactcggtaagatcaggaaaacatcattcttatttggtttggttccttgccttccctgtaaaccaaatagttgtcaaacaggtgttttgtgtttcacatgcagactaaggataattgtatgcttttcatcaaatggtttaaagtcccttaggagttattttttttattttaatgttttatgagctgaatatacattattttgtcactgttctacacaagcattttttttgctgatcatataagcattcttcctgttctgatttagtctgatgcaaagggggaaacacttgtttgtaggcacctaatcgcacgcacaagtttgatggccatggaaatcccaacaagaataatcaagcataccatagaaatggccccaagagacgttctcctgctgcgaatgggactccatcttatcctgccgcgatgccatatcaccaacatccagggcaacctttttactaccctgttattcccagtccagtgatactacatgaatatccttacccaccttttgctgttccggttccaagtcatgacccgcatgctggaaaatctggatatgagaattctatgcctgcttatgttccagtagatcaagctggtggcaatgaaggtaaccggccagtgcctccacaaccaaggggagaccttcatgcttggaggcctcctgttggtgcaagaccccagcctggccttgaaggccgtggccattttaatcacaattggcagaatccccagatgttcggtaccagggaaaacacaagtgtaccacaaggtgctgggccaagagctttcatgagaccaatggcacatctgcctcacactctgggatacataaatggtccaccataccctggtaatgctatgctcactgtaatggcatctcctttcatgcttggtattagagctttttttgcaccaatattaaaaaatgtgttgacccagggccaatgcctcccatgtattattacatgcctgctgtacccatggagccgatgagaggtccaccacgttttgtccaaaaccaaccacctcctcatcctgttttatctcctgaattaagagctaaaatactgactcaagtggagtactattttaggtaaattcttatttcttctattgagttgggtagctattttatattgggttaagtctgatttactccccctcaattatcacaaaagtacgatctaccccccttaactctaaacaagatattttacgccctcaaacttttaaaactgtacgaattaccccctttgcactatattgggtagtttttgcataagtggtgtctatgtggcaacaaaatcagtggaccttttttttaagacctatggacccacctcccattctcctttgtctgtgttctctctctgtgttcttcctacacgagcaagagcaaccatccaaatcggagatctctcaaaaccacatccggcatggcagcaacagttccatttctgtgactcgcctgatgcaatcaataactggctttgcttgaagggatgcctcccactgaatccaaggccatatgtcatcgaagtatccagctgcatatgactgattacttcctgattgatctctctgttgagctatgatgcacacctagatggagctgctgcacatggttggagctcgtcaggtgtccttttcctgaaagttcgcgaggagatcgccagcagcttgaatgggcctggctgtggatagatcggggaaatcactagcagcttgggctccgctgtcgctcccgcctcataccagtctgccactgttgtctccatcgtgctgctacagtggagataggggcagggagatgcgactcggttgctgctcagaaccagatgccatcgcgcctaaagtccaaaggttgcaggagggagaggggagagaaataagaggggatgaagaaggtagggagaggctgacaagtgggtctgattccacgttggatgccatgtaggcttaaaaccaccatatggttagcagaagggggtaaatcgtctggcttaaatagtactttttccccaaggaagcatgatggttgatgactagaaaacaggcatttgagcatttacactacctgatagagttttcatgcaatttcagaaagcagtgacaagttagtcccattgtatgtctattgaactttggaatatatgaactacaatttgattttgtcaatttcattgttgttatcctatatgcaaacactgacatgctgcactactaaaactattttgtatgtatgtgatgcacatgggttatcatatgcacttttatcatttgtcattcataaggtcttttatttacccattatgatgcttttcagtgatagtaatctggatcatgataattttcttaaatctttaatggacgaacatggctgggttccaatttccaaagttgcagacttcaatcgggtatgtttttctcagtacttaaacttttgctatttcacctttatattatgccatataactactctgctagtttggcttgtttagttgttttgcagcttaagaaaattatcaaggatatacatctaacaactctgttattgcttggttcatttgcagcttaagaaaatgaccacggatatacaactgattgtagaagcattggcaaactcaagtcttttagaagttcaggtacgtttaatgcaactattgttgcttagatccctcttagaatgtcatctctcttatttatcttatgccttttgtataccaccaggatggtaatatgaggcggcgttctgactggtcaaagtgggtttccttgtctgggacatctcttccgagtccatcttcaaccagtatggataacactactggtgaatgtaataaggatgcttattctgaagatgaaaagaagcctcatcctcgcagcgtag

SEQ ID NO: 58235 - DNA, 848 bp, Oryza sativa
atctactacactgcagattctagaaatggtatgcatataattgattctctttatgtttgtttaagcagggtcgatgatgaggaagatgatttttatgttgatgaccaagatgtgaacaggctaataatcgttacgcaggttagatttcaagtagtattttgtattgctagctctgtgtagtgatatacctccttcagtttgcagctccttgccttcgtaatctgaacacactgggcttgcctttttttatgcaccatgcaccaataagttttgggacagtttcaatggcgttggatgtttaactatttctaattttcatgttatgatgatttacctgatttcttattttttgtatttataatagtcttgctatttcccttgctacgaatcctatttgagcagattatgttcatgcttaataattacataacaaataaatagttgattgctaagtgaaattttatgctttatagggacatgccctttttatttcatgatttttgacttgattgagatacatttccatgtactgtgatataccattattttaacattatttgctttataatgacttgaattttctcatctctaaatattatatgttaattagcaccttagcatccatcaagcaaattttgcagcacgctatcttgtatgctttcaccatgttaagcaagtcttgtcttggtaatagtgcaataaactcttgtcaactatctgcgttacaggacggacctcaagcattttcaaaagaggaaatatcaagaatcaatgaggggttatattactatgaggtaatattttagagcataaaaagaacaagattatcagtaattggggttgtatgt

SEQ ID NO: 58236 - DNA, 2966 bp, Oryza sativa
  unsure (1)..(2966): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagaaggagaagcacaagcatagcaagcatgatcgctatggccaagctcaccttgggatgatcttcggctccgactccgagtcaagctcaagtgatgaagaaggagttgccacgttcgccgtcaagccttcatcaccaccgagactcttcaactactcaagtgatgaggatgctcccatttgcctcatggcaaaggagcctaaggtaccctctcccctcaagtcatttaatgttgatcttgttagtgatttggaggaagatgttgaggatgaggttatggatgacgagttgttcaaatccatagccaaggaatccataccacacttgagtgagttgcttaggagaattgagaatcaatatgcaactcttgagaggcaagaggaattgctcattcgtgagaaagagcggtctcatgaactcaagagtgaacttgctaaggagagagagaaaaatgaggctttggtacggctttacaagcaaaccaaagagtctcatgctaatcttgaggtggcgaacgctcaacttcaagagagagtggatgacttggacaaagcttacctctctcttgaagagaagttcgaaaccttaaagaatagtgtctctttccctagcgaggcatcgtgctccaaaattgtcccaagcaatgaaccatgtgtgaggtgcaaagatattgatattgaaacttgtgctactaactctacttctttgagtgctttgcaaaagcaaaacgagaagcttatgggactccttcataatggcttacttaagtgccatatgggtagtaaggccctaaaggagtacctaggctatcaaagggacaacttcaaccatgaaggtcttgggtatgttcctccacctaaaggaagggtggacaagagtgtgatgatcaagaagccccaatgtcttagcaactttgttaaggccaaatgtatccttcctaatgataatgcttctcattgttttgatgcatcttatgttcttaggaagaacgctagtggtcgcgttgttgctaagtatgttggcccaaggggtaaaaatatttctatcaagagagtgctttgggtgcctaaggcacttgttactaacatgagaggacccaagcaagtatgggtacctaaaactagaaattgatctcttgtaggaatatgtctccggtggaagaagttgggtgattgatagtggttgtactaatcatatgaccggagaagaatcaatgttttcatctcttgatccaaatggcacttctcaagagaacatcatctttggggacgatggaaagggaaaggtaattggattgggtaagattgcaatttcaaatgacctttccatttccaacgccctcttggtaaaatctctaaattacaatctattgtccgtttctcaattatgttccatgggattcaattgtctttttaccgatgttgatgtgaccatatttagaagggatgatttctcggtagtctttaagggtgttctcaagggaaagttttatcttgtggatttttcctcaactaaagccaaacatgacacatgcttagtggctaagtccaacatgggatggctttggcatcggaggctaacccatgttggtatgaggaatcttcacaaacttctaaagcacgacacatccttggactaacaaatattcaatttgagaaagatagggtgtgtagtgcatgtcaagccgggaaacaaattggagcacatcacccagtcaagaacgtaatgactactacaagaccgttggagcttcttcacatggacctcttcgggccaattgcttatctaagcattggaggtaacaaatatggtcttgttattgttgatgacttttcatgcttcacgtgggtgttcttcttgcatgacaagagtgagacacaagccatcttcaagaagtttgcaagaagagcccaaaacgagttcgacctcaagatcaagaacattcgaagcgacaacgtcaaggaattcaagaacacgtgcatcgagagtttccttgatgaagaaggcatcaagcatgagttctcggctccatactcacctcaacaaaatggagtagccgagaggaagaatcggactctcatcgagattgcgaggacaatgttggacgaatacaagacatcggaccgcttttgggccgaagccgtcaacaccgtatgtcacgacatcaaccgcctctatcttcaccgccttcttaagaagactccctatgagcttcttaccggtaacaaaccaaatgtctcttactttcgtgttttcggtagtaagtgctacattcttaataagaaggctagatcctcaaagtttgctcctaaagtggatggggggttcttgcttggatatgggtcaaatgagtgcgcataccgcgttttcaacaaaacctccggtattgttgagatcgcgcctgatgtgacatttgacgaaactaacggctctcaagtagagcaagttgactcacatgtgttaggtgaagaggaggaccctagagaagcaatcaaaaggttggctcttggagacgtacgtcctagggagccacaacaaggggcctcttcctcaacacaagtggagccacctacatcgacccaagccaatgatccctctacttcaagcttggatcaaggtgaagaaggcgagcaagtgccaccctcttcaataaatctagctcacccaagaatccaccaaagtatccaacgagatcaccccaccgacaacatcttaggagacatcaacaagggagtatccactcgttctcatattgcaaatttttgtgagcattactcgtttgtgtcttctcttgaacctctaagggtggaagaagctcttaatgatccggattgggtgatggcgatgcaagaggagttgaaca

SEQ ID NO: 58237 - DNA, 1192 bp, Oryza sativa
ggtttgatctcattggttatgccgatgcggattatgccgggtgcaaagtggataggaaaagcacatcgggtacttgccaattcttgggtaggtcccttgtttcttggtcttccaagaagcaaaactccgtcgccctatccaccgccgaagcggaatacatttcgacggggagttgttgtgctcaacttatttggatgaagcaaaccttgagagactatggcctcaatgtgtccaaaatcccactcctatgtgacaatgagagtgccattaagatagccaataatcccgtccaacattcccgaaccaaacatatagatattcgccaccatttcttgagagatcattccacaagaggcgacatagacatccaacatgtgagaatcgacaaacaattggcggatatcttcaccaagcctctagatgaagctaggttttgtgagttgagaagtgaactaaatatcttggattctcggaatgtggcttgatcttttgcatgcatttgttttcaattactagaataggattgcatgccacatcatgacaaagtgaacattcaattcatgaatgaacactagtcataatctgagtggatagcttgaatctatgtgtacggggatctcattctctaatgaattttggtccttgcacaatttgctatagattcgtacattccctctctcgagggtgaatcatcttgtctcatgataattcactctcatttgatttttggatcatccatttgacttgtggctattgttttgtgtggttgattgtgtgctagccatgaactcaaatggggccagaatgttcggccattcctttctctccaactcccatcaaaagtttgtgaaaaattgaatctcttcaaaattcccggtgcaattcccttaaaaaattcatttccaaaagtttgcaaaatgttttcatcaaaattccggcaaaaatcctcccttttcggtgcttagatgccaaagggggagaagatctatccttttatttattatggtcgatcatgagtggtttttatttgtatgagagatgtgtgtttcttaagttagtttaatgctttgtaagacattattgtttaattatgaatgcttggtatgtaatgtgatatatttgttgtcttgtgagcttcaatgtggatgcaaagatttagggggagctctctacttgctttaatgcacacttt

SEQ ID NO: 58238 - DNA, 21268 bp, Oryza sativa
  unsure (1)..(21268): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgttttgctctgctataatgtctgtatgttaacgttgatcctgaaaagaacaagagagtatttttttctgttgccacatgcttcaattgattagctcgtatggaggacagatgcctgatggtccgtgccttcaaattttctgaaataataataattgatagttttgactagatccaccctgctgcaaacagaaaagcaacatattttggctgcaaatatttaacttttttacttagcaacatttcttgaccaccaaatgaacctattgatttgatcggttacttgaaattaagtatacaatttgaggcaccaagaactgaaatataagctcttttccatgttctgtgtgcattgagctaaaccgacaggcaatttgaacctgtggcagtcaataatatgacctaaggtatcaaaagtgcacacggcagtcaatgaagaatagttattataagaaaaaagaactaaattgaatgggcattcacgctttgatgatttcatctaaataattcttatgagatgtaccagtctaggtgtttgcatcatattaactctgctccataatagttgtcttagagctcacagagcaaggaaagggttaataccttttttttcacaaagtttgcccttttggatgatataatctgtgcttatctgtgcaattgagtcatatttgaagatacatacagccatttaattcgttgtaggcttgtattgcttattgaaattatacaaaatatttgaatcacaatttgggtttcatttttttagaacttatgcctcatcatgtgaatatgtttacaaccttatgagtttttattatttgatactcattttgcacatctgttctagaatcatcctatgcttgctaaagagtacgagcgtgttagagctgggaaacctcctgctaccatagagatgtcccgctatggtttggagccacccccagcgaacaagaggaatgatgttgctgcatggaggcaggctctaagaaatgctcagagccagctgcaccatcaaatcataaggtaagagtagagagccacagggtactgaactaatgaaatttaccatcaaaggtgcagtatcgttgaacgttgtgcatttgattgtgataggatcacagggaccagtgtcttcctgtggcatgtccttttgataatttttcattaccataatagcttttaagctttccctggtgtggaaaacatagacttcgagaatagtatcagagtagataggatgggctgcttgacaaaggtttctgcagtctgtttaaaataacaagcagtattattttgataaaagagcatgttttttggatacactgacaatttgtaaattggaggattgtataatgctcatagcagaagacttttccttgtactttactaaatgtatcttgggtaaattaagatatttgatcatgtattgcctaatatcagcttcaacagtttacttgacaatgggagctcctaggttagttatgattgaacatgtaaagcttcgatcatgttacttcagaattcgactgctgtacgcactgtgtaggatatactgcttttttctgaccatggtttcttatcatctatggagtcagcatacttctatgctattattagttttgaaataaagttaatattgcaggatagagaatctggagcttatgctgaagtatggtgttgaggtttggaagcttcagaatagacaaatggaatcagttttgtctaggtaggctattgtgacataagtttattatctttgaatttggagctacgtatcctgtgttattcatgagattcatttagagccatttcagtactcctgtttgtagactctggtctcatatgttgatagtgtagcttagctgtttaaacttccagtaaagcacttattttgatatttgaagcacttatttcgacattcttgtaagtctcaatgctacttatcactgtaacaatatggatggtagattatttttatgcctgattgcatggtatctaagatgtcgaatatagcatttatcattctagcagcatatgatgggttgatctctttataggatgcaaaagatggctgtcgaatacaatgagaagatagaaactgtcaaccgcgagaggaaatttcaccaggtaattatattactcctgctcttgttcttaaccacggcatatttcacagccaagctgatcatttgtgttttgatcagcaaaacactggtggtcaactccatgccttgacgacggaatggcaggagctgtgtcagaaaaatatagctattcaagctgcatgtgttgatctgcagaatcagattgatcagcttaaacttggagctaaagaattgtactccccctctctccctactttcctccctctctctccacatccacatgactaacagattccttaacaggggaatgcccatcgatgacagcaccggaactaatcagcaagcatcatcagccatttgaggtactatttgttattttgttctcaaagaaagcagtattcttaggagtattgaagttaagtcaagagacaaaatctaccttcatcatgcttacaagtttttaccacagcacagatacataggtagcaatggaggtgagacaattccatgagatgggagctggaggtttccatcaaggcacatctttttgcatgatctgcagttgccaaatccaagataacaatctaggcgattaccttgacaacccgcacttgtgattgtattccgttatccatttttcgaggacttgtgtgcatatggagacctgatagagaaacagatcgtatgcatgctgtgtttctgttccaagtgatctaacctgtgtgagaggcagaaatctcatcactgaaatagaatgtaccttgacattgaagcgtcagttaaggtttttgttatttatgttgacatgtttgtgtactcttcctgctgttaccatacagttttactaaacatgagttgtactaaccatggaggttgatatggaaataattactacctccatcctaacatagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctcgcatcaaccatggccgccgccgtcgccgccgccgcctgccactccccggcgcgcctcgtggtcacctgctcgagctccgccacgcccgcgccgccgcggcgcccgctgcgggtggccgtggtgggcggcggccccgcgggcgcgtcggcggccgaggcgctggcgtcggcgggcgcgcaggcgttcctcctcgagcgcaacccgtcgggcgccaagccctgcggcggcgccatcccgctctgcatgctcgacgagttcgccatcccgcgtgacctcgtcgaccgccgcgtcacccgcatgcgcgtcctctcgccgtccaacctcgccgccgacttctcccgcgcgctgcccccgggcgcccacatccccatgctccgccgcgaggtgctcgactccttcctccgccgccgcgccgccgacgccggcgccaccctcgtcccgggcctcgtcacctcgctctccctccccgccgaccccgccaccgacccttacctcgtccactacatctcctccgactccggtggcccctcctcctcccggtgcgtcctcgaggtcgacgccgtcatcggcgcggacggcgccaacagccgtgtcgcccgcgaggtcggcgcgggggactactcgacggccatcgcgttccaggagcgcatccgcctccccgacgaggccatggcctactacgacgacctcgccgagatgtacgtcggcggcgacgtctccccggacttctacggctgggtcttccccaagtgcgaccacgtcgccgtcgggacgggcacggtggccgccaagccggagatcaagaggctccagtcgggcatccgcgcgcgcgcggcgggcaaggtcgccggcggccgcgtggtcagggtggaggcgcacccgatcccggagcacccgcgcccccgccgcgtggtggggcgcgtggcgctcgtcggcgacgcggcgggctacgtcacccggtgctccggcgagggcatctacttcgcggccaggtcggggcgcctctgcggccgcgccatggccgacgagtggcggctcaccggcgcggtgacggaggccgggatacgggcgggatacctccggcggtgggacgacgagttccgccccacgttccggttcctggacctgctgcagcgggtgttctacggcgggaacgccgggagggaggcgctggtggagatgtgcgccgacgagcacgtgcagcgccggacgttcgacagctacctgcacaagcggatggcgcccgccgagccgtggggggacctccgcctgctgtggcgcacggcggcggccatggtgcgctgcggcgtgctcggcagggaggtcgagcgcctccgccgtctcgagcagcaggccgccgaccaggtgctcctccgccattgaagatgtgtgtactgctctgctctctctctttctcatgttttgtagtagcaactctgcatttgcaaattgcaatagtatcttacataaagatgctgctgctagtaataagcatggtaatttttgggatgctttaacttctaagcaataatatgacatttttattcagtttagtggaaatcccagttgtcatgaattcgtgatgattgttatgtgtaccagtactcaacacatagggaatttagtgggcattagcaacgattaattgaggaaaagaactgcattactcgggtatatcgtatatgaatatatgatatagttcaagctgacaattagtctcttaataataccggaaggggttgtagagagtagctaggtaacataacaaaccagatctgaaaagcctaacgaagaaatacaatatattcaacgaacactccagtgaaataataatccaaatctcagtatcaaaatgaccatctcctccgttctccagaaaatgcaactgctatgtaatgtggtattctggtcatccaatcaggcctgcagtcaattgaaagatgagagcgtgacagatactgtaaaaagaacaaaaccaccaatcaaattttatcaatataacaaaactttggaaaaagagttggcatagctgtgttcgggaggaggggttggtcaccggcacgcaaaacaaagctcgtattgttgcatgattaatcaagtattaacttttttttttgaaaaatagattaatcatatagaaagtttttccataaatcacaccgtttagcagtttgaaaagcgtgcgcgcagaaaacgaaagaggtgggttgggaaaatggggggaagaacacagtaagcttcaaaccatgtaccaccatctttcaaacaccctcatggtacaattgcatgacagagtaatgtggtaatggcacataggaactaccttgtttgcaatgttgctcgagagccagtcaaggccctcatataaaccctctcctgttgtggcgcatgtactctggatatacctaaatgacagcaaaatccaacaggttatgatatgtaaaaatagcataatattttcaaggaaaaaaacgaaagttattgatccattgttaaggtgattctattcatcatgtaataatgagccacataattgtataggtgaacatcactaaaaagttttatagatctaggatggttcttggtgaaaatatgtaaatggcataagatacatacggagtaacacagttattcaccccctatgactatttagttgataaaaaagagttgaaccacaaagtggagtaaggtaaaccaaaaggctgattcattaaaatattaaaacataaagtttaaaattgaaagatagaaatcgacaaaccagaatacaagaccatcaaacttagaacaaaaataggaatggatgagatgagaagtagacagcctacaagtgacaacaaaagcaaccatatattaccagtggcgttggcgcagggaatggagaccaagcttatctgtgatctcagcagcattcattgcattaggaagatcttgcttgttagcaaaaaccagcaacaccgcatccctcaactcatcctgcaaatgccatatgactgaatgcttaaagcagtgattgaaaagaatttgtatatgtatgtaacatagtccaagtgtatctgaaagcaaaattcaggattctaattgcctaagaggatagattccttaaccatatggaactaatacctagcaacattttgcataggcatgtcttaacttttaagctctgaaaagcatatgctatgtgtgtaatagtgtgtattagcataccatggcatattttggacagcatatatttatttttaaaattctgggcaaacggtatagtaacaaaaaattatgaggatatgtcggaagtgtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagatatgatacaaaagcacatgcagcaaagttcttaaatctcagctcagataatgtaagaccaaaaccaaaatgggctccatagttcagttagttaaatcacaattcattcaaacgaaccagatcttttgcaaacgagaaaagtatataaggatatcgacattaagaagtactcccgtcatgccgttgtcttttaacatgacgtttgacatcttactaaaaaaattatataaataccataattttgttgtaacttgttttatcataaaaaaactataatattaacttagtacttttacatatttatactaaatttttaaataagacgttatgcgaaaagtcaagagcgtgcgttatacataaaaacctgaggtattatttgaaacggcaccgtgatccctcaggcaatgcaaagaaaacagcatctacagactatgatttcacatcccacgagtaaacaaaattcacagaccagtctgctgtgcgaaggatctatgcaatgcaacgcaacgcaacacgatgccactggaattaaaatgaacaatatacaagtctaacacgtgaaaaggggtcggcaatggaaacggataggcgatcacctcagccaaagcaaacaacggatcgccgaccagaagctcatctacggactaacaattccgcaccccacgcacgaacgaattccgcggacttgtagaggcctcccaaggatctacgcaacggaacacaacacacagcaccacgccattttctcgaggaaaaaaaattctggatcgaaccgaacgagatctacacacgcgcgacgccattggaagtttacgcaccacacgctacgaactcactcggctacacagatctacgcctccactccacggatctgggcctgggcagcagcagcagcatcgccgattcgccgccagcgccagcgccaccgcatccctccccagcaatgccccgagggcgaggcggagatcggagaggagaggagagagggaaaggagttgggcgtaccaaccttgctggagatcgatctcgtgcgcgcgcgtggcctctctcatctcctccccacctcgtcgagccgaagaaaaaggagacgacgcctcgacgcgcggtggttgcagcggagggaggcttcgagccgccgcggtgggtggacgcggtctacgtgagccgggtgtggtggactggtggtggtggtggtctaggtagagtgcggtgcacgtgagacgggtgcaggagagagcggtgcttctcatttgaagcttcaacgtgcaaccgacgctttctctaagtttcattttttaaaccattttaaaattgagggagcttctaacttctcccagctgtcccaaatagtctagattttcatttagatttcaagaatttgtaattgtagaatccagaaaatgaactaaaattctcataagttgactaccaaccagttgtttcttagaatttttaacttttcaatcaggaccaaaaccaaaaagtctacaatgtcctcactttatcaaattctaatataattattcatctgcaattatttctcattttttatttccaatacaattattctttatgttcacaaactccgatgcaatgattattttaaaaataaacttattatggaacggagagagcatataagcatgtgtacatgtataaagtcgtataaaattcaaatgtttaaagtcagggtggaacccttggccatgataccaataggaaaattcgattgggctgtgtacccaaaacgttggggcagagctgcaaatttattgtgaagatgctgttgttccgctagtttgcagtcacaattcattcagacgacccagatcttttgctcgagtatacaagatgtacacatataaagtcgtgcagaattcaaatgtttaaggtcagggtacttgggatgtaaagtgttctctagcacaaaatatatttggcatgtgcgcgttggaaatacaaaatattcactctgctcataagataaaattaaatcaatcaatacctaaacacatgagaaaatagttcaattctccaacatcacttccccacaccttgaaaactaggaaaataaatacatacgatctcctaaatatcaaaaagaaaaatagatacattctcctctccctaaactgtagttcactcttttcatttcatctcctatatttctacaacatactattataaaatataaaggcgacgaagagacgaactgaagaacatgaatcaagtcttcggactgggattcacagcatcagaatcagcgaccaggccaatctgcatagggaagatgccatttcagtcaccagggtgctccacagcacctcatatatctgtctgtatggtataatcctgatctttttgaagaacttatgatatcaccaaatacttgcaatccaataaataagatcttgtagggttaatgctcctgctgacgctatctaaagccatattgccactaaagaaatgaatttactgtcttgtttgcttctaacgccgcctcaatatccggcaaagcaacagaatagatgtgctactattcaaaccctagaattggccccaagaaatgggaaaaccaaacaaaatgcagcatgcaaagaggtcaacttttccttagctcattttctcttgattttcttgcattagtttctccagttccttctgcccagtagatatcagtgtcttcacagtatcgaacgcagtcagtttaatactgcatggattgaggaatactgtgagcaatgagaagttacgtgccagtaaacatactattacctatcagtgttgccataaatttaaatatatagttgaccaccactgtgaaaagaaaaggcacctgctatttggtagattttttaatgcatttggaacaaaacctctgtatagtccaattagaccatcacgttccacaatgcctgcattcagcagagacaaatttaagaaatgcttcagtttagcccataaaggacaagaccaagctacaagtgagcatgtagaactggcatctgagagctgaagtgaacgttatgcagtaagtaaaagatgatgtttatccaacaccagaaggactatatataaatcagctacctggaatagcatccaaaaccgtgttgtagggtgatcctttcatttgcatctgccttctaacagtgtccagaggataacacatcaaagttgcaaatgttgctgaaagaagagcagttgccagagatgtctctggtctactcttatacttctctggtacagatttcttcattcttacatacagaaaagaatagagggtgaggtgaatatctacttttgagaccaacttttttatatgatgaggtagaaagaatctcacaagtcaaaaacacagaagttcacagcaatgtaaggggcgattcctataagagacggacccaggcctccatagaaggaggccaaaccttcgtctctcagcatgttcatagcaacctaaaagttaagtcatcaggttacattaatttccagaaacgaaactcaagcttataaactagttacctgagacatagtactatgtccagattgaactgctagcctcagccgaagaacatccagtgggtaagttacctatcagcaagtagccaagtatatatagaagtttcataatgatcagaacacaaacaaacaaatcaaactagatataaggacaattgctcaggagtaaataaataaattacaagtgtagatgtcatgcccgcacaagcaccagcagcaagtctcccaaacacagtaagctctccgtcctttctccggaaaaatttctgaatgcaaagcaggtacatggaaattgaaatgacaggaatccaaaataggtaattgactgatgataaagagttggcgttatcaccttgtaaacttcataagaaaacagttgcaccgcactgtaaggaactatgcggataaccttaagtagtttataaagaaactaagtgagaacaggaccaacagaataaaataaaccatgcatgagccacaatctgcatgatggggaatatcaagcacctgtggaagattgcctttccagtaacccttcaagccctcttccttccctatctctgcaatagcctgcataattgtagatgtatcagattagttatgtagtaccagatatacaactctaagtaaaatctatgaaaaagatagctatgcttctcctccttgtttgaaagtggaaagtgcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggngtcatggtgtgccctacctgcatgaggagcttgacgcggtcgagcggcgcggtgatcgtcttggcgacggcccccgcgaccgcccccgccgcgaagagcgcgacggcgttgggcaccagcgccagcatcgccagcgggtgcctcaccagcacccccgccgccggcagctgctgctgcttccccttcccntcccccacctccccctcctcccctccccctcccccctcccgcacggtgagcgacgcgaacgccgggccacccccacccccacccacgcggagggcgagcgcgcggcgggcgtggggaggcggcggcgtgggtgggggcctccatgagtcgcacgccgccgcatccactcgccggtggctcatcgtcgtcggtgggcaggcggtggccggatctgcttggccgcgagaggcgaggcgaggcgaggcggaatggaagagagaattaatgcggaggaagaagaagaagcgaagaaggaagaggggataagggggggaggaggattgatttcctccccgttttatgtcgaagctcgagagagcggtgaggaggggggttggttgtttaaaccctcgcgcacgccggacacgcgggcaatgcactcctctctcttttttttctttctttttcgttttcttttcttgagaggattaatggtgtatgagtgtggcacaatgaaagggacgtgtttcggttcttgccacaatgtcagcaagtaaatgcggttttggttgcccgtctgttcggcatttgtgccgtacatggacatgggaaccgaatcgtggaagaagggacagctaattgggtccgttttttttttttttgacaaattgacccttttggaaaacttatttcgaaactaacccctgccaaaaacttcaacaaaaaataggccgtcgcctcagcgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggatggcttgcgggctgggacctcagcgccagcccacctggcgctgaggtgggacttggccgcaacccccaaggcccagaccagcaagcctgctggatggcttgcgggctgggacctcagcgccagccataatggcgctgactattggaaactcagcgccagcccacctggcgctgaggtgggacttggccgtttcggccgtggcccagcccagcaagccttctggatggctgggctgggacctcagcgccaggtgagccctgctaaactttagcaaaactttgcacacaacagaggcaaacatcaaatcatagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatctggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtaccccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgaccaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatgaaaaaatcacaatgagaacggaaaggaggacaacagaaagtaaacattgatgcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcggggggccacctccacatccaaacctcgcaacttacaaacggttatcatgtgggagcatggcaagtgatggagctgagggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgctaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgcccaattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaattttaaacccatgcataaacattaattacttgaaaataatatgtaattaccattgcaataccaatacttcaaaagctaacaacatgtctaatttttccaataaataagtacattactcaaatactacacattattgataaaaaaaaaactctactcctacaaattacctacccttcaccacacatcaacccctttcaaaccctctcaa

SEQ ID NO: 58239 - DNA, 2060 bp, Oryza sativa
catattatccatctaataatccatccttagccaactattatcaaaccacgtctacaaccaaaacaatgcaaaatatccaataaaactttggggaacttagggtttatagaggggtttaccttctcttccgatcccaaactcaatgccgcacaaatcaccttcgattagagaggtttttgggggagattgggcgaggagaacgcggtggcgaccgaaccctaggcgggcggctggggaaaaaacagaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggtaattgggtggtaactagaaccaatacgtacttcatatgtacttaaataatacttttaaatattagaatctacgatactatttaacccatcctataaacaaaacctccatacaaatttataggatggtttaaatcttgtagtaggttgcaacattttgagacatggatagtatagtaatatagtagctggattagacctaacctattactaatcttatctagatcttgttatacccctctaaattgatttgaagtactaaattgtgtctaatctggtttttcggtactaaattgctatattttagaatgagattcattcaaattctaagtaaatacaatccaaaaaataaactaaaaaccagaacagattctcaaaaattaactaactaccaaccaaatgtttatcagaatttagctccctaataaagaagaccaaagagttgttgggtggatggttggattgagcgtggtgcatagctgcatatcaaaggctgacatcatttgcagcaaacgcataccacaataatactatgcatgtacgtgaagtgtttttttcgtgaggattattaaaagtttaagttttttttcctgaatgaacgaggtttattaaaagttgagttcaattatactagcacgcatgtagttagtctatattgagtaccactagagcaatgatccagctagccaagctaaaacgacatctagatcaccccaagtaaagcatataggtttagaaaccattcggatacacagcaaaacaaaaagaaaactcatgtcccagctattctttagaaagtccatgggataaattggagcaagtctatttgcttttcccttttgctcttggaaatttgcagatcaacggtaagattacatatagggcataaattagttgactttctttgccaccttttgatgtttgttattcacaactgagcactattaaatatgatatgtccacggtgtgttttgtttatttcttctcatttcaggttttctacaatactgctcagtactatttaggattctcgtgtcatattgattggccttcttctaattattttagcatttcaatacataaacagttgacaggtatgtataccgaattagaagtatttatctatgtcaaggttcttttagtaattgtatgatgtccataatgtttctttcaaaatataggatcatgtcctgtccccccaacacacacacaaagagataaaaatagaatgtggttattcttaggtacccctctgttccaaaaaaaagtctaatccttgctaatccttggacacatgtgtgtcagattcgtagctagagtttgcctttttatgggacaaagtagtaggaactacacttttttgttgttttgcaagtttgaaatttgacatttcattttacatttattattttcatgtagagggattgaactttatttttccaagtctttgaaatcacttcttacagaattaagcatttcatgttcatacattcgggctgcaggaatt

SEQ ID NO: 58240 - DNA, 3955 bp, Oryza sativa
tactctcagttagagttaactaaatagagtattaccatatatctaacgctacaatagtgttgttagtgatgggagtgaggatgttagcatgttgcctcccaccaactaataatgcttttaaagagagaacaatcccacctactcaggttgattatatggtggacacatcccttattaagatcaactccaaggctcataatgctagaaaaagatatgaacgtacatgtataattgtgtcgcccaagcagacattataagcaacagaaaattaaaaagaaaacatacctactctaaaaactttagggagcatttgtttgcacaaagacaatattaatagctgtaatatttaaagtactatatttaattaaacaaatttggtcttgtagatgttgaattttttttataaacttgatgaaaactaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcatctcctcccgctcccgctcgctcgcgccattttccagcccaaagccaagcgcctcggctcgctctcgccgcctcgccgcgcgccgcgcgctcgccatggagatcggtggcgtgctcgtgtcgctgctcttcgccgccttctccctcccctgcctcctcctcctcctcgtcctcgccgaggccggcctccgcctcgcctccctcgcgctccgcggcggccgctacgcctggcccacccgctccgacttcctcggctaccgcatcgcccgccgccgccgcgccgccgtctccggcggcgccggcggggcggacggcgaggaggaggcgcagccgacggcggagtgctgcgaccgccttgccgtggcgatgtaccggcgcgggcgcgacgcggctcccgtggactgcgtgttctgcctgtcgcgggtggacgacggcgaggaggtccgcgagctccggtgccgccacgtcttccaccgcgcctgcctcgacgcctggctcgtcctcccgcgcgccacctgcccgctctgccgcgactgcctcctcccgccgccgtgcgagccgccgcgcagcttcccgctcgactactacgacgacgacgacgacgtccacttcggcttcaacgacttctccatcacctcctccaccaccaccaccacctccgccgccgccgccgtcgcctacccacacggcgtcgcgctctggcccatgtaataaatgtaataatcgccattgctgccgctgccggctgccgccatgcgagaagccgaggagcagagtgttctctctgtttttcttcttctttttttttggtttctttttgcatagttttttttagtaattagttgctaattaatttgggactgattgcttgattaatctaatgtaatctaagatgatctggctaggtggcccatgtaaagtaatgtaataatctccaattctccattgttgctgccacacgagagaagccgagaaacacacagggatcttttggctagctttacgaggtgataggctagacgatttgaatttgaagcctcgttctttctagctatttgatactaaatctttatctaatattcacgtcttttttagcatagtattctctctgttttttcatattttaggggttttttagtagttaattgctaattaattttgggacggattgcctgattagtgcaaaagacgatcaggcttaggtggcggttgctggctgctgtcctgtcctgtcttgctctctctcccggtaaatatcagcgactgataacgatgcctcacctgctactatttctcggatcgtccgtacatctttcatctactacacgagtacatggccatatgcattcatcacgagaaaacgctgcataatgcaaaccacaccccgtcccactaatgcttcatttctgggcatatacaaatactacctctatcctaaaatataaaatattttatccacgtagaagtagtgcttcattcctgcaatcctactgatgtatatatatagcgagaaatgaagtgttatgccaattcagaaaacacaaaaaggaaacagtaatatattatttgtgagcaatttaattaaaaatatggattagataccacctaataataggaataagtttgctgggatcgtgaaagaggaagtaattcgttggatcggttctcctgatccatcctccattatcaaaggatcagcggagtcccaatccatggtggaattccccgctccatggtggataatatcacagcaaatcgatggattgacctaacctagtgtgcaaagcacgtagactaatgcaattagggtaggtggcggtgtcaccgagcgagccagccagccagccggagttgacaacaccggtccatcgcgatcacgattatgcagcccccctacagtagtaatttctccatcacagtaaaaaacaatctagaagtacctgaagtagatttgacactatttgacactatttagtactccatccgtttcataatacaagtgatcttaagtttttacttatactacttcctccgttttttaatagatgacgccattgactttttctcacatgtttgaccattcgtcttattcaaaaaatttatgtaaatgtataacatataaatcacacttaa

SEQ ID NO: 58241 - DNA, 4061 bp, Oryza sativa
cggcgtcatctattaaaaaacggaggtagtatttaacaactcatcttattcaaaaaaattatgtaaatataaaaaacaaaaagttatgcttaaagtactttggataataaattaagtcacacataaaataaataataatttcaaaactttttaaataatgcaagtaaaaaagtcaaatagaacggagggagtaaaacagatttgaacagaacagttcagatttgttttgtaatagatgatgtcaaatccatttctaaattatttatttttttcctaactaagggtctgttcactttgataccactttcaaccttatcaaattttggtaaagttaacaaaaaaaaaatggttacatttagtttgctgccaaattttggtaactatataagaaatcctaccaaaattttggcaagttaccaaaattttgacaactataccaaaatttgataatgctaaaatttagtaaggttttttttttattaaagtgaacaggcactaagagagtactccaaatagtagtacagtgagtgactgtgaaggccagccagccataagcctaagctaacctaatcctccgtcgcgtagcaagttgacaaggccaacttgcccagcaaccagcaggtggcgcggccgtagcatggcgcacgtacgcgcccaccgcatttccgcccaaacgggggagctatccgtgaccgtgcgcccctatccgaagttgttaagatcattagcagttcgaaagaacgtgctaatgatcttaagtcagaaatcagaacagaacgaagccctaacatagtatgatccggaccggcatcctaacaacctcgcgggcgtgatatatcctcccagggttcacaattccgacgaaaaccgatcgaattcctcgaaatttcgacgtttcgatacggctcaaaattaggttttaattggaatttcgaaggctaaacagtatatttggtcgaaattcagtcggaatttatcaaaaactgattgaaaatcatcgaaaatcgtgatatcaatgagacttaaaatttagtggtcaaccggtaatgtgatcctccttcccgcttgcaggtgcagctcgatcgcgcgcgcacccggcaccgaagcgcagagagatcaggtgccgcggcgaccggcccggccacgacgaccaaaacatatcagcattcaacacgatcccgcgagggcgcatgctaaacaaccttatctttttctttttcttatgtttatagttatcaaccaaaatttaaaattttaaatcgttaagaacacgtgtgtgtatatatatataagaaatttataaattattttttatttgtatcctaataagcaaaaagatagccgttccccaactgccgtggcagtacagcctacaggtggtgtacctgcatatggccggcaggcgacatatccatcgccgtttggtactgtggcgtactgagttgtacgtactactactgtgtagcagccagatcttttttttcttcctaaaaaagagggacgtaacgtaacaaccgattgataaaaaactactaacctcttctgtcgcacatatattttcgaataaaccaaaacggcttattaaacaataaaagttaatttataagtacaacttctatatatttgttcgtagcgacttaaaagctaacactaaaagtaaattacatttaaaatatttaaaaatcattcaaaaagttaaattttagctttttctttggtttattagaccaaccaataaggctctatgtctgatctgatgagggaaaacaaagagcaagtttaataataaatgagctataagattatctcttttttttctcctcctctttctatctcttacctatgtatttaatgtatttatcttgaaatatatgaatagctagctattgatgagagccaaccctctttattttttaaattctcttttctccacagttggtttatagcctctaaggacgggcaattcagtttgtataccgcgtgaagccgtgaaagttgaaacagagccggtgagttccatcgtcggacggtcgccgagaagaggttacgcaaaatatgcaacgatagatcatacgttccctatcaaaatcgcgggtgttttgcttgggaaggcgtacgccgtctccgtcgacgatttaatttgtcccgtccccgcttggattcaatgttcgttgccactgatcaagaaccaataatatggtttaggcatttgcttgctcgctaaattgccctgcctcggacatcttaattcacatcgatcgaagacgacgacgaagaaggggatcagtcctgcatgtgactcactctgatttaacggtgacgccacgctgccttgtgtctagcttccctctcaatatactactactcctattcgtcgtataaagagttactcactccgtcaaaaaaaaatcaacctagaaagagatacgatctctcctagtatgataaatataaacatataatttgtccagatttattgtattaggagggatcacattgcctcctaagttgagtttttttagacggagagagtagttttttttagaaaatctcagataaattagtatcacattgaaaaagatgtcaacgtcttccattaaaggcttctttgggacacatgaatagaaaaaaaaaaatagaaatgagatgccatatgtaagcaaatcccatgaaatacaaaacacaggaatttgcaagacaatgtgtttagatagctcatagtaaaaacttggggatttggatggattttagagagagaagagagagaaatagaggaagcattggacttctcaaagcaatgttaaaatgaggtaggagagctcatgtgcaaaattcctaggaattggagtataggattacaattcaaaggaattttcctatgcttcaaacaagctagatagaaaattttccttaagatttaaatcctttgaaattcaaatccttgaaattcctatagaaatactccatttcaaaggagccataaaccccatagttcgtagtagtgactattggttgtcctgaccatgattttcttttcaatgaattcctaagcatggtttaattactctgcagatactttttaatatttattcacttcttactaaaatatagcaaccaagtgctcgaatagacaccacctaatactaatatttagtagtacgagtatagacaggtccctttatttagaatcgttgagctatgtggtatctactatgttgctactctcttcgtccctaaattaagtactaattaagtatattttgggatatggagggaataactttttatgggagagattttatatgctaaattatagtataattttaatacagacccttgcaattgattttgcagtatatttcgcacaagctagtctgttatccaagtatggacttcacaaacaatgagaccctgtttaaaagggactaaaactagttttaagtctctatcacatcagatgtttggacactaattataaatattaaacgtagactattaataaaacccatccataatcttggactaattcgtgagacgaatctattgagcctattaatccatgattagactatgtgatgctacagtaaacattatttaattatggattaattaggcttaaaaatatgtctcgcaaattagctttcatttatgtaattagttttgtaagtagtctatatttaatactctaaattagtgtctaaatatagagactaaagttaaatctctggatccaaacaccacctgattcggttgtcggttgcaaaaacaaagagaagaaaaaaacatttcccttcaatccccgtgcatttaatttccctcgtactaccaaggaaaaaaccgaaaaatacgttcccactcccacgcacatatggcctgcacgaatcgtcatcactctcttcatttcacgaaagcaactttaatttgctaaaggaaatcagacaggttcggaaagacaaacgagtttccatttttaaaaagacaatatactctctccgtttcaaaatatttgacaccgctgacttttttagtatgtgtttgaccattcgtcttatttaaaaaat

SEQ ID NO: 58242 - DNA, 1691 bp, Oryza sativa
gggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaatgatagagcatcggacgcatatccatgtgctacaacggaatgttcgacaacgaaccggtctgtctcagtcatccaccttggttcctatcaattgtggccatacacaaccttttgcaactgtcgatggaggtctgtcctattcctatttccacttattttactgtgtttctctcctaattcttcaacaaatgtaaccaatgatagcatgttcatcgtcgacctcttcagccctattgtctccatctcccacacatcaacgtaagtttagtcatatattagttctctacaactatcatttcatttcaccctttacaaatcatgacaactacaatgctaataatgtacagaccatttgctcatcaattctcgcggttttgctgatgtaaacctgatgctcgacatgtcaaatcagatcactcatacagtatgatgctcgacttgctgttcgactcactaatgtaattctgatgctcgacctgatgtatgtcaatcaatagcacgaaaaaaaattcccaccttttacacacacttatgtcattttcttttaattactaggcactattttctctccatcaaggcttgggcccccatgtcacacttgtccatattgtggggctttcttttggtttgaggagcgtgtccgccgagaacagcacagctcatcaccaatatacaatacatgttgtaaaggtgggagtgtcatcttacctccatataggccacccccagaacctttgcatagtctactcacaggagttaacagatcattgtcagcccatttttttagaacattaggttctacaattcgatgtttgccttcacatcgatgggtgtaaatgtcattgattctatcaatgatggacgaggcccatatgttttcaagattagtggccagctctgccatcgcattgggtcactcataccagaagaaggaagacgaccagagtatgctcacttatatatctttgacacagaaaatgagat

SEQ ID NO: 58243 - DNA, 776 bp, Oryza sativa
attcctgcagccttaatcacaaacattgctttgaagctcttgaccgaacattgagagatattcttgcatccaatgatccatcacttgctaacaaacagtttggaggcattacagatgttcttggaggagattttaggcaaactctcccggttctaccctatgaaaaaaacaggaaatcttatcttcatccatcacacgttctcatttgtggcagcactgcattctcatgcatcttacggaaaatatgaggcttcaatccccaacattgtctaatactcatcgtcaacgccttcaagaatttgcagaatggttgttagcaataggggagggagcagtagcagattcttcacctactgatcgagaggatgtttcttgggtaaaaataccagagtatttgcttttgccagatgacacaagaaacctttcaggccttatctcttttgtatatgatgcctcaatcaattctcacacagccaattatctctgtgagcgagcaattctagccccaacaaatgaaatcgctgcaagtataaattcccaaatgattgctcagctgactactgaagaaatgtcatactatagttcagacacaattgaagatactacaagtaatcgtgccactcttgatgctctttacccaactgagttcctgaacactataaaaatcagcggtttgccagaccatcaccttcaactaaaaataggagtgctgattatgctgctgcgcaatctgaacccaaccagacttataatgactcaattggggctgcaggaat

SEQ ID NO: 58244 - DNA, 14396 bp, Oryza sativa
attcctgcagccctatggctgatgctcataatgatactataatgcaggctgccatcatacgaagaaccaagcatccaaccatctcaatgatcattataaatttcatttttccatcagcaggtgttctgctagaaaacatatcaatgcacctctatgccctattatgtaccttttggcttgcaagagtgttatacgagataaattatttgtctcactcacctgtatgcctgccatgtaaataatataactattttaattgccaactgactaccgtcatcaattcttttgtccgatgaaataacatatcttacatatattatatgctttttagtaagtaaacttccagtaatatttttgttgtcatgtgaaatattaaaaatatatgcattcacatttatattaacgacaatgcagtttctaatcatatcagctttgacgttggatttatatttcaaaatctacatgaataccttttgtttccgtgcttcactccatgcttataataaccaattttcattatgtcccgcggcaacgcgcggggcacatactagtttagtatatacatcgtcaagattctcacgtagtccttccatcctaaaatatttttagacgctgttaactattttaaaaatatttgaccgttcgtcttattcaaaaaatttaagtaattattaatccttttcctatcatttgatttattgttaaatatacttttatgtatgcatataattttgcacatttcacaaaagtttttaataagacgaacggtcaaatatgttttaaaaggttaacaatatcaaacatttagaaaatgagggagtattcggtatggtcctagatttacacggcgacatcctagatttacatggccctttttcgagtttttaatttacgtgtttggggtatctttacaacaaaaaaaaagtcacaaacataactcaagcaaccgattagtctcgccctgttttagcatactaacataatttgagatcttatctaaaaaaataggaatttcaacggagacagtttaaataggaatttttcaggaaaccattacaaaagttgtttctacgtttgggttcatcccctcataattccacctcatcagtgcgtgtgttcggccgtccgtagctgttcattgtctatcgccgtcgtccatcatatatatcgtcagatggacggcgatgggggtgtaaaagagtgacgctgaacggaggagggtcctgtgcgttaatgtcagctacttgtcttctcctcgaggccatagtacccaagctcatgattccgcagtgtcttttatcaccattttttttcttcgggcttgttcactttaatgccaaaaaaaaaccttactaaattttagcaatgccaaaattttggtatagttgtaaaaattttggtaacttgtcaaaattttggcaggatttcttatatagttaacaaaatttagtagcaaactaaatgtagccacttttttttgtcactttatcaaaatttggtaaggttgaaaatgacatcaaagtgaacaggcccttcctctccagttactacctccacctccgttcgataaaacaccaacttctgactttaaatctagatgttggttttttatgagattaagagagtaattagtagtagtaaataaaaacagtaaaaatcaaagttaaccggcttggcgacctagaattattaaactgagcggagattattaatttgtaagttattcataaactgattttgcatgcggggtccgaatgatgtgcagtgcgcatgaacctgaacatgctcgtcgacggtagagctatttccccgacttttctaactcaccatcatcgttttttgcgcccactcttttcaaacggctaaacgacgtgttttttataaaaaatttctatacaaaagttgctttaaaaaatcatattaatccattttcaataataatatatatctataactaatataaatatttggatttttcctgtcgtcacctctcaatgatcgctgtttttgtccgatcatgcgacaaaattttcgtccgtaatgtccgactgagcggcgcccaatttccatccctaataatgtctgactgagcggcgccctccctctctgcgtgaacgcaatcgtgtacggtggccaaagaaaaaatcaaagaggatacaaaatcctaatcgtgtatgacaaatcacaacatcaaaaccaaccgataatcctagaaaatcagtttttcattcactattacaagatcaacactacaaaaattatgaaggtggaagcagaaacacacaaacaaatcctagatccctaaaaaaaccaattgcagcagctcgcgatgcggcaaatccaattgtgaccaaatcagcccaaacatctccacaacaccaatggagagcaaatcgggtaaacaccaaagatccccataaaaaaggccacaaatttccaaagaacatcgctcatgaatcctcttactaaccatcccacgattgatggaggaagagaagcaagggtgctcgagtgaaagcaggaggaaaggcataaaaaacaatgttggatctggaccggtcgccccgcgcctcctccttcgtggaaccatcgcaccgtcctcgccatgctccctgccgccgtgctggtccccagctcgggggctgttggatctagcccccgccgccccgcgcctccttctccacctcatgagagaggagaggcctcgccgcacaggggagagggaaggagaggcgcctgccgcggcgcaggggagagggagaggcgtatatcccagataaaacggacacgtatatcccatatatatataccggttttaaaaaaatatataaaatattactggtgccaacactcaacacttttaatgggctacaggtgcgtcacaaaattttcatctgtaaagtccgactgagtggcgccctccatcttcgcacgagtgtaatcgtgtacaacggccagagcaaaaataaataaataaatcttaatcttaactaactaaaagattaataattttcctttcgtcacaaatttttggtccgtaaatccgtacgcgtttaaccgttttaatcggatttcatgcgcgcaggcctagacagagtccggagctagcctggagtccagtacaagcccaaaatgcccaaatacgttcgcacccagtcacaacatatcctaatctgttttcttttcctccattagtttgagagaaaattatatttgaagtataggtagatgatgcctattatagatggagtggtagctggtttagttacgttctttattatatggcgtccccacatatgtaagatgatacaattttctctccataaagcaaaattcaaacaggtaagacagatcgcaacgccgcgagacattacggatcacaacataagacaaatcttatcttaactacttaaaaatttgtaattttctgttcatcacatcatttttcatccgtaacatcaatttttttgtctgtaaatccgattgagatccaatcagacaatccaaagaaagagaaaacgaatggaaaaaaaaaaacccgcataaatcttatctcaatctttgtcaccgccagatccacccacgggaagccactgtcaccatcggattggcctgtgggaagccgcgtgccgtcggcgccagatccgccatcgacgacgctcgcgggaagtcgctgtcgctgttggatccggccgtgggaagccgcggagggcgccgctgctcgcggtgggggacggcgcagcttcactcgctcgcagtgggggagggcgccgccggcaatgctcgcggtgggagggggaggtcgctaccatcgccttttgagatagagagagagagcaaggggatcgggggaaatgatattaaggttagggtttgagctgccgaatatttatctaggtcgggatcaatcgggaccgtccatcagattggatggccctggtttctcccgcgtcaggtcgggcgttgttcccaggccacctagctattgggccgcatatcctttatattaagttgtattatttatatagacagattaatatatccagtttaggggtttttttttggcagaagacttgttttatgcagatatccaattggacaacgtcatttttcaaaaaaaaaaacaaaaaacaaaagtaccaaaacagtgtgaaaataacttcagttaaaaacaaatatttttagttttaatacgccgtagcgaagcacgggcattttgctaataataataaatatttaattaattataagaaaatgtgtcaaatgttttgcgtgcgggacctcacctcccagccccgtactatcttgttcgaaacagaacgtgctgcagcaaaactcttggtttacgtacgcggacagcagtgcagttgcaggttgttacgctttaagaaagtacgatctcatacatgataacgtacctaggcacagtttggacttggacatatatgaatatttgtcgatggtttggacgtttggaagttgtgatctgcaacaaaagtaattaacaatctaccgcccgggcaaggttttttctagtgttaacaagaagagatgcgtaaaagaatcaacagctatatgtacatgcttgtttggtttagtcgtaccaataccaatatcaacacctaaacatgtttttggcactatcaatattttagtagggtccgtagcattctaagtaagtgaagtgggtttaaattgatactaattgagagccaagttttatcaaattaagcatgagcaagctccaaaccaaaccatcatatttactactccctccattctaaattgatctacatatagttttattttagttattcctaaatgatctatacatttgtgatcattcattaagtctattcgttatttgtgtattggagtaaatggacattgatgcatgcatccatgcacacaagtatttataacccacatgcaatatcttgatttgctattggctagaaaatagtgggggtgatgcatacattaagtttgttgctagagttaatatagtataaaaaagttcttagtttttcttgatcttagtgtacctatgaaatatgtagatcaatttaaaatggagggattactccacattttagtatcaatccaaaataatcctacatcaacgaaggacagatcagggcgtaagattcactccttttcactctgtagtcatccaagagcatatgcgtgtgctcttgctaaatccaaaaagaaaagacatgcgtgatcaacaatcgagaacgagagagagagagagagagagagaagaaaccgcgtgcccgattgggccttctgccgactgctcggcctgttccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacagcatgctctcgtgaggagaagttgacttgagcaaatcaaatggtcctatacctggtttaattccgttaaaaaaaatggacatcggcgttggccgccagggtttatggacaagtcaccagatacgtgccgtagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcgtctcagctcaggaacaacgacgccacgacctggaaccacgcgttggatgagtccggagagaaatgagtggcttcggtgagagaaggtggtccataagggggaaaaggagaggggggaatgagaaaaggttggtgcacctgagaaaatatcgttcgactggaatagaaaaagtatgtttggtggcataacatgcccacctggattcaagtgcttgcatttacgactatttattgttttaatgctagacgatatactcagtggacaagttaattatggtgacttcattgatataaagatatatcggctcagtctgtatatgagtgtgggtgtgagcatttatagggtgagtttgtgtgtgtttatatgagcaagtgtacccagtaatatatggaatcgagaatacgaagtgttgtgctccaacaaagtcatggtgtccgtatgaattgaacaccggtactagcccggttttgtggactacaaaatgaagtacagtatataagaaaacgctacaacacgccggttcctctctagtactggagtagtactccctccgtattttaataatatatgacgccgttgactttttgacaaacgtttgaccttttgttttattcaaaaaagattttaatgtatgacgccattgactttttgacaaacgtttgaccttttgtcttattcaaaaaatttatgtaattataatttattttattgtgatttgatttatcataaaatattctttaagtatgacataagtatttttatatttacataaaaattttgaataagatgagtggtcaaacattgattaaaaagtcaacggcgtcatacattaaaatacggttaaaatacggtgggagtactacctaacatggaccgtacatcagctgaagcacgaaaaccaccttttgttggtacacgcccacacatgccgcagccgtcaacgggtaaaccagctgcaccagcaggcccctgatggccaggccagccaccatttgaaaccaattgaaaaaggcaaaattgccaatattcaaccagcctacttttgttgatattgcggaggaggggactaaaagtttttcttttactttgtgcatgtacatagagtttttgaaatttactcaactcactttgtactcaggactcctttgaaacataaaataaaagatacaaataaaaaaacacaggataaaaggtcattctgtatgaaatcctataaaaattaaaaacaaaaatttatcaaattggtcgtttggatactccacataaaacttataaagactttagagaaaaagtatcatttaagtagagtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataatgcctgtaactgaagcatgcacattcacattccagaaagaaactgaagggtacattcacattcacataagcaaataagtcctctcggcactccaacaaaaactgaaactgaagcatgcacattcacattccaacagaaactgaagtgcacattcgcatttacaaatcacattcacattaattcagaaactgaaactgaatgagacctctcggcactccaactgacctcacaggatgtatatatctcccaggatgtatacctcccagccatgaccacaatcaaatcaatatttagctcccagtatatacctccaatgatcaagctctgaatttatttcctaaattttccttttctgatcatttgcagattctctccgcgcgggatcctgccgcgccgtcgcctcgggacgacgagctcgtacaacggtgctgagcttgcctcttccgcctcggagcacgggtcgtcgccgtcgcctcgcgagaggacgcagctcccgtcgcttgactcaaccggggggttttttttgcataaaaggcatcacaaagacggggcaaaaagacccgctgtacgtgcccttatcccgttaccctttcgtaagccgtccaattagttaatggtagtcgagttacgaacacgtgaccatctaagaagcgagtctattccaatgtcagacaaagagaactgcatgccatccgccagttatcacgtcaattaacactactatttttttatagaatctttcattacttatatattctagacaatatgttatttttaaaatatgtttgaaccattatactgtacttaaaatatgtgacaaaacgaatctaatatcaaatatgttaaaattatttaaattttgttacttcctaatgagttactttcttccaacagtacagttatttctagtattttgaagaccttgtagcattgtagttatttctgcacaccataaaaagatacttttctctagcagtagagttacttctaatatcttatagagatatttctaattttaagagttagttccctgtaggctgtaccagtgtaggtacttcaaataccatagaaagttacttctgttctttcaaagttacctttgtaagcagtgtagttacttctaggatcgtgaaaaattactccgtacatgatgctaaattatatatgtatttttaaaaataacatagagatcactttgaatgaagaaagtatatgtatttatttgaaaatcgtccgtacgttttacttgtaaatttactgtaaatagcctcacgatataataatttgtagtgctataaagagttatttatattacagagctaagctacttctataatttaattaaattactttaaaattgatatatgtttagatatactcaacactatacttgttttatttgttatatattttgagtgaagtgtaatagtgcaaatagctcttaaaaatactatacggtttaggaaatataaatcattaaaaagttttaaaaagatatagtacgagagaataatatattgctatttttaggaagggttactcgttgacacacggcggatgaggtggtcgctctgtttaaccatgtgctgtgtatagacgtgtcccttttgttggtacacgcccacgccgcagcgcagccgtcaacgggtaaataaaccagcagctgcacgttagcacgtacgcctgcacctccaggcccccctgacctgtccccaaccgaaaaggcaaaattgacgcccaaactgcccattttttcatcgagaaaaccagcagctaaggccgtgtttagattttttttcttcttcaaacgttcaacttttccgtcacgtcaaatattttaacacatgtataaagtattaaatatagacgaaaaaaaatcaattgcacagtttacatgtaaatcgcgagacgaatcttttgagcctaattacaccatgattttataatatggcgctacagtaaacatttactaatgatagattaattaggcctaatagattcgacttgcagtatatatacgacatctataatttattttattttattattagtataaatttaatactttaaatgtgtccatatacttaaaaataaatttgccgcacaaactaatcacagacaataaagctgtctcggcaaagccaaagcgcggccgttttcccgggtgccccacccccaccccaccccaccccggcccgcaggtttccgtcccaaaacccagcggcgaccgaccctggccttgccccatgcgtcgtacagacgaaaccgcagtcagtgccgccaccagctgacctgcctgaccaaccaagccggcggctattcatggcggcaccaaaataccacccgccgcccgcccaccgtacccgcgcgcgctgcagtcgcggtgcgatatatagcaacccccacttgagctagaattcccaatccatccaaacccaaaatcggaggtagctacagccgaatcccccaacagttgtgtgcaatttcttgcttgcttggttttcttttccccccactcggatcgatctcgttgttgtgtgaggttttttgagctttggtcgatggcgtcgatcgtgctgctgctgtcggagctgctcggcggcgagagcaccagcgtaatggcggctgactggtacatgagcggacacagcctccgggagttccggcccgtggcggctgctccggcggcggcggcggcggtggccaagtgcgagcggccggcggccgaggcagcgggggagaagaagaaggaggagtcgttcgaggatctcgccgccgtgtcccggatcgcggtcgacgtgatgtggccttagagcatccgtcgccgccatctcgccggagaagaagaaaaagaaaattctattcttgagttttttttctctatttttctccttttttttggttgccaacgaggcatgtgttgtgtactgttctttttgagatcagatttgtaaatatacgaagtgattcttggatgtttttcatgtcattttgtcatcgattttctccttcactcgtttctttcactagttctccactctttttcattccgtctcaaaaaccatcacgattcgctctgaagtcttaacctaaatacgcacttgcttcttcagacaatgcagttcccgcatccagattgcttcataaacattgcagatccttttattcccaaatataacatcaattacaatcgttcgcggtacgcgtcgaacaacaacaatttctccgctgaactctcaagcatacaagagcaagcagatcgccagacactctgacagagagagatgctacgccaagagagtcccggccatcacagtgacagcttctccctggatccggactctcctgttctcgccgtccagctccaagtacaatgttccactccttggcgaagcctgacgaccatggtattgtgccgtttgtacttatcttttttttttcagaaaagtataatgttggcaacaattgtttaccccctacttgtcacaagaaggtagcaaaaggataatacctgaaacgccgtaagtttttgtttccccagctttccaccccagtaaggtgccagaacacaatgtgcgcttccacacacaggatcctgtaagagtatatccgagttgttagtgttttaaaagcctgtgctaaaaaatatactacgagaagtttcaaattttggtcgataaggggcatagagattaacttgccaagttataccaaaagtttctgaacactcaaggaacgatacagccatacagggaatcgtcataaaactatcaaatgcatgataacaagtttatggaactgtcacaagaaatcatgaccaaaataaatttcagtactcagtcaaattcacactttggtcacttcacaagtctatctaaaatgatgtttttttaattactagttgtcgataaccccttgactcaccttgaggtattaagaggttctgattctttggagagattatatcagtcatctctgcatcaatgccaatgtttttcacctagtgtggtaggaactaggaagattaaaactacgcataaaccagaactgtagagacttcaaataaaaaacaccatattatatagagttaagtattgttttcttttatgaaaggagttaagtattgtagtaatcatgcaaggtgtaatcaatttatgtctctgattgatgaaaaatagcttgtgatgatttaacaattttgaatttagacaagcaacattggtaacatcgtgacagcagagaatccttctgtacccatgcaatgactaaaaagtgtaccacatatgagattatatctacatattctggaactaaaatggccatttttaacttaacaagccacattgtctgcataaaaaacttggttgttgggtggaaagaatcggcatacctcatctatcccaaattttgggcagaagaatcgtgaaaagaagtcataatcagatccagcaggtgctggtcccgtaacaataactcctctaccatcacattttttaatttcattaatgttagggataatatcagcaacctcttttccggaagaaagttccacctgaaagccatgccagaatcatttagtactaacaaacaaatgaacaattccaactccttcctctccatcttctttttttaataaaaaaaatccattataaattttccatcttttcagaaaagcttaccaactcctcatttaatattagcatccttaaaagattagcaattctttctcttagggaaataatcgtagcggtagcattgccatggttcatgacctccattttaatctttgaacagacattttttaatcattgacaatgttgactcgcctaattaaatttggacaaataataatttcaaagctattctactttgtaggctaaaaataaaattgtaagattcattccatattactattttcataacagtgcagagttcagagtatttacaaatttattaccaaaaagtagtggtcaaagtgtgtataattcaattgatgttgccaatcattttaaccaaaaaaaaaagacatggtaatatccaaatgtactagttatgaaggcaacattcagagcagcatatatcaaattttgccaaattttgccggatgttgtaacttgtattaaggggatataagaggaagtacgatgaggtcaccggcggttgatgatttccaaacactgacgactcgggcgccattcagagtctccggaatcgacagcgtctccgcggaatcgtactccacgagatcgatcatggggaaatccagctcgatgaacagcttctcctcacccgggacgccgccatcgttcgccggaggcggcggagcaggaaccttcttggcggtcaggatgccggacctcgtcacgaactcgaccatggcggcggcggcgtgctgct

SEQ ID NO: 58245 - DNA, 3932 bp, Oryza sativa
cgcggcatcctccccttccaggaggcatacggcggcggggttgcccttgaacggctcggccgcgaacgcgtccacctgcgacgaccgcgccgccgtggcgccaccgacacgtcagcgtcagcatcagcatcgcgcggtgggtcaacaagagaaagggcggatagtgtactgaccacggcgtactggatggcgttcttgaccatttccggcgaggcggcggcgacgacgacgactgcggcgggcggcggcggctgctccgaattcgcgcgcgtgctgaggtggctgcgcaggcggggcacgtttgtttatactttatagagagtgaccagtcgtgctgcaggtgaatgctggtgctgtgttcatcagcactgacgacatggagcttggcggcttatattccttgtaggcactgccgcaccggacaagtgtcactgacaagtggggcccatggacaagtggagccctcggtgtgggagcagttggaaagttacaaatttggaaggcctctcaccaatcacaaaaattttgaagaaaaagttgggaactaggggtgtgtttagttccaaagttttttttccaaacttccaactatccatcacatcaaacctttcatacacacgcaacttttcagtcacatcgtctccaatttcaaccaaatttcaaactttgggtcgaactaaacacagcctagacaaggcctaggtgactggagacagtttaatactactagcatatactcctcccataataccaaaatatagcaacatggtattatattaaaacctacttattcagatttgttgtaatataatatactatatcatatcgaatgtatttactggtgagagtaacttggtactagtagaattctccattcagtcaagatggaaaatgatcaatcagttcggctcccatgacaaacccaatagccaacttcatcatcagttcttcacctgctcccttcttttttctatcctcatatttctgaccagctaaaatgatagtcaaggacagagctcaaccaaccaatttggtaatccagttgaagttagagctcacgtcaatgctgacaaacatgttgcccggcaagctgatttgtaacaggaaaacaaatattctgggcgtagcaaggcagactacaaacatctttacatggatactcgagtagtcgagttttcgtttatttactacagcaaaagcatgcatgctgcatgagaaaacaaacaacgacagaatttcgttactcggatcagatttggtccaagatcacctcggcaccagaaaccttgaagtcagaaggagctacctcaacattgaaagccttgatcttcccatcgtcaacaaaggctgaccacctaaaacggacagcaatacttttagaagagaagtaagaaaaatctatccattaaccagtcacatttcacaatctcttaaatgacaaaacatgtaaattacatcctcaaaaaaaaaaagtgtaccacagcatgagctgtccatggagattatggaatggcatttcaggcttagccaaatgcatacattgtgtcaccagagtactatttacaacaaatgaaagggggcacacaaggaggttcaaaagtgactcaatgttgaatgatgttcaactttgcggaatcacgcaactacatattccttcacaaaaaaacatgcaatacatgcacctggtgaaccataattatgttccaaatatgcacctcagctcttttgtttgaaatttcaatgcacccatagatagttgtgcagctaacaagggcatgctaaagtgcgacacttaggaagtggtttggattcatttattggagtcttttgagaggttagcctcagtgcagtaaattttgtcacaacaacagcaaaatccattggaaatcgactgaataagactcacacttaaatcatgtataggcatgtgcatgcagcttgaagtaattgatcatttacagtcatgaatcatgacagtttaacagtagggaacatgtgtagattagcaatgccgccaatgcagaatgtccttgacaacataaaacatgctcaaatatgataatgaatgcaatgcactttgaagggtaaagctacagtaaggaaaaggagtacttgagttaacccatggtaagtaataagtttaacacaatgatttaattaaacaaataaagcaaaaggcaactgaaatacgttgttttatgttcaattgtaattatataaaacaggcagcagttttaactttttaaggacataaaccaagttaaccaaagtaaaattcattgacctgtgggaacggcggccaagcaaagcagcagagaggtctacttccaaatccaagcttttgtggaaactcccatcaaaatcaccataaaattcaatctggtatcaatattacaaaatcatagcagatggttagatttgaatattatgtgattgtgagcaagtttgatatgaactatatctgcatggactcatgggacaaacattcataaacaatagccatctacaatggtacgagactatgatacgctggtccttattatttttaaagtatagaatatataactattatatacttgaagaatgtttatgtttcttcttacattaaagtgtacattaaacaaatcagaagaaaaacataaataaatttaggtgaacttgaggagatacatgaaattagctttgcaatttactgttttacaggttatatgatgaaataagcacattactggcagacatgtgcagctttcaatcattacaaagtactgaggcagggagagaatacaatagcattcagcatttgtattatggataaagtccaccaaacacaaaggtggatattaatataccatgcatgattagtaaatataattagattagcaaaacatacagcgtgtttaatgcatttcttactatttaagcatatagaatggtaactcacagcatcttttgcctgtagcttttctgcccatccattcagggcataagggtcattcacagagacacagataacagagtcaaccccttttgctttcaacttgtcaatgttatttttataactagggacgtgtgcctgtgaacagactcctgtgtatgcaccctgaaatatgtggtaaagataacagtcacctatattatcagatcagtagatcattcagaaagagaatcgctccaggatataagaatttggaataaacgatgaaaaaatttagacaataaacaaatgatatcaaacatataaagcttcataaatactaaaagacagttagaaatcaactaggaattttgatagaaatgccttattggctggctctgaaagcagaattgtgtggataagtaacatgaaatttttacctttttgtttttactattgcaaccccaaaccatattaccctcactagattgtttgattagatgcagcaccctgtttgctgttcagagaatagagaagaatcgaagaaatggagagttctattaccatttcacctgtgggcaccacgaataccaggctttctaatttctgcactcctaatccgcaaaagaactactctcaagtctggcatttcctactccttaacttcaaatgttggaatttatcttgaaagttgaagtaatcgatgcccaaactacctcttcgccatggcccatggctaatgtatgtcactgtaatgacagaggctacaggaagacgaatccataatccccaatgcgcattcaggatgagtgtatccacacaaaaagcaacaaaccgaaggtcctcatctggtatccgaaatgtatagagtacgcatgaatttcgggaggaagagaggaggggagagcttacaggcaggccgaagatgaccactttcttcccctgcaaaaacacgagggatcatcagaaaagcctgctgagcagcagagcagacgaacgtgggtagtgtagggctagc

SEQ ID NO: 58246 - DNA, 1738 bp, Oryza sativa
cgccctcctcctgccccgtcggttcacgtgtgccacggtggcaggaggatggtgccccaccctggcgccccaaaaagaacagtttctgggataagttttttcagggatctatttgtgaaataagttttttaaaatgaccaaaatgtgaaaaatccagcgacaagtgataactggcaaaaccagtgaaattttagagaagttctgtcaaaatcttgaattctagtttgattttttctttcattggtcggattatcaggcagccttaaacccttgtttgatgcttaggaatagtttctaccagctacaactattcttaccagcgtcaacttcccctgcaatccgtccaaattctaatcttaagattttgggtgcattagcttaccggccatacttagccaacatatatcaataaaagttgtcgtaattgtctaagttgagacgaccaaatccattctgacacatttagatcttaggttcagtttgggagagcttctagcagctacagcttctcacgtaatctttagcttctcccaacaatctagattatcagttatcacccgtattttaaaaaaaccaacttctacaaattctcgaaagctggctaccaaccaacaaattctcgtaatcttaaaactctccgaacatagccttaggaaatctcatcataccttttaaagtaattgacatatgggatctaatttgttaaaaaaaatcctaccaatattatggtaccaactaaacagctaccaagttgatcaaacttgtagcaaaagagtgacgggcaaccaaacacccctagggctgtgttcacacataggtgttcccatcctgaacagtgattacggaaaatggagcggtctattagcgtttgattaattaagtattagctaattttttttcaaaaatagattaatttgatttttttaagcaactttcgtatagaaactttttacaaaaaaacgcaccgtttaacaatttgaaaagcgtgcacgcggaagaggggatagcgaacagagcctagcatctacataatccaaaaactaagccaaaagctagagttatccgacttattcagattctcatcagctgattatagctgaattctttgtaatctcgccagcaaaataaccaatggacatatctcaaattatctagctcccaaagcggctcgagttcgataactgtttattcaaaaatccacgtcgatcaggaaaggatctatcaagaaatagcagagagagagagggggcagcggaactaaataaactagttgtgacttgtgaccactcttttctattaatgtaaacagaaaattttataagagtttgaaagggtcaattagccctagagggggggtgaataggctaatttaaaactttatgtgaaagctaaaactgaaataaggtcggaaagtctgatccacagtcagactatccgaaaatatcagatagtctgaagttggatcagactgtctgatccaccaatgaagcacaactagatctatcacacaaacaagagtaaagcacaaacagcgactagatctatagcgacacaattaagcaaagctaaaaggaggatgaaggaagattaccaatgatgttcacgaagttgttcccggagttcaaatccttgaggggattctactctccgttgaggagctcactaagagccgggtctttgctaaccctttcctcaagaggttgcactaagcactcctccttccactaaggggtatctt

SEQ ID NO: 58247 - DNA, 874 bp, Oryza sativa
cacttaggatcacgatacaactaaccacaaaaaaaaaattaaactcgaactaccacttagctaagtctgaaaatagctagcatatcacttagtctactttgcaccttcactaaaattagaccataactcctttagtaaaaccctttgatcatcatgttacacataatgcactctatcactatataaaattacttaatctaatttaaaatataaccacatgaaatgatagccataagttaaacagtacagagagatgcaatttttttatttttatttcattttttaatatttttttcacacttaggagaacatagaaaccaaccatataaaaaataaactcaaacagacttgtaaaattttccaaaactctaccgaaacggacaaaatatgtcatttattaaaatagacgtaactttctcatacggactcggaatcaggcaaataatatatccacggacatttacagaaaatgttacatccgatcctcccccgcttcgccgggttcggcgatattaaaacctccgaattctgcttgcaagattgtgttttcgaggagagaagtttttcggtagagctttggaaattccacaggccacatatttcatccgtttgagtttattttttatatggttggttcttgtaagttcctaagtatgaaaaaaatatcaaaaaaataaaataaaagtaaaaaagttgcacatctctctcctctgcattagttcggagagatatgagaggagaggaaaaattctacatgttacatattacgtccatttgagttcattttttctatggttggttcttatgtgtccctaagcgtgcaaaaaatatcaaaaaaataaaagaaaaataaaaaaattcggggggggggggg

SEQ ID NO: 58248 - DNA, 5075 bp, Oryza sativa
attcctgcagcccataacaggatgacaaaaacgaataatccaaaataagaattaacagatatcacacctaaaaataaacttacacaaataaatataaaaaatgcattatcatttctagtgtaaggatatcaaacttaatatgaaatgcaatccccagcacaagacgtagatgtgtacatagtccatagtcctaacacaatcagatgtagagtacatataccatcctaatcctcaacacgagaaatacgtgtacatatagtactatgtatagttttaaaaaacctcctacttctcggcacgaggaaatcagggcatgagaaaatcgggatcgatccataacatgtctagtgacttgacaacgctagaactccaacaaacactgctagcacagatccaactaggaaccgtgtgcactcaaccacgcttatgcaaagatcatgctgtctagcaagcagggcagtgcttaaggctgcaattccccccacctcacatgcaacacatgagcacatgcattaacatagatataacttaatcaaattagggagcgtttgttgagggggaaatgagttgtaagacctcatttgcatggccagcattgagtcccatataaacaaagcattaattaactctatccatttccaaaatatagtcagttttataaataattttcatgaaactgttccaaagccaagtaccatcatccactgttgtttaaaaatgtatttgctagtactacatgatgaggaaagtagtaaaatgctagtagtgctttactacttcatttattgccaggcttatttttggtccattattgattggggagagatataaggaaaagatattaaaagaatttcattttattctcaatttttgctacacaaactagtaatagttgtaccttgaaactgagagtataatttattgcttattgtcatgctctatgcatattaatcaggagagtataaagggactatatggcacagctccagcttcacccctcctagagctagagctcagccaaatgtttcagctccacaaaaaataggagtggagctgggtggagctctctcacaaaatggtctagagttgtagagctgggtttaagagctggtgtgctaattcaaggagcaactcaggaactccaaagcacctcaaaccacatatccaccgagcaactccagcatctccaaaacaccgcaaaccatatatccaccaagacatacctacgcatgattctttgtagacgagcacagcgcgaccaactgctacgagtagcgcctcttctatcctgccctctccgcaccgtcgttgcaacgatgtaatggagcgaagcccacaaggaggcaatgggggcacatgcccccttacgctcatagaacaaagcgtaccttatagtaataatagttgatctccatggttgtgggttgctcatcatcaccaatggagcttaaactaaagtggagggagaacctatagaaataaacatcaatatttgaataaattgatcaaacatttaaaatattaggatgagataaccaatttaacatttattttggttaattaaaacactttgagttaacagatatcacttgaaagaaaatagataacaggatgacaaaaacgaatcgtctaaaataagaattgatagatatcacacctgaaaatcaacttacacaaataaatataaagaatacattatcatttgcagtgtaaggatatcaaacttactatgaaatgcaatcctcagcatgagacgtagatgtgtacatagtcgtaatacaatcctcggcacaaggagattatttgagccagtgaacatatcatgttgatcatgaccatcgtgataagtagggtagtggatatgtgtctcacgccacaaaagaattggtgtgctaattggagaagcaactccaggaactccaaagcacctcaaaccacatatccaccgagacatctctgtaagacaaatccagcaacccgaaagcaccgcaaaccatatatccacaaagacaaatctccataaggtcggtaagcatatccatcaagacatgcatacgcacgattctttgtagatgagcacaacgcgaccaaccgcgactattagcacctcttttatcttgccctctccgcaccgtcgttgcaacgatgcaacggagcggagcacagatgggggcacatgcccccttacgctcatagaacaaagtgtaccttatagtaataatagttgatctccatggttgtgggttgttcatcatcaccaattgagtttaagctaaaatggagggagaacctatagaaataaacatcaatatttgaataaattgatcacacctgaaaataaacttacacaaataaatataaaaaatgcattatcatttgcagtgtaagatatcaaacttagtatgaaatgcaatcctcagcacgagacatagatgtatatatagtcctaacacaatcagatgtagacatgtgtacaatcagatgcacataacagtacgagacatgtgtacatataccatcctaatcctcaacacgagaactatgtgtgtacatatagtactatgtatagttttatagatcctcctacttctcggcacgaggaaatcaggatccgagggtccataatatgtagtttcttgacaacactaagaactccaacaaacaccgctagcatagatctaacatgatataaaaggcatcaagtggaaatcctctatgttcaaatttgaaatcaactagttattgagaggatttacagcatgtagttgaataaatttggaattcttgtaatgaaaagaggtctatattgataaatgcgatggagaatgcaaatgatgagaaaagggctaaacagatggaacatgaactgggatagtgaatacaaatgggaaaaacataggtggcaaattattcatatcaagtttcgatagagatgagccaagagaagtttggagtggagggaatgaagtttttgtgtgctcctctttttggcctgatgccgatggatgcaggttttatgccctagcttattttgtagttttttttagtcgatctggtcgcacctgaaccaatgagaattaggccaaaaccttttaatttttttctcctgaacttaatttttttattttttttctcctgaacttaatacttccctaaaaatacttccactgaactaaagtatataaggagaaatggtgatcaagctaataaatgaaacatggtgtaataaaaaaaacataaacaaacatgtgagattgtgataaaagcaactgtgactatatagcagctcatccctcatgcggagagagagataagggggagaggggtgtttataacaaggataagcatgcattcatgataatcttaacaacactaaacagccttgactaacctggccaacagttcttgtgtgcacaatccagaggaaggcactaaatcactacatgtcaatcgatagaagagacaaatacttgggatgagcccctgaatatgtccacaggcaaaaaagttgacagacttgcttaggagcacaccaaaagccagaccaagtaaatacaagcaccaaacatctattttgttttgtattttttatacaacctcccaatgggaataaactaagcatattcttattgatttagttgattgacatggatgagttattgaaatatttgttaaatctatattactttcaactgaaagtataataacaaaaacaaggaaggaggtttccgcatgtaaaagtactaaaaagataattcaaaacgtgttcagactttagtagtacctcaagatacatttcatcgagcagtccttgagcaccaaaaacctctaatgcgttcctcctcttccttgttctctttgtatcctcctattctctggccatagcagcagtgcacagcagcacatacatcatgaggtcaacgtagagcagaagcaaatcgacaacaaatcagaaagagcaatgcggtggcagtaacataatagcagcagcagcagcaacaacatcaacagttgtagctgtagctgtagcctgtagcggggcagcaaatcgtccctaccaagcaaagcaagagcattgaactcattttttttagcagacggtaggagcaaccgcataggagttggcaagggatgtgaagacctgaaaaaatttgaaagccttggcaaatcagttacagcaactgtcaggcgactcaagctcgtgctgccagccgttgtcgctaccatctctccccctttgtccgcaggaaaccaccgctattgtcgctaccatctttcccctttgtccacaggaaaccgccaatatccccatccattgcatctgtagtgatagatggatggggatgaacggaagacgatggataattttataagatttcatctcttcctcctcttatggtgacgacgttgcgatctactatctaatcccgctttgcttgccctagggtcgcgctcagccctcaactcatgctcactgccttccttatggcgaagatgcagagttgaggatgacgacaaatcgacagcaccgacagcggtgggcaggcggcgatgtcgagcggagttaatgtgtagcagccacagcgcactgtgttgaggggagatggcgacacgagacgaggcgatggtggtgggctaaggcgcacggtggtgggcctattggcgagccggcgatgacattggctgggggatggcagtggcgacgagccacctgggaaggaagaggggtggttcaaggcggcgacgaagtggaggcgtggggtgctcgaagcagggaggttgtccattggtttcactaatcctgctactaatccatcggctaatccaactcacaacgtaggtcgttagatgagaggatccaacggttaggaatgatctgggtatattttgttaattcattttgactttttccgtagtcaaacttaaccaagtttattaataacatatttgttttgtatttaaaatgctatgctaacttgattaaacttaaagtttgattagtcaaaacaacttataatatgaaacagagagagtagatgcctactaattgacttactatactgggctgcaggaat

SEQ ID NO: 58249 - DNA, 959 bp, Oryza sativa
acttgtatctttccttgtctttaggaaacatggtgtcgcgtccgatatgaactactatctaaccatgggtgtttctttgtaaaatgtaatctatctcttgatcaatacaacttcagcgcatatcattggacatctacttcaacatattatcatcggtcgattggattgattgtctttatatcatatttatctaagcgttaaaatttagatcgggcatataacctattgtttaagaccatatcgacatcggctagtactgatacattggcttaatggttgatcggttctttgaacatcaatttatctatcttgtcaattacaggatcaaactgactggcacacccaaacctgatattttaggacttgcactggagctaagcaaatctcccatgacttcaagtgtcacgaagaaatttcacgtcaacacatgcccatatatagatggatgtttgttcctcctttttgttgcaagttttctgtgcattatattcttattagacactctccaggcccattcatgaatgatcctatgtacatgtaagcttctctattgcctttatgtgtacatgaagattatttcgtataagccttttcaagtcttacttcgatacctcagttatcttgtatagttaggtataattatgatcaataattatttaaaaagtctatgaatgatatcgtccattcaaatatatgatccaaatgactacaattattctaaaccacaatagaaataatgatgtcggtatatatatatatctctactacctaaaaaaatcaaaacgtttccttcgtccatcaaaacaaaaaaaaggaagaaaataactaaaaaaaagtctgactcccctgcgttcgtttgccagggctggccctccggtatggaaaacggagcgatccattagcgcgtgtttaattaagtgtttgctaatgtctttttcaaaaatggatcaatatgattt

SEQ ID NO: 58250 - DNA, 1383 bp, Oryza sativa
gagtaactaaaagcactctagcgtccatgaagcaaggaatagtttccacttatttgccataacaccatatccttaaatgcattagtacgcagatcagctcctattaacttaccttgataaggagatcacttcctgtcatgaagccctggctctgagaaaaacaaacatagcagtttcagaagaacaaatcatacagaactgacgtaatgaagatttcagaccaaaaacaatgaaaagagaaccacaccagaagcttttcagctgcttcacagatcttgtctacctttgcttcagataatcccttgattcctgtcaggctctacaagatggatccatatattgaaacaatatcagataattatattgtaagacagaaatgggacaattgaaagaatataatcgtcataaaccagaaatagaacaagtgggagatagcatgaagatttgggaacccaattttgcaaccttctttgtatgcatcatgaggccattgcaagtgtagataccagcatcctgcagcttcttcacatctccagagtttatcccttgcgagattactgtggacaagtgcacgagagatggataataatgcagagattatgctcaattgctcatagttcgaattcatggatatgaatgaataatttgcaggaagaaccatatgaagaatgaaacccagggagaagtcaggatcacaccaaaacaacttactaatattgaactcgctagaattagggagccaccagaaatcgtaaaagtacaagagggactcaagcttaaaccctaaaccctccaagtacacaactggttcaactaatatacactcaagttcaccaaaacacaactggttcaactaatgggcagaaccccacatgtttgaactagccgggggcgaattccgacgagttccaccaaacgcgggtaaaattgactgaaaatggggataaattcgaaccagccctctcacatgccacacatcgatcagcaggaaatagcccaaaacagatatcaaatgtggggaggcgaaaaatcccgaaaaaattggccacgatacgaggctaatttacgtccagaacacacgaaattgagggagaaaaactagaagcaaccgaacacgcacagcacaaaacaaccagaccccaaaaaaaaatggaaacacaaaataggctagaatccatctacttcaccgcaaatcagcatcaaattacaatgtgaagagtaaccaatcgaaacgcaaggcagaatgagcactcgcacgcgcgaacacacacgcgcacacgagcacgagccaagcaatgcagtgccgggatacgagacgggggaggaggggatggaaatgaggcggagggcgttacatacacttgtcgatggggctgcaggaat

SEQ ID NO: 58251 - DNA, 2333 bp, Oryza sativa
atgcgtaagaacaactgatgaggcagatttctctactattattgatagcgtacactatgcacacattaatttaatggtggaatagtcattgtcgttaaaacaattaacaacggcgcaatatcaccatcgttaaataaataacaaggacactatcgtggattctatattttgaagaaagtttcactcaaaagtgaatcagatatgaatcagtactgcaagaaataagtatgtcttgtcatatcaattttttttaccacgcaaagaaatattttatttaccgctctaatggatcgttggatgtattttgactgccttggccatctggtggtgttggtacggcacccatccaagctccatatggggaaacaaatgaattaatctgcagtggaggtgctgtccaccaacctacgtcagaagcacaccatcattagttttctgttgatgacctattcactagaggctggaccaacggagacgacggcggaaagtgcgattttacttggaacagccatggcttcaccagacaaagggaaggcgacgccgggcttcactacaccaccccaccaaggaacgccgggaggcaaagcttgaggcgttggaggagcaatctcccgcttggatctatggctcatcacttgaggtttgaggagatatgaggattagggatgagtttcaggaagactgagcgacaagcggtggatttatggattaggggcaaacttggcttgggtctaccgcgggaataagagggtgatttggcgcataaactacgcgggaagattagcagccatggggatttggcgccctagagaagaggagagcgcgcgaggaggaagacgcaggggcgtgcagggaacacccgatcccctttggcgagaaaacgcgttgaatagcggcagcttgtgtcgatacggtgtcgttgcgagtctcgatttgtgtatatcggctctcgccaggtctgtagagagctgtgttctctttcctaatttattgtctttcacctaggagagattgatgacatggatttttgtagagtgcttaacggcacctgttgcggctgcccttagcctttgccgccgatatcgatcggatctccgactcgggacacaagtatgtcttaaaatcgcatcattaatcttaatttagatataagttaatgatcttgtgtgcttccatagttccatcaatcttgtttcctgttgagtgcattattaagcgcgcgcatcactagtcttaagttagatataataatcatcttgtatgttttcatcaatcttgtttcttgtcgagtgcattaagccctatgctggaatttgtaatttttaagggacaaaccacttcaaactttcgatgagagagagcaggaaacatagtatcattgctagcaacaaacaaatattaattccgcaccaaatactgtcccaaacaaatgagtagtccatatcccactaaacagtagtattacttcactcaaataagaaacaaatatgaattatgcatcaagcactgttccctgctgttttttagataatggattaagaaaccggcctctacatccaactgttccctgctgttgatcggtgaagtttcatttcgtcgtcagatggaagggctcgtgaaatactgctgtcattgtttgcttggccagtaaatagaaggcgcttatttcatcctgttgaatatacaattggcgaactaaatctcctgtgttggttgaacctttattctgtttgttactcgggtaattacaacttggactttgttgattctgcttcacgcagttgtgcgtacatatctgcgatttcttttgcaaagtatgccttagcttgcggtcttttgatctgcaacatcattgagatagagaattagcaccttaggtatcgagatctcctgcaacagaattaacgggcctaccttgaatgttggggtgaggagaccattttctagtgtgaaaggctcagcaacaagggtaacagctttggcaaattcaaaacctcttagctggtacagtaagtaagcacagagagatagataaggatcatacacatcatacagaacttttacttattaagagagcatgtaaggtaagaactaagaagtgaaaattaaacctgtgcctcctttccaatagagtccatgtcagccaggacagcagctcttgcccttgtatcagcgcatagctgtcttaaatcctcgtactgtaggttagaaagggaagatcataacataagcaggcaatgcggatgtaaggagctctatttgtagttctgttttttaataaataaaggcagtgtttgtgtagtgaactggaaaatatataataacatacaaga

SEQ ID NO: 58252 - DNA, 1616 bp, Oryza sativa
attcacagaactacaaaatacagcaaattctataatttagaatagcagtgagctttcacatattagagtttcatcaccaaccatgcaaatctcatataacaaacaatataatggtgagaagaaaatagtagaagctgaatgaagatttcaagtatgcattaatatttaacaacttaatttagcaatcactgatctggatatcattaggaaactgcaaggaagctaaaagtaagtcctaagatgtacaccctctctttggaagatttggaagcatagaaaaaattgtgtgtttaacagcattaatctcagtgtaactacagttatccaaacagtgaccaatgaatgttggatcatgcccagggcttcttagggagtttcctaataggtcgcttgggtgaggttgttttttagtttgtgtgtttttcatgtaaaggctaaggtttgttggtggtttggatgagggtgggcgttgctcccttccttgttcctgttttctcatgtattcaagaaaaaaagatgcactccctctgtttccttttatgaggcctaaagttttttcaatcttgttgaaaaacagaaggctttcatgtgaatttattgagccttttctttattttgccccctttatcacatactctctcttgcatataggaagcatcacacatgacactaaccatccactctcctattcctaaggtatttaattaagtatgggtagcatggtcattttaactcctcttcttagtattgtaccgccttagtcctcttgcccacccaaaataagagctatattttcaaatggaaggagtacatgaaacatcactaataaaacttctatgcatcataatttattttcgcaggaacttgtagcatgatattttcttctgcctaggaaaaaaattaatttggaagtcagaactttgctggatagtagatcaatcctattcctatcttcaccaaactcatgagactgtttagcaatgattgaaaggatgcgatggcaaaattatcaaggaacaaaatagatattatatgacgaaggcacaaggccattttaattccaaagaaaatggctgaaacacaaacggtagtcattcagttttaccctatctatattttttaaccgccctccaggcagccacaaacttatgtctccagtgtgcaaccaaccgtcctcatcaatgacctctctcttgcatgttttcaaatgtaatttctgaaactcatttaatatatttgaacttaaataggagacagaaatacatagcaagatacgttacgtttggatttcatccttatagtaaccaaaaaatatcgtagttcccctacacaaatttctccacgaggatatggttgatcctcagaggtgtaattcatttctgggacatccactagcttaatctctgaaaaatggcaacaggatttacattatgagagtgtgatagcacgcaaaaaaaaacaatattttagttgaagatgaaacctagacttatttggggttaagaaaggtaaatatgagatgtcacatgttttacatcagtgatgggttactatgcactacaactatatgaagcagacttgacttgatgggcgtcatgaacactaattcatagata

SEQ ID NO: 58253 - DNA, 2007 bp, Oryza sativa
cagaagcatactgtaccatgcactgacataatcacattgctcctctttggatgctatttccaaggtacgaaggattgacacgctgtgcttatagagtttaacagctgaactcatgtcttccagtgcctacgttgagtatcatatcaagaaatttcaataacccaatcaagatcatgtcatgactcatggaaacaagggcagaaggtaatggcaaacagaaacattaagtgcacatacgtatactgaaatcaagcaaaatgacatgtcatctatgaatcactttgcctggtacaatctatatatcactttggaggcaagttcaatgcagcttatagaaaagcacaatatcattttcacatttaattatgtttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcagaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgcactgaacaataatatcaagtacttgagttgatcctagaaacaaactcaatgtctcacaacattaaataaatttgtcgggatcaaaagtgcattgcatgcacatcaatataacaatacacaagcaagttgtgaaaaagtcatgctttgataaacatacaagaataaaataatttatagcaaaacattaagcggagcacacctgaatctccctttcagtttctgtcatcacttcattcttttcatcagaaagcatagaattcttctggctttcctgaatccgtatcaattacaaaattatgaacggaagataaccaaatgatttatcagaatataatcagtagtgactgaccttaagatccttcttgtactgggatattaccgtcaatgattcttctctcagcttatggtagaaatcaatcaaaatcctatcacttgctgatttaattgaatggttttcatctgttccaaatgaagagttctgatcactgatcattagtctgtatcacatggggaaaaagggggtgaatgtggagccgaaataccatgaatactcaccatttcagtattagagaacatatcagaagagctttgcacactttctgaagaacattgcataatgtggacagcatcaatcggttcactttctttgtacaggtcgagtatggctgcattattgggtggaaaataactaaaggccttcacactttgtccagcggactcacgagttccaacatgatctgtagtttgaacattgttcaaattttcgctaacactagtaaataatgaccagccctcctggtcgctgctcattgactttggtacatcctgacaaaataaaaagattcagaccaatcagtggagaaggccatagacatatcaagacctaatacagaaaaaaaaactagaaagaggtcataacaggatttctaatgctagaatttcagaaatttttttttaatcaaaagatatataaggataaaattcatcctttgtttagcagggactagggaattcttataacaatgtctgtgtgctgttaaatttactactccgtaagtcagaattttatactatgtatacagattgtaataggcaataaaaatccttctaggcagcttgactgttcaacttgaagaatacaatcacatgatttattgatttaatttcgtgaggcaggtcg

SEQ ID NO: 58254 - DNA, 12665 bp, Oryza sativa
ggcggttggaggagaagaggacggaaagcaagagggaggctcgatggtggagccgttgatcaagttgccattgccaagctgtattccatcgtcagcgccagcaaagagaatgtgtttttttttcttattttccttttttaggaaaataatttctttgatttctttcattggctttgctaggttggcctattgctggcacctgaaatgttgaaatgccaactttgagagacagatgtgctatttcaaacattggcaataaacacaccaaaattgaaagtttaatggaaattggaacgatgtgacggaaaagttagaagtttgtgtgtgtaggaaagttttgatgtgatggaaaagttaaaagtttgaagaaaaagttgggaactaaaccaggtcgaaataagaatatgcatgtttctcaaatttatatggttctatcgtttgttctttcagcttattagccgtagctaaactttgaattaaaacttggttttagaggtgatttttatttttttttattgtagtttgttttacataattagattttaagccaaaatattacttgtaagttttttttttctaataagcgttgacttataatcaattttttgcgatttacgtaaaatactttttgtatatatgagtttccttagaaaagtggttttcaatttatttttaactttataatatttaattaattcatttataccatcaaaataatcgtaacaaatcattcaactattcagcaccgcataacataccaaatcattgacaccataaaggcaatgtattgttcataggaaaaatgtctgaacttttagctcccaaagctcaagtcacaatgcagtgaaggactgaaggcacaaaaatgccgagagattgtagaatttgacaccgattgcgtgcagttcaacactcccaactacttgtagtagaattcccagcctacagtacaatgagtccatgttttggtcgtcaaatcgtcagttctgcactatccgttcctattcattcattcttgggtttgaacagttttatgagataaccaatcaaggacacgagccactgccagaagcgaacgatggaatttgacgccttcggtttgggttcgggccttggaccaaagaggcctttgtacagctccttctgtttttggtacagagctttatcctgttccgcgagagaccgaagctcacgctggatctccttgtcttctggggaatgtttcttggctttcaggaagtcctccctcgctgattctgtctgaccaagttcagctcttgcttttcctcgtctgaacaatgctttcacattgttttcatcctctgccaacacctgaagaataggattatgagttcatcatccagtcaataattattcggtttcggaaaaagggggaaaaattcttcacttgatgaattgccaggtcagttacgtcatgaaattagtgagggttgtcttacaaaaataagttgaggaaaatataggcaactgcactatattcttcactttttggtccaagcgtctagttaccataataatatcatgttgtatgtctttattgtctgaaagtcaaatcaaaatcctaattcatctgaagctatacacaaaccgactggtgtgagtgtgacagcatgagttttaatagattgaactttatgcaaacaaaaaaaacttacaatactacactgtgcgatagcttcatcgaatctcttcagtttgattaggcatgcggccatgttgagatgacatggatttttcacagccaaggccatatctctgtatttcccgaacaattgaaacatgaagtcatctcccatgtatgcaatcgcctgtaaagaggaggagctagaggattacgattagagaatcatctcacaacagttgaagaaggacaactaaccatttcatattgctgcatggcctcctcaaacttcttttctttgaaatactcattgccctcaatcttcctcctgtccgctgcttcaatcctttcctctactgtcatgtcacttcgggctttcccctgcagttgtacacaatttgtaaggttccttagaacatccaaatcaccttgaaaaccataaataaaatgaaaccaaccaacaatagtctcagattactatcagaaataataaggagaagcattatgttgggtggagatggtaagaaggatgtttccctacctctttgacatcatcaaacccaataagttcaacttcatataaaagatctgccattggagggacatttgggaatgaaaagctcccttctttcccatagcctagctcccagccaacatgcaacagtgcacgctccccacttctcatgttaccaacaccaatgcctaaaccagacatttgttttttctctgtcggtaaaaagagaaaaaggcttttattccatatgtgataatcactgataaatcccaggtatactctacatgctcaagagtgtccaaaagatatttgtaggaaagttatatagttaccctgtacctgtattgtatatttagtgaaccatcagaaaacagggggggaaatatattagtaataaaaatataactatttagtctttatgtccttgcaagttgtcaatcgccctcacacacacacacacacacccaaaaaaaaaactagaatatcaatagcaagttgaaagttgctgatcgatcaactgattttcaaaacccttattagaatcatagattatttgtggcactataagatcagaatggcataagagtaagctatttgatgtgtatcatctatagaaggcatgcatgcagtgtagaagaactagggataaaatgaagtatcattattttcaccttttccaattactagttcaatgggatgctgttcttgccaagtatcctcgaatttatgcagagagccttgaacccaagctctatagtgcactgtaacagaaaaaacagaaacaaacattatgcagatgctctccttctgaataagtatatacatggtctgagaatggaagattgatctgtaatagacagacgttgacatgcttatacaaatgatggacgtgccacttggtaagaagtgctcaaagctgatgattcatagcaaagcacaagtgcatgactagttttaaatatcatttgctctaagttgttatgagtttggtgctgctatgtgccacactagttattagtaagcctgtggtgttagagaaggctgtgcgtacatcgaattgttcatcctaaaatactgttaagtatttcatgatttctggtatctgaataagaagctctttccacagaaagttccagtactggcaatttagttaaaaagaagtgtacaaaaaagaaacagagagctaggagatagtacaacagagcataaatactgagcccctagtacatgtaactttacaaatgtatgttctgagcccctgatacacagagaataagttctcttattatggaacttccatagaaacaacaacgagatgaaatgtgatgataagacaaatgctaatgaaggtggaatatattagcctcattctataaatcaccaggataaatatagggaatgatcaaaccatttatgacatacaaaagcacgtcgcgaactttgatggtttcttgccatggccttctttgatgacttgttttttaactttgtcatgaaggacctccatattagaggaaaccacaggtgggacagagccatcttgcggaggttcagtatgcacaaaagaagcttcctctacagttatctcattatcacttgaacctgaaaaaccaggatacgggttaagaacaaagggaaattgaagcatgtttaataaagtactccctattttaatacaaattctggttctatactggtcatgttgtaatgtagggtcgaagtactatatccaatgttcagtttccaatagtgcgtgtttgttgattagaaggaaagggacaacgtgagctacatttttcgctgtctagtatccactatcatgtagcacgccgaaccatttaagctcctcttaggactccagcctccaggcatgcaggggttttcttttccagatttctgttggaagtgaattgttttaaagcaggccagagaaaaaaaggacaatagacataatccatatggttactgattgttcctgtagacctatacagaaatcaactgtatcgttctatacagttgaagcaaattcagaaatcgatttatacttgaacttgtttctccggattcatcaaaacaaagggagaaagggatgccatgtcataattaatttcactattaggtctaccagtacaatttagcatttgatttgagcatcatttggggtacttgtatcaaggtggaaactgcaaaacgatttgaattctgcctgcgtgctcgggagctcaaactaatccaagcacataatctatacgccttccttttggatcccaacaaaaagaaaaagaacattctacaccgaaattcagaaacaaagcacatccacagagcaatagccacgcggggctggtacggggtagagtggggcaggcgagagaaaagggaggctcaccagaggaggcgggatcggcggcggcggcgggtgccggcggcgagccctcttcttcctccaccacagccatcgcgcgcgtgcacggtggtttggttgggtttgggggcttccgagctccgaggcggacggttcgaggagatgagactgagaagtcaaacagttgagaataccacgagagactccagcagcagcagccgccagcgagacgtcgccgtccggccgccgcttgatgcgggcttcccttttcgacgcggccgtatcaaggaatccccatgacgccaagctctacgctattggtccaacttcatgaagaaattcttattgcacttaagaatttatcactcgtaatccctccgtactcgtaaagtcgtttataacagcgacacggtctccaaaacacaactttgacttcttttttctataaaaatatttattgaaaagtgatatatgtatacttttatgaaagtatttttcaagacaaatctattcatataatttttatattttcaaactcaacaacttaagtgttattcatgatttatattcccaaggtttgacttaaacattgtcctaaacgacttcctttataagtatggagagagtaacttataactcgtggaattcttatatattcatgatatgtggattcagtgataaatacttaattgtcattttaagagtgacaaatagcaaaatttctctttcttacgagcctcattcaatttctgttgttcttttcacggttcaattaaataattatttatgtactttataatcataatatgttttgtaattaaatttctatcataatcttatatttatcccctttttctgttttcttaatattgtgcttcgaaggaaccttaagttcccaacaactgatgtaatatactaccttgatctaaaagtcttcttcgtatttctttaattactaagaccaagaagaaactacctcatccgattaatactccatatttagcaaaattctcagcatacatgcaatggtgttggactgttggaggatggctggtcggttccgaaataaacttaattcattgttgctaaacaaagatatactctcttcattcaagtcttggatacatagaaattacaaataggaaaataaaatagtaagaaaaatttaggtggagggaatatatatttcactacaactagacatctcttgttagctgaagtaacaagtataaaaacagaccagaaccagtagtacttgttttttagataatagatttatattaaacccagcctatacacaagtagtacttgttagctgaagtaaccagtagtgcccatcttacagtgcagaccaaaatccataactctacaactaaacttggtagtcggctgcagtgaattacagaattgcgtcaaccgggacaggatgccggcaagatggggcagcactacggcagcgtgccgtgacagacaaacgtgctggctccattcatcatcagacaaacgtgtaagatcgggcagaaacgatcccaactggccaactatgcgttctatccagaggcagcagctgaaataatgcacatgctctgaaacagtcacagctactcacaatgctccccttgaatcgaaacagtcacgtttctcgcggattgtagtagaattatatatttacatcattcattgctggagctcctagctagctatgctcacctcataacctctctgtatgaaataccaagatagcatatcaccttggcaatacaggctaagctactacagatcagagcagagcggtgcagcttcctgccaaccaactctaaaatgttccaaaaatgtgtccactcactaggataactactattacctactcgttgggaagtgaatggatcagctgaggagcagcatcacccaagacactggatgaagctttgttctgtcctgatgagctgctggatttacttccctcttcaaattgtcaagttgtacttatttagctttcgccagccagctttcagtgttttggtgccaacaagaggtacattttgacctatcatagattgtcttttcaacaagaggttgtagacaagctcattccaggtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaagaagagattcccactggttccgcccaattgaatcaccaacaaatactactcttttgtttctcaacttctccagcatatttctggcatcaaatctaagaaatcaaagaaaataatggtgaaatcagaatatgatatcagtaatgcttaattggatatgtgaattattcataacaatacttcttgatctacaagcatcagtgaggcatcatttacatgctcaaaagaaaatgaaattacaaggtcacaatcatcttcttttttttcctttatggactgttttattgagaaatcaaaggtgccccaaaagtttttattttaaaaaaaagggttaaaatcagatgttccactgttttctcataaaaaatatttatatgtttaccatagtatgtaatacagtctaatgtgttacagtaagcaattatgaaggataacaaattttccaacatgtaaaagctaccgatagtgatgataacaagaatcagtattttttctttcttctgcaaaaggcagaaacccaatctgagaatagctatacttttctgaaacagaagagacaacttttcctttctgtaagaaagacagcttaaccgaacatatagaacactggactctgacaacaaacaagacgaggtcacatttccatcaaggcaaaacaaaggtgaaagatggcaacaccatgaaagctacagacagactactaattaaacaacactagtttaactaatttatctctcggaggcctaaccatgcgcataacattgttttctaacccagtggggagcataaggcatcgagtttccaatcgcggtgcacagttcctaagtgcggtggtcgtcaacctcatttcctgtgcaaataatctaatgctcacaagggttcagattataatatgcacactcaccgatccaatctcaccaggtatcctgctaaaagggcccaaagtcagaactacatctgcaaattaacaatcattctaccaacaatgctacatgtatgagtgctagactgaaccaagtttatccatcttgagttctttacttctccaagcccaacaaattaggtgtcacccaaactagccaacgattcatatctccattactcgaaaacaatgcgcatccgaaattcatactcgatccaccaacaatgcttatgcaccattctgaatgtttggattgcagcaagagatttcgcttgagatgtctagatttctccttcacgagattgctaaagtagacaatcgagtagattcatctaaacccccaaacccccaccaaatccaaccgagcggaagcgtacaagcaagaacttaatcgaacaaaccgaccaacctggggagatcgcagcgcgacggcctccaccgccacttggagtaggacgcgtcggggcggccgttctcggagcaccggaacccgacgtccaggaaggggcagtccgtggagtggtagagcgggtagctgtcgttccacacccactccccgtcgaacaggtcgcactcctcctcctcctccccctcggcgcgcgcctccaccgccgccgcctcggccgcgatggagaccccgccgctccagagcttcccgggggccgccgacagcgcgaggccgacggccgccgagcagcggagcgaggcggcgcagaggagcagcaccagcgcggcggcggcggccaccgccacggcgagccccgccatcctggccttctccagcaccggcctcttcgtgacccgccccgccagccgcttcgccgccgccgccgccaccaccaccgccatctcgatctgctcctccacccagcgcgcctcgcttcctggcagcagcgaggtagcgtacgggactacgggcgcgacgtcactgagacgggaggttgtgcgtggccgccattaaaggcgaagtggaggtctccaagaggaagaggaggatttgagagggagatgagtatttgctttctgttttagttcggcgatttttgattggaaagcgatgcgtctactaggagtaggagtagtcatttgccataacggctgtggttagtggtgcggtttggccgcgtaggagtagtagagtagcaataaattcgggcgtggtggggagaggaggagtgagtacatgtcaagtactcgtactattaaatcgagttggatctaatttgtgttgcaactgctgatgaccccttgattcgaacgaaaatcatatgaatcttggagtatttatatttttataggattttttctatatagcccttaaagttaaaggaatgaatcatatagtcctatgtaattcctatgtaatatttcattccatgcaagttttatagaaaatttaacataatgtagaacctgagaaagttttctttaagtctttatccctcttcaaattcatatgtatttctttcggtccaaccaaacggttattcatttgttttttctatgttttctaatcatctattttatgaatcatgtctttttcatattcttctatttttcctctatttttctattcatgctattcaaataggcctttgtttttgttttgataagcactatggttgtgattgttaattttattttatttttttatcgggatgaccgaaggaagttatctgaatcttattatggatgcttgtcaaattatgggcacatgatttttatgcagcaaaatgcaagtattggcatgtgcagttgaataatttatgcttaggaatatcaatcttcatttatcccgtgagcacccctactttatccgtcctaaaataaatcaaattaaaataggatatgacataaactagtagtaatgaatctagaattattatacttaggattattttctatatatatatatatatatatatatatatatatatatatatatatacatatatatacatacattatatacatacatatatatatatatatacatatatatacatacattatatatatacatatatatatatatatatatatatatgtttcaaccatagaaattcgacattgttgcatattttatattgttatgttgcaatgtttttttttaaaaaaaaatgcaaatgatgttgtttggatgtctcaataagtttttttttaatgtttcactagtatatgtgtaaatgttgcacgtggtattatttgattgtttcaataagtattgtgtgatgttacaccagttcattcacaaatgttgcacttgatgttatttggatgtttcagtaaatatttcgtgatgtctcaatagttataacttgatgtgccatgtattatacaagaatatctagttagaaatataattatatatttttattagaaatataagtatgggagatcttgttttaaagatttaattgtaacaaatatagaggtacaatcaaatatcaaaaaagataattaatttatgaagaaaaatagtttaaagttcattaaaaggttggttagagaagagtgagaatatgtttaccatgcacctaggtgtgtatgtgcagcagcttgcgacagtgcatgcaggaggggagtagtgcatgacccacaacaacatgtatggggtagttgtgacttgtgagtgatgtgaataagtagggatgcgagagtctgatgtgttgctttagttaaggattgttttcccttttcaagaacacagttaggatagtcaagtctggaaggaaaagtccactttgacgagtgagcctaataagcagctaacgccctgcgcctggctatgggtgatcgagcctatgcgagcacgagaatcgcgagtggaaagcaacgagaaagcatggctagatcgcgcgaatttgacccaccaagaattgtagcccatgttcgtggatctaggggtctgtttagattgtagccaaaataaaccatattaaatttcggcaatgccaaaattttaggaagatgataatattgtcaaaattttggcaggatttcttatgtatttaccatatttgacaacaaactaaacgtagacttttttttgataacttttaaaaaaaatggtttggttgaaaatagcatcaaagtaacatgccataagacaagcaacctaggtgcatgtgcatcccatagacttgtattaggcttgtttgagtttaagtccactcgatttaattgagcttttaaaaaaataacaaagaaaaaaagtaaaaacaatttataacatgaaacgcaagtactattatacatggaattcagcctatcaagggccataacaagaagcaaaaggaataagtttactttaggtccctctatttgtcggtcagtgagattttcgttccttaaccgcaaaaccgggtacgacccgtcccccaacttatgaaaccgagcaaacgagctccctcggcggtatagagggcggttttggccgatgtggcatctacgtggcacctacatggctcctttgactaggtcttcgtcccatgtggcaatgacgtggtgcttacgtggcaatttcatcccggaaaaataataaaaattgtgggacccatatgttagctacaaaaaaataataaaaaaggtgggcccatgtggtcccacatatcagcctccctcttctctctatccccccctctctcccctcccacactacggagagaaggcgagtggcggcgctgaggggcgacggacggagcagcgacggagcgaagcagcacggcagccggtggtagatggagcggcgggcggcggtggacggtgagcggctggcggcgggcggcgggag

SEQ ID NO: 58255 - DNA, 8771 bp, Oryza sativa
tgctccgcttcctcccgccgcccgccgtcgctccgtccaccgcccactgccgcgccgcttcgctccgtcgccgctcgcccttctctcctggcaatgtatgggatagagagaagagggaggctgacatgtgggaccacacgggccacaccttttttattaattttttgtgtagctgacatatgggtcccattatttttattattttttcgagataaaattgccacgtaatcgctacgtcaatgccacgtgggacggagacctagtcaaaggctccacgtagacgccatgtcaaccaaaactgccctccatactgccgagggatcttgtttgcccaattttcgtaagttgggggatgggtcgtacccggttttgcggttaagggacgaaaatcagactgaccgacaaatagagggatctaaagtgaacttattccagacgcaaaattgtcggtgctggcccatggaactaaaaccagctcttgggccaaaccaggccaggccgattgtccctcacgccaaaccatcacgtgtgcgcttcgaccttcctccctcgcgatgggacccaccaagttcggcaccgccccattccctctccgcgtcggcgtcccgtctgttcgctacgcacgcactcactcactccccaaattccccaccacattcccccgcgattccctccactccccactcggcagctcgccattccaccaccaccgcgccgccgcggcgcatcgggccatggcgcccgccgccgccgccgcgtgcgccgcctccgtccgcgccgacccgccgggcatcctcgactacggcgccatccacgcctgcctcctgggcggggaccgccgcgcctccctcccggcgctcgcgctcctcctcctcctccacttccgcgtcctcgccgccgccgcggggacccacttctcccccgcggtctcccgcctcgcggcccgcctccgcctctccccgtccatggccgccgtcacgctcctcgcgctcggcaacggcgcccccgatgcgttcgcctccgccgccgcgctcggcggggccggcgggatgcggcgtgcggggctcgccgcgatcctctccgccggagccttcgtctccgcgttcgtcgtcggggccgtcgcgctcatcgccgcgccgttcgctgtcccgcccgcgtcgttcgcccgcgacgtcttcttctacctcctcgccgcctccggcctcttctacatctaccttagcgccgagatatacctctggcaggccatcgggctcgtgctcttctacgtcttcttcgtgggcttagtggtatacatggatttggatgctgaggggaaggcggtgagcaccaccgagctggaggtggtgaatggcattggtcgcgtggtgatggacttgccggtaacagtggaggatcgcaagcaacaacaccctactttgtgcacgatgttcagtaaggtaatgctccaatgagtggctcccgttagtttgttttgtctccactgtggttaatatagtattgagtagtcagggacaagtattctaatataaatagtttctttggtattcatttgaagatggtcgtaaaccgtcaatttgtttatgtgcaactgacaactgtgcaagattgttgacttacccttctagtttgaactcactgactgtattgtactcatttagggtaagctttagtttaatggtccaacttgtttgttatgcttttctatggttcaatttgtacaaacgattctagtatagatagttactttcgaagtgcacttgacttgaaaatacagtactaatgtgaacagtgctataagctgctgattggtttatgttcaagagtgttaacttcaccctggtagtttgcaattactggctgcaatcaacagcgagaaacagattactttatggctagtagaaactttagtagtgagccaatgttcccctgaaaaaatagttgttttatacaatacccatacaattgtagatattaagtagaaacaaacattaaatactttgataactcagtagtacactttgacagaaaggtaactggtaacaatgctgcaattcatggtgtgtttgtgtactttgataattttaagtagattttttcatgatgcaacctattctgatttactatatgcacaggataatgtacttttaacatagatacaattactcagcacactgagtgctaatgtacatttgatataaataggattactcagtgtactgaataatgtatcatgctaaacaagctaagtccttttagctgcaccaacatcatgccttgctgggatcaattcgctatgagtttatttatctgtatgtgattaggcagcttatgataaatattcccatttatagtaatggttgaagttagtaatgtcagctttgctactatgacaagaatgcatcgactactgtattgaatatatacaattgcttaatgatcaaaagatttttaaacttaacagacttgctgattgtttaactttgtttttatgaggaaatcgatggcatgttctggcaaatcctaagttctcatttccaattttttgtgacatttagctccttgtttcttattagactttgctaaaacatgaatattttcctctcggcatctgcattttcatgacactgattgtcatctacccctggcaggtgacaaaagtttgggagtggcctgtagcatttcttcttaagctcacaataccatcaacgcttcctactgaatggaacaaattttatgtttgtgcaaacatctgtctatgtcctctcctactcctgtattctttcagttcattcattccatttgatagccgaatagtatttcttctccctcaaagtcgtttccccatctggtccgtggtgcttttcgtgagcatttctttagccctgtcccacttcatttttgagaaagaagccccaataactgaaaacattgcaagcaccacaatttcctttgtaatgagtgtcttctggatctcaaccatggctggagagctcctgaactgccttgcagcaatcggagtcattatggatttccctccagctatacttggcatgacggtcttggcttgggggaattcggtgggtgacctcgttgctgatgtagctttggcaaagtctggccagccgacaatagccattgctggctgctttgctggtccaatgttcaatatgctggttggactgggaactgcacttgtaatacaaacagccagggtgtaccccaaagcttatgtactcgaattccatgttggaattgttgttgcatttgtatttcttcttttgagcctgatgggcaccctgttgatggtcacctggactaggtttcgggttcccaggttttggggttactgccttatggggctttacatcttgtttacagtagtgagtatagctatagcgagctcttctggatgatacatatttttatacataaatagcagctagtcgtttgcagtatatataagtgtttgcaatttttccagttgctgcagagcaatggttcatttcgatggggatggttcacgaggtgcaagatgcctccaggctgcaatacaacttcttatcttggcagctgatgcatacagcccttcacactgaattggcttgtactggtctggcatgttcctgtggattcttctgtaccttcattttacgagttcatgagttcaggccagaggggagatcttgctggcgatgtgcatcagtgcatgcactgtctactcggttcttttggttgaatcactgcatgtgcggatgtgccgcagcgtacacaagatatcactggatctctttcctgtggccatgttttatttttctcgaaccggtagcctgccgtcgacgttttatataaagaaaaagaaaaaggacctcatttttaaaaggaaaatgggattatggcagagaagtaactcaaagaagaggaccctgcaacccccgaaggagacctccagcgatagagtcgtagaggcatatgcattcgctccgctctcttgcacgcgtcacttctcttctccatatctatccatcgaccatcgcaggctacttcccggtacagttcccctctcctgatctcctctagctcatgccatagtcgccactcgccactgctgcaatggctactgaaaaactaccaatgccacaggccaaaaaccaaaaagtatagcacaggtacactcgaaggatcgacgcgaggtgaggaagttaccgatgcaacggaccaaaagccaaaatctaaccccgctcgcaccagctatgcacccttcgtttctatacgctcgacggactcgacgcccgggacccggccgagaacgggcgaacaacgatcggattcaggatgtctcggggggtcggagagaattagtgctggtttggtttgtggcctaaattagtcttaccaatttttgtcaatgtcaaattttgataacttttggcatagctaattttggcaaaggtaaaattgtgtttggattaaagccaaaatagtctaaattaaccgttgaaatggcctattttcttagtcatgccaaaatttggctccaaaccaaatagacaataaataatattgaaattgccaaatattggtaaggccaatataggcctcaaaccaaaccaacccttaaactccgcctctccatctgacccacataagggcaggcctactttacgtggagcaacctgcatacgcgtgggccggccttactagttactagtctaaggcttaattcggagagcgctacgtgtcggacgtatggcgcgagacgaaaaatcggacgtctcgcgcgaccgtccgatcgatgcacaagtgtgctagccatccatcatgcatgtatcaagccatccatcatgcatgtatcaaacgaattttatactattttttctcttaaaatatttatccaaatcataatccaattgcaccattaaatccgttgcaattaaatctttaaaacaagacaacacatgaatataatccgatgaaaataattagcttattattgaattatttttaaatgttgcacgctgttgcgctgagtatattgtaattgtttcactaagtagatcgaaaatgttttatcgaacgttgttttaccttatataaaaataatgtttcagcgaatagcgaaaggatgtttcaattcactacaacatttgatctatacgtagtgaaacatcatgagtacattaggtgaaacatttttaaattaaaaaaaaatcggacggtcaaatgttgcagttgaccaacaagtgaaacattatattatatatatggtgaaaaaaaaattagcaactggaacatttaaatattttatgaaacatgatgaaaatgcacgttgaaacatgtcgctgtcacacatgaaacaacaagtattaacggattgaaacacatgtttttcttttatcaaaatataatcaagcgatatcttattataaaaatttaattacaacgaatacaatggtgtgatcggatcatagattgaataggtaatttaagagaaaaatcattttgaagcttgctaaaatacatgcatgtatgcatgcatgaggtggagagagagtagtagtagatagtttcaggaattttgtgaaacacacttaagacacatattgaaacatatcactattacgtatgaaacattttgttttaacggtttgaaacgtatgtttttgttttgacataatataatcatgtgatatcttgttgtaaagatttaattgcaacgaatacaacagtgtgatcagttcgtaaattggataagtaatttaggagaaaaaatatttgaagagaggaggaaagaatgaaaagaaacaactaggtatgtgcatgtctgttacattacgacaagggttcgtctaatccaacagggtgctgatttgcagcatttttctgacgtcaacagagagaaaggagatattaacgagtaaggattgagctggccgtagacgtccgacgtttttcatctgatcggacgttcgaagagaagcattttcggcttaattcacgatggttcatgggggttcggagaattaaactccgaccccgctgcagcctgcagaaaacgtcccaaaagcctctcactgaagaggcaaaagcatccatggtacacttccattgccactaccagactatatctcaccttttttttataaaaggattttcattaaaacccagcctatacatcacattagatgtacacaaccaaaattcagaacaaagcattgaggctcactcccattacatgagaccaaacacacacgtactaaaacagcttagagagtcaataaacccctgatacaagagctaagctccccaacacatacaatcattactcaaaagaggagtctaatcacaacaccactaggcttcgatcctcattctgtagttccatccatacatggagaagaactcaaggactgttagtcccaacctcttgcaatattcgtttaccatgttgctatcatcttccttaagaagcacaaatcaaagccttgcccaatatgagcatctgaaaatcacctctcagcctcacgccgccgcaaagacgtatgcatctaccgtctactttctctatcttagaaaaaaaaatcaacttctaaatacgttggatacgatcggacgttgttgattttttttatgttaccaatgcattctagtaaaaaaaaaatggaatggccaaaaccaacatctacccaccagcgatgcagccatcgatctctggctgccatcgaggagtatactgtatactcgatactcgagagactctgccagctgccatgatgtgcgtgtgctgtgcccggacgtggctgcacataaacagcttccagtccagatcgtcctgggaggtcggagaattgaactccgaacccccgctcggcccatccatgggccttcctaacataatacgcctgggcctacaagccaaaggcacaactcgcatcccacgcccccatggcccacaaaccaccacaaagaaaagatcggccgcatcgggccatcgccgcatcgatcgccttccgcgccgccacgccgcagcggcggactgacgacgccgtccgccgcgctccggcgtcccgctcgccgccggccttctaccatgacgatccgcaggtacacggcgcccgctgaccctagcccgcactagcagccacaagcggagacagctctgccgcactcacacggtcctgaaatcctgatgagaccttgtatgatgaacttttttttttagccctagatatgcagcgtgcctggaggtgtagatcacacgcaacgcaagtcccaacggctaggctcgatgatgagatgcttctgtttctttcccgattcacaggttaaactctcttcattcctcttattgtttttttttaaaaaaattaattcaaatcatcagggcaccctgtaactacgcgttgatcaaacattgatttgactccagccatgaagatgaaatcccccttcatcagattcagaatctatcaactttacctcgcgattagccgattactactgcaatcctggtacgtggagtttcacctttatgcctactttaattgttcaatcaagcaggatagttgaggtagacacactcacactgacatcatcctgcacctgcatgcatgggttcctgatatttctgcctagaattctagcagcataactttctctactcccagttgaagctggtcttgtcccaccatatgtgtgtgtgcgtttctgcgaagcaaaaacgaatctaaacaactggtttggtatggtggtatccaattagaaatgctctgaagaaatgaaccagctgaaaccttgtctggtttgggagactttggtttcgaaactgtgggcacaaaccattcctgaactgttccttcgagatgcttccaattcgtattaagaacgaaaccaaagattcacattaacatgaattggtataattatatgcccaaagcaatactgcaacttggattatttgatgaattgacacgctgaaaagtgtactagattcattggcaccgtgtgggttggcaaattacaaagccaagattctttgcttgcttgcttgcttttctagtagtaattctttgtgcttcccctgatccaggcaatcgctttcgaggcgatggccattgaaataatgtagtgcagtaactttaggtatgcctcttgccaacttgcagctgctatgtttgcataattttagcttagataaactgatgttgtattaattagttgtaggataatttcagtggctgtcattctcatgaaagggaaagggtgaaaacaataatgtttgattccttttcacaaattactactagtagtactagcataacatatttagaagaaaaaatatacagaaaaggatgtgataaacacaaggtctgataaaaaatatcctagaggagaagaacagcagacttgtgctgaccatgttggagatgcaaaggccagccacttttaatcagaattttaactaaagttgacaagtccccatttgatccctttacaatgtatccataccacaaattaaactcttggaacacaatttggaagaactaaagaagaatcccattagcactgaatcacatggctagattctctctgcagtccacaggtcgtgcagaaaaatcagcaaatccgtgggtcttaagtcttatctaatcctgtgggcgcccattggttttgcaacaattaaacaaggatattttggtcagtacttcactactcggaacggattcaactaagccacacacaactatatataaaaaaaagatcaaaacaaa

SEQ ID NO: 58256 - DNA, 16198 bp, Oryza sativa
ccctgtttagatgggactaaaacttttaagtccttatcacatcggatatttgtcactaattataaatattaaacgtagactattaataaaacccataaataatcttggactaattcacgagacgaatctattgagcctaattaatccatgattagcctttataatgctacagtaaacattctctaattatatattaattaggcttaaaaattttgtctcgcaaattagctttcatttatgtaattagttttgtaagtagtctatatttaatactctaaattagtgtctaaatacagagactaaagttaaatccctggatccaaacaccacctcagtcttatttccataatatcgatttgacaataaattgcgtacaactttttatctttcttcctccttttcttttttgtttttgttttcctttaagacgacattgttaattggcataattgcacaacaaggttttgccctgctgagcaatcaatgtcagagttttagctgtgccacagccccacaaggctcatttttgtatatgagggttttttatgtctctaaaaagttttttttaaaaaatcagcctatatgaaaggactgatttagtataaatgtgagtttcattttattttcttgtatttgtgtaaaacaaactgaaacgtcaaatggttttagcaaaacaatttgtcaaatgcttcatcgttctcctcctattgtgtcaccatgtcaagctcttcgcaaaaatgttagccacttgtgttcgttttgttttcctttccattttgtattgcaaggagagtgacttgccaatgattccttactccttggactctaggatattcttcttttttagcaatgagcatatggtgtattgtgtactacgtagggtgtcacacgatatagcaaactgggttttcttttattcttttacttgtttatacatgggactatcaacatatgtcatggcttgcgtaagttcgatattttaatgcacataattcgaattagactattaacttgagtccaaaataatggagtgttgcttttgtgcatacagacaaataaactgaataaaatacaaacgtagcatgtccggtggaaagttctaaaacttctattatctttatgttctttttatatttggattggatattcaaaatggtttaatgaaaggtgtaacatagtatgtaggttaatcaataatgtacctaaaatgaaaattagttcaacttagctactctttccattcccaaatataaacatttttgatatttaaattttgtacacgctcgaggaatggtaatttttggtaacgaagaacaagcactatacaatgcagatcagtttggcaacaagaagactgcatacattattttccggaagaattatgtatggttaaaagacatgaatattaaggaatgacctaatatcaaataattagatgaagttatgcttcgaacccagattatctagctcactatcttgtgtagctagccagaaaacccctaggcgtttctcgaattatgtttggttaagaaattcattgggctaagactgaaaaaaaagcttacattaattaataagacctctaaatctatctacacctatattaattagacactctgaaagagcttatgtgttaaccagaaagaattaattgttgattaggtggatcgtgctatcacaacctagataatctgtgtaatgcatgggctggtgactttatgaaattaagtcctaaattcaacaaaattggctcggctcagagcagatactcgacttttctcgtccgctcagaggaaaatattattctctgaagacgtaattaacgatgagtcgatgactcatccctttgtcatccaattaatcatctaactgagttaattgattatccacttgttttcttctctaacgtaccaaagcgacatgtatggtgctggattcttgattccctgagtgaccaaaaaaatatcatttcgtttcttgcaaattctttttgtgcataattgagcgtacccgacgggaatggggaattagatgttttagtgcaagtcaattttaagacagatcattacgaactaaagggatgtttaatggtgtggacgaatttggggtgctacgtcagtcgttttctctacaacactacaacagtgtcgtagttcatgctgtccacttatcagcttgtggaggtggattctcctccgcttattttgcgattgctcaatcagcagatctggtcatgagatgctgcatagattattggggaatttgcaaattttttgatctttttttttattttacaagaatgccattcgaatgacaattccggtcataatttcctaatgacgattcaaatcgtggtaaatttgctgttgcccctagattatttgaatcatttttgcggtttgagtgaggaataattttcggtttgtggaaggtagaggtatactttggcattaatagggaggaatttaactatttaccatttttaggtttgttatttatccaaatgcccctcttaggtttgcgcttaattatttgctcccggagagagatgatttcttaactatttgccatttttgcctacgtgatatgcccgcgtggaaagcatcgtagaccccacccgtcatcccctcccctatcattcttctccacctccggtcgtcgaggtctccgtgctggcgagccccacccatggccaccacctggagcacccggattggggaggcgcactaggagagaccgtcgaggtcgaggaagaaggagagggcgcgggggtcgatggtagtcgtcggcaggatcagatgcggcggatggagggcgagcggtggcgatggtgacgacggctcatcctgatcctcccatcgcgaggacggggatcggatgcagtgggtggagggcgagcggcggcggcgacaacggctcgtcccgctccccccattgcggggatggggatcggatgcggcgggtggagggcgagcggcagcggcggccacgagcggcgagcgacggtggagaagaaggataggggagggctgacgagtggggtccacgatactttccacgcgggcacgccacgtaggcaacagtggcaaatagttaagaaatcatctcttcagtggtaaattattaagcgcaagcctaagaggagcatttagataagtggcaaacctaaaagtggcaaatagttaaattccccttaacaggaggaattatactctttgaactaaaagatatacctatataaatattatgtagtgacacatatttgatgactgatattgcattaacagatagttggggagggaaatgttctatcagaagatttggaagtaaagataatattctttatcataatacacacaatttttactaataggcaggtacgtgcaaaatttcctggtcttgaaataagtactgcatcatcaagcgtgccacgcaatatctgctccggtaggccaaaatgccggtggccgtttctgtggccgcattagattcccacatggaaacaaagcacacatcacaacaagtgtcactcacaagaaatcgtgcaagatgcatccaatatattccatcaccatcctcacctcatctccttcgtccttgtttgcttccctcgcttcacctatcaacttcttcaccatgcttcacctaatcaaattagcagctactggcttcagagttctttttttctttgaacgaattagtcaatgtgatatgattctctagaaatatctcggttccgtttcttccattctcgcatccattttttcctgacggcccaattgttgattgtccagattagtaacagagtttaaaactttgtttcagaaaaaaaaatcatttatatatttttcttgctaggaagaaaaggtatcaaagttgtaacatctcgtgtccaacatttgcactcaatgactcttcatggactctttatggctgtgttaacctttggagcagagggttagggagtattttacccagaaacgttgatgatttagtctgggttcggcagctgtggattagaagaaaaactctttcgttgtgtgcgtgcatgcttcccaagcagttaaatggtacgtttttcataaaatatttatatagaaaagttattttaaataatcatattaatttattttttttaaatttaaaatagttaatactcaataatcatgtagtaatatttacattgttttgcgtattcttctcgatcttctcctctcatcttaaacacaacatatagtctattgttaacattctttgtaccttctttgattataaaatttatttgtaagtatgccgtatgttttgacgttatgcatctaactatggagacgtccaaagtgttctcagcgtagttctacgattttgatataattgactaattaaaacttacactccattaaaagtacagacataagctggtgtttttgacacgcccatgtgcacgagacgttttgttttagtcaggagaaaaacaattaaagaagattaatcggaggttaacacacaagaaaacgtcagtgcggcccccacgtaaacagagctccattgcttgggtttgtggctatataaagcagcttctcctcctccatttctccatccatccagtgtgagctccgtttcttgctccatccatctatccatccaaggagtgtggaacgccacacgtattttttttttatctatgctaatctgatcattagcagaggagagttttagcagtaggattggattaaattggagtagtttcatagtttgtgtgtagtgatcttaattagctttgattagacagacagtacagtagagtagaggatgttggctgtgttcagcggcgcggtggtggaggtgccggcggagctggtggccgccggcagccggacgccgtcgcccaagacgcgggcgtcggagctggtcggccgcttcctcgccgccgccgagccggccgtgtccctgcagctcggcgaccttggccacctcgcctactcccacgccaaccaatccctcctccgcccaaggtatactagctgctgcttctactctgcttcagctgaaattgctgaaaaaacatctgccgttttctttaccctgaactccccaagtcctggatttcacgagatctagctaagaacagagccaagaattgattgctctctgtggctagatcagttaactgttcatcctgagaggctgagacagagtcatttactctgaatttgttcttcagttagtgtctcggtgaagtctcatggtgatgagatttaatagttagtctctgcaagaagacaatctaagttggtggttgagataagcttttgcaagttgcaacaggctcactgttcttggcaacactagtcactgcgtggtgggcgacagcttttcatccaaggggaaaaaaaaatctgaggacatgttgctgaaatgattttttgtgcccacctgaaatggtttgagtgatgaggtgggctctcctagtaccataggtcatgtggacatgtctcacaactcacaagatctgacaaaaaaaaattctcaggtttggtaaaaacatatgcttaaaatgaattatcgatctgaaaaacaagtttatgtacagtaacttaaactgttattttacataataaactggtttcttcaataacttaagcctggttttttggttgtggcttgagtcaataattggagaggtacaaaggctttttgctttcggaagacagagtaatagatacaactctctaatccatttctgtaggtgaggaggcaaggctaccaaacctcctccttcatctatagttttttgttttatctatagaccacacgactgagatcatcgggattttactgataattaggtgattaactatggcatacgtttatttatttcagaaggtagaaagctaatcgaacaagaaaatggacgaaaaggaactgtcaaagaggtgtagtttgccatgctgctatggtacctagatctctttacggtcaaatgattggtgcttccataggaaaaacaagaggagaacaagacaggaaagaaagttaaatcaatgtttacatgaacattgccacatatatttcgatgaaagaaggccaccgcatcaccttttgttattttgcatgtccacatcaagccaccttccacagatacaaaggtttcaattgacttcacaacaaacgggcctcatattcttcatcaggcggctaatgattggactaattatagttttaagaaaatggacaaacctgttttgtcaagcctatttcttaattataaaaacttaaaaaggataaacatgacagtatttggcaagctactaggttgcttttaaaaacctctttgtttatgcctttcctttagttgttgtgccattcacatggcttagttcatagtaggagtgtaggacacttagcacttggtggctactgcttaccagaagactctatccggttttgatacccacagatctgaaagaaaggaaagctgaacaagggggccatgctgtcaattcagcactatgatttgtggggcctgattacccttttttcatatcttatctagtactactaggcagattcactgaagaagtatcatccaaggaattccactcctttactccattcattataccagtacaaaatatatgcttccttttcagcaagtttaggtatctaattcttgatgttaggtgcatcttgcattaagtcatagatgttccacctaattttgcattctgcactgaagtaccatgtccttcaggcattcaagaatggctgaactgataacaccaaacatactaattttcttaaattttgttgtggatgccagtttttttttatcatagggttggaaagcatctataattttacagctgctcactgagaacatacaactgcatttgtgcagatcctttgcatcaaaagatgacattttctgcctgtttgagggagtcctggacaatctgggcaggctgagccagcagtatggcctgtccaagggcgccaatgaggtgctcctggttatcgaggcgtacaagacgctgagagacagagcaccttaccctgctagcttcatgctctcgcagctcaccggcagctacgcctttgtgctcttcgacaagtccacctcttctctccttgtggcctctgtgagttcttcatctcgaggcaaccgacagttacatgctgttgctcaaacacttgcattgacagtgcttggtgatttggttggtttagcttactgattatgacgtgatcttgtgctggcaattgttgtctcaggatccagagggcaaggtgcctctgttctgggggataactgctgatggatctgttgccttctctaacgacattgacctgcttaaaggatcatgtggcaagtcacttgcacctttcccacaaggtaatgtttgaatcatagtccttttatgttgccaatcattgcaaatgacatttaaaatggggcatttagtataaaattgtgggtcagttgaatcttcactgctcaaatatgtgcaaagagccatttttggttatgctcactaattacatgcattctgactgcaggttgcttctattccaatgctcttggaggcttgaagtgctatgagaacccaaagaacaaggtgactgctgttcctgcaaatgaagaagagatctgtggtgcaaccttcaaggtaaaaaggaaattgatttcttgccaagaatataatgttgagggaaactattttgatccctcgaggggatcctaattaacttgactcaataaaacagaactccttttttcatcatttgcatttgatctgaactcattcgacctttctggatgcattgctaggttgagagcgccactgcaatcctcacagctctgcactaggatgatgtttcggtgtccggtcgttgggcatggtggtggtgtaacatagttgcaactgatctgtatcatcttttcataaaagagaagtactgcctgcatggcaagtgcttcagtgttctgggtgtgtagtatgatctctgtacctttgttgttcaagcaggaatgaactccaggccggctgtgatcagttgaatgtagttctgttgcaaataacctgtccttgtcagttgttactatggatgtctgtttgatgtagtgatgttgtagatcactgcatttcatgaactttggtcaactagtagcaagaacagagtgcagaaataagcaatgttcagagtagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcggcacggcacggcccgcggcacggcacggcccgtttcgccggcggcccgtcaggccgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcataatggatccgaactttccataccagtcgccgtcgttcaccttgggtgatttcgaccccaactacatgtcgaggtttgacgatacctccggatcggctccaactccaccatctgtggaggaggtaccggttcatacggctgtcgttgaggaggtaccggttcaggcggcgacagcttcggaaggattttccggaaccgcgagcggaagtgtttcgacacacaccggctcgaagagatcgagaacctccggtgtgtggcaaaacttcgacgagataaaggaaacatgccccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagatatatggagtagtagagctagagaggattatcttagcgtagttgttcattttgttgatgatgattggcaattacaaaagagagttttagggcttaggttaatagatgtctcacatatagaagaaaacatagctgaaagaattagggaagtaattaatgaatttaatcttgctgataaaatatttgctgtcaccctagataatgcatctgctaattctagggctattgaaatattgcaacctttattttgtgtgtatgctcaatcttttctactccatcagcgttgtgcatgtcatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtccaaaaatttcaccaatttctagaaactttttatgattgtactctaactttgtcacaagtttattatccaactgctaatataattttgcacaaccttcttgaaattgctactttatttaaagaatacgaaaatgatgacgttctaactgaacctgtctttcacatgaaacaaaaatatttgaaatattggaaaaatatacctatgttgtatgcttttgcttttgttttagatcctaggtgtaaattaaggggattatctgctattttatcacttgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacggtgcccgtgtcgacggtgtcctccgaatcggccttcagtctatgcggccgaatcatcgaagaccggaggacgactctgcgcagcgaccacgtcgaaatgctactaagcgttaaagactgggagcttgctcgacaacatgcccaatacactgcggacaaccaagaattggccgcccagttcgagcaactctacctggatccagaccaaccccagtagaattttgttagaagtagttctgacctttgagctgtactcttttctttgtcatggttttctcattttcccctatgagtttttacatgacaaagtttttaacgaggcagcatgtatcattgtatcctgtaatgatataaacatcaataaaggtcattactatttttaacaaattcttttgcaatattttcgcaagtgtggatttatctttaaattatttcaaaataataaatcacaatctatatttttaaatttttcaacacaacaaaaaaataccattttttcttttttttaacattagcaaatcattacttttttaaaaaacttttatttccattttttaaataccattttttaacattagtaaatcattacttttttttaaacattttatttccatttttaattttttttccttatacatttcctttgctttttttttaaaaaaaaacactgtgcactggcggcctggcggctggcggcctggcggcctggcggccagtgcagctcagctgccggcctgccttcacgggccgccgtgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctatagttcagagtagagttctaaattctgattgtgaagtctgaaccttctgttccttccttgctcctctatttgcttccttttgtatataacctctccttatcagttgttactttgattgtgtgtttgatgtcttgatgttgtagatcaccgcatttcatcaactttgctcagctagtagcaagaacaaaagtgcagaaacaagcaatgttcagagagagttattctgattgtggaatctgaaccacctgttctttccttctgcttatatttggttcagtaaatcggtaaacaaggtctgattcagtttgagacactggatgactggaatcgggagctagcaagctggagctggatgcacgtcttgggacatgatatccgtatgaagaaattgccttggatgtgatcgatcgatagaccacctgctctttctcaaaaatcaaaatttctgcttcatatattcgtcgctggcatccgcagcttgcaccatatactgtgctcgcctctgtccgcttgattgttcaaccgcacgttctcgatcggacggttcccgtgttggggggggggggatccaacgtaagtgcaagggggactcgagtcccccctacacccacaaaacccatggataccctccggagcacccccttcaattttttcatcataaataataaactaaaggtctctagatgactggaggttgaaaaaactgtgtaattgagtccccccaatttttttgttcctagatccgccccggggggggggggctaatgcgcgacacgcgactacctgctactatgtactgtactagtctattactagtagtactactactacactcctattactaatactactactataatactactactacattatggttatgatactactaatattactactataatatatttttgatgtataaaaaatatacacatatacaaactttatatacgtacgtatacaaagttcgtatatgtgacgtatataaagtttgcatgcacgtacacaaggtttgtatgcacgtctataaagtttgcatgcacgtatacaaactttttatagatatacgtaaatgctaaaaaatcgaaaagaaaaaaaacggaaagaaaaaaactggaaagaaaaccgtaaaaaactgaaaagaaaaaagtaaaaacagaaaaaaaaaacaacgggaaaaaccgtgcgccccacccctacgcatgcccgcgcgcgccacatgcctcgccgcgggggagggggggtggtggcggcggctgatcgctcattagcgattttggttcccgtgagcccaagagaataattccccgaaccccatgaacagcaatttttttaagccttgcttttgttacagacgacatttggcctttgttcgaacactgagtcattcatagttcagataaaaattgtactaggagattagccatagtggttgataccagttttggggtgtttgctgaattcgtgccacttgggggtccgttagaatcagctgaaagaactgagctgattatggctcgtgaaatgaaacaaaccagtatgagtaattaaatattactaactattaccaatataaaaatcgagttatttgatttttttaaagaattttttacatataaaatatttgcatggaatgcgccgtttaatattttaagaaacatgctaacagaaaacggggtagccccaccatatcagcacttccgaactatcacactcaagaaatcaaaatttctgtttcatatttgtcgctggcatccgcagcttgcacgatatactgtgctcgagtgctcgactctgtccgctttgttctcaaaaagaaaaaaaaaagatgctccaatctgttcagattgatggtggatgcgatgaagtgatctggccttacactaaacataagtcctttactgccaagtcaatgtacaatctgctaacctttgggggattaaggattcagacatgtaggctgtttggaagagtagaattcctctcaaaatcaagcattttctatatttatctgggagaggaaaacttccttgtgctaatcaattagttaaaaggaaatggaagggtgggaatgagctttgtaaactctaggaaaactgaaacttctgaccatattctgtttcactgccctttagctttgtttgcttggtgtgtgattgaagaggccttgcatttgagaaggagacatatttcattctgggattgcactgggtttgtttgggataggggggagaagatggtttggatggtcttattggccagtgtatgctgggcttcgtggctaataaatgattgggcttttaaggactttccggtttcttctcctttacagggttatttacaggtcactctcgcttgcacagaagtggaaggtgttcctaaggggagaagagcaaaaggtgctggatggctggcatgaagccattctggacaaattgtatcaagtgaagccgtctgttcttcccgcagccatttagctctttcttttttgggctgttgtttttgtgtagcgaggtgttttgtgggttaaaatggtggtcgtttccagggtgtaggagcaaagctctttccgaagctagctgttgcatcatacctatgcggtctagatgagttaaaaataaaaccgctcccatgctatatcaccattcgtgcgactataacctatctcttctctttgtggttgataatacttaatgaaatttatgccatttgtgcgactataacctctctcttctctttgttgttgataatacttaatgaaatttgtgataacaatataaatggcaaattactgttaatgaaagtcaaaaggtcaatggtaaagtgaaatagtaagtctagtgagaatacaaatagatttttttcccgaatacaaatagatctttctttttcccgattagtcagatatttgtacttttttaagaactcacacataattacgcatgcacactatacttacacacctcacacgcggtatttgtgccgtgttacaatatttgttgtaccattttgtaatttagtgttaatatttttttttcggaatgatgtaaatttagggttaggcctagttagcctatcaatctacttaacatgcgggatgacacccctccagcagaatgaaatggtgaccggagggagttagggataggattttctgttctaatcggtataccatggtcctctctcatctgcccatgtaaaagtgccgtagctgaaagataaaactaataatatgctaagctaaatttgcatgatgtgtgtctaatacttaaaataataaattgtattagtcatttgatgaattatggggtttgtgaaattctgttttaagtaattttagtgtagtcccgtacgactttaggtaaattaaaaggtaggtatataaattttggtaggttttagttttcagacttccaccacatatgtggtttttgccctacatattttcgcagaaatcgaagacccttatggtccaggccagtttacaacttcatctttctacaaggacccagccaagaattgagcccaaacttcggtctaaaattataagcttctggacaggccgaatacggggaggcctaggcccatgctttctctgtccattatgtgggccgtaagattgccaacataggattgggctttaaattagttactgtccatcgtgctcatgcacagaatctccgacagtgctaaaatgcttccactccggttgctgttcaggagatctctctttcatcccggaactgtagacgtgtactagttctcttgataactgaacaaaaaacatcgaacattgatcgaattgattactgaaaatactggaaaaatctgggataaaactttcgccgaatgaaagggagtctgttttttatcgcctccattctatgcacttgcactgggggtgccaactgccaattccattttctgctgacacagtgaagaggaaaaggaaaaatctgccggctccacggcatccaaaatatccgcaccctgcaccccctttttgcattctgatatctgaatttgaaacatcacctcatcagctttagctctttctgacctctattatactaaaccattgtcataaaatgttcttctgttttttattttatttggaaagatcctgatcagaaaattatcttttcagttaattaatcctatgcctgccgaaccaaagaatatgtttcgggactcggacatgggagcattcagcatcgccttcctcgtaatcccgacactttctttcgttccggctgcgagaaggattttgttttgtttcatgtgttgacgagttgcagcaacattggagcaagtttaacggtatagccaactgccggctctaaatca

SEQ ID NO: 58257 - DNA, 1029 bp, Oryza sativa
attcctgcagcccgttcgtcccctctgaatatttcgtttaggcggaatttggtgggagcgaatcttagtagatggaatagagtgcttgcttccatacaggaagtattattacaggatgggggtgactcgtttgtgtggtctttgcaggcctcaggaaattttactgtcaaatcgatgtatgctgcactaatcagtaatggtattagagtttcacaggatatttggcaaattaaggtcccttcaaaaataaaaatttttttgtggtacttaaagaaaggtgtcattcttactaaagataatttagctaggaggaattggcatggtgatttaaaatgcgctttctgtcatcagcctgagtcaattcaacacctgttttttgattgctatattgccaagttcttgtggcgagcggttcatattttgtttggtataagtaccccatcaaacttagttgagttattccaacagtggtctaaggggggtaataaaaaacaaaatactttactgttaactgcagcagcagcgcttttctggacagtttggttaacaacaaacgagttagtgtttgacaattacggaccgaaatcttttttgcaggtactattcaggggtacgcattggttacgccaatgggcgaagctgcaacggcatgaggatctgcgttcacagttgatcgcggcatcgcaacatcttgagtcatcagctttgcaattttttagttccaatggatggttatcagctagacacatcggtctttagtcgtctgaacttttatctcggttttgtttccaagtgttactctgtaagaacgtttgttataattggcatgagtctatcttttgatagatgaagccgggtataaaatatccattatctaaaaaaacacgaatgtccaaatatttttaaaaaatcaacggcgtcgaacattttagaatggaggaagtataaaggtaacgtgcgactagctaggcaaagggtggccagcgcaaaggcgcagagaaaggctggaaatgcacgcgatggaatgat

SEQ ID NO: 58258 - DNA, 3141 bp, Oryza sativa
  unsure (1)..(3141): unsure at all n locations
ctagctcccgtgcatatcgcactagtggagaaaccatctttggtcggtcggccgaaatccacaatagtccggttccactaaaaaccgggactaaaaatgatctttagtcccggttggtggctacagtgggcatatttaatctttagtcccggttggtgaagatgatatttagtctcggttctaaacctgtcaggccccccgatctttactcactaaagatcctaactttactcccggttggtgttatcaaccgggatctagaagatttttagtcccggttggtattaccaaccggcactaaaattcaacgcttaatatataatccttcttccctatcctctcctccacaaccgcctcgcacttatcctctcagatcgatctccctctcctcctccccctccgcctcctcccatccccggccctctcctccccatcctcccttcccatccgctcaaatcgatctccctctcctcctcccttcctccctctcagatcgatctccctcctcctccccctccgcctcctctccttcccctcccatccccggccctctcctccccctcctcccttcccacgcagcaggcggccggctgggccgcgcacgggcctagtggctagcggcggcaggcggcagccgctgccggcatctttttttttacaatttgtgattcactaagatgtataattttgtgatttgttgcatgatctgagatgtataatccgtgatgtatttggtttgtgtgtaatttttttaagatttgtgatatattcgatttgtgcgtataagtaacttaagatttgtgatgtgaatgttttggggtgttacttttatttgaggtttgatttagggatatgtatcccacttgatttggggatatgtatcccacttgatttgggagaaaatatagggattaaactctagctagaaacaatgaaaaaaaagagacctaatgggactgccggtaccctctcgtatatttagtcccggactaaatatctatctttagtcccggttatttcaaccgggactaaagataaatatctttagtcccggatttatagtcccggttgaaaaattaggattaaagggagttaccaaccggaagtataaatggattctccaccagcgtcgggcgatcgttcggactccgctgctaacatcttcactgtaaatagttttcgatgttagaaaaaaatannnnnnnnnnnnnnnnnnnnnnnnnntagtagtcgtccggacttgacgacatatctctggctccgccactgtgtgggagggaggatcggcgtggctgttccgggcgatctgtgacgcaagattcttccggccgagttgcaggacaccacaccggaggagtactggctgctttgcttttctcgcggttatttgacgcgacacatgcgagcaggcaggcagcgcagcggcagaatcggccatccagcggcagaatgtgcagatcctttcctgcatgcattgtgcgtcgttgctgcaaagaccacacacacatactccttctcctactactactactactacgagaatactcgtagtatttagacccatcctaaaaacattttactccatcacatcgaacatttaatacctacataaagtattaaatataaaaaaaaatactttctccataaaaaaattaacttctagagtttgaattttgtccaaaaaaaccaacttctactatcctatctaccctcagcacgtaaaacgagaaattttatctcttccataccctttatctactatcaccattactatttttttaataatctagggtattttagtcattctccatctccattaattccaccttaggatattaggaatggattttttgtgggacggaaggagtaactaatttaacagattgcgactaatttgcgaaacgaatattttaagcctaattgctccatgatttgacaatgtagtgttacagtaaacatttgctaatgatggattaataaattcgtctcgcagtttattgacggattctgcaactatttttttgttactgtccgaacaccccatacgacactctatataacacccgatatgatacgccaaaactttacaccattgaatctaaacacccccttacacgtatggtattgaggctgtaaaaaatgtgtcccagtactccaaacaggagtacgttgaaaatgactacgtaaggtcaatttttaatgtgtcttttgtacacaactgaacaacccatctctccaaatagaagcagtactagtatatggtcaactttctcggtgcaggtaacactatatggccataatttgttgccgcggccagtcttttttactagtagtatgcctgtagccgatcgatcccaaatgccagcagatactagtatatatacacacagttattccgtgcaatattatagtattatctatttatccagtactagtagcattgtttgtatatcttgatagcctgacaaggtagtagtttgacgaacactacagtaacactattcaagattctctctacgggtttgacccatcacgtgaaaggaaagcatgcatgacattgtagtaccagcaacgcatgaatgtcgtcgtcctctccctactcgagaccttggcaaaggcatctcatctcatctgctcgctccgtttattgaacccctaaacttttaagcacatatttaatcgttcgtcttatttaaaaacttttataaaatatgtaaaactatatgtatacatataaatatatttaacaattaatcaaattttagaaaaagaattaataatttttgaataagacgagcagttaaacatatttaaaaaagttaacagcgtcaaatatttagaaacgaaaggagtagatgagtagtcgagtatcttagaaaaatcaatgtaggaagatatgtgacctcttctaaaatatatataatatagcgtattgttctataagaggtcacatcttcttttaaattgattatttttggaaggagaaagtactttctcctaccaaataatctaatacaatatttttttataaaaatatattaaattgagttttttttttacggagtactcctctcaggagtagcatatgacatgtttgttgttgcacttggaaaaagaaggggagaaaaggggctgcaggaa

SEQ ID NO: 58259 - DNA, 1969 bp, Oryza sativa
caaatcgtttggaacttaactgcatataccgctattgctttcaaacatttgtggtagataacatttcaataacagtgggacatgatgcaagcaataagactagcatgttatgtttaatgctatatatctaataggcattgatatgtattagaaatctgcaagagttcattcctcccccatgataaaaggccgtgtgttgtttaattgaaaaagaatccaccaagtgtgttttgcacaaatattttgcaatagtacttactggatggcgaggatcagcaagcatcggaaagagacctctaactatgagtgattgtcttgcctgaaagaaaagcatacgagaaatatgagatacaatagtcaggcataaaccagataacagaaagcatgttacatgaaaaaaatcagaaaaaagatcataaacatagaagggaaggactgattacatacttcaaatgcgccagtgaaactccacctcatatggtttgttttcagacgaggaatgacaacagatagaacaggcatggtgggcctgtacttggcaattagtctgcagacattacagataccagatgaaatatgaaattagttttgattaaactacaccattatcctgtttatattcacatctttctaccttgcagcgcgtccagatgatgtgaagcaaataatgacagaagccttcactttgatagcagctcgcacctgcaaaataggcaagaaacaatttcagactaagaaacccttgtttcatataaagactttgtgaagcaaaaaacaatggaatagtcaaaaatattttatatgtgcacaataaacgttaagaaattttgggaacaagagaagaaacacaccgcagaagaagcgatagactccaagtgggtcatgggctccccaacatatttcacagtccgcttgaagtataaatcttggttgaataccttctctgcctgtgaaacaatggacaaacaaatatgactaaatcatgttactaacagactgatatagacagaaaaacaagaagtgaattttcattgtacttgttgaaaattgtaaagaaaaaacataaaagtagaaagaaaattcacctcagcgcaaattttgcccacaattgagatagtctcaactgggtacagaccacggagagtctcagcaccaaggagaatggcatcactccctgaacaaaaaatatatggttcagatttttcagaaggcaattaacatcatcaacaactcaaacaactcaccgtcaagtacagcatttgccacatcagtagcctccgcacgagtaggcctgaggttgtcagtcatactgtccacaacacgagtaacaacagcaggctttccagccatgttgcacttgtgcagagcagacttttgaaacaaaaacacctacagtaccagaagttaaagatcagtaagcaaattacatatcaaattgaaaacagagcaattcttgctaaagaacttgaggactctgccactaaaagcttcatagccaaataaaaagaagcagagtatgtaggactattaattaatcaatgccctctgaactgctaaaataagtcaaaaataagatactaaccttttcaggtggaagatcaattccaaggtttcctcttgacagaatgataccatccgcctcttgcaggatttcatcaaaatgattcaaaccctgcaaataattaaagagttgataggtggtagaacaaatcaaagttggctaagaaatatataaagagtatgttgcaaatacctcaacattctcaattttggcaaaaatctgagtttggctaaggtcgcctaactttgagaggaactcacgtgcctgtaatgtaaggagaaattccagcactgtttagaatttcttcccaaataccaaatgaagaggtagaggagagtatatattggaatatagacatgcaatattttcactgtacagtagacttgcaaaactttcaagcacaacggg

SEQ ID NO: 58260 - DNA, 5974 bp, Oryza sativa
ctgccatctctctaaaggtgtaccctcaatggacaccccttgccacacctcctttacaatatcactgaaaccgtccctccgcaaccagcccaattcaaatttaaattgaggttggtaagctgcggacgcaccgcctgaattgtatagcaaaggtgtatgatctgaaatttccctagcgaggatgctaacagtagagagtgggaattttgtctcaaactccgtagaaactagaattctgtcaagcttctcaaaagtttgattttgtaagtgatttgcccaagtaaaagatctccctgatgactccaattctctaagattcaaagtgtcaattactgcattgaacagaaatggccatctatcgttaaagttatcattatttttctcctgtgggttacgaagtatattaaagtcaccacctacaactgtaggtatggtttctttagagcaaactcgtactaattcagagagaaaatgaccttttaaatcagactgtgctggaccatatacagaaatcaaattaaatttaaaatcatctgctctctgtcttaatttaaagcgaatgaaaaaatctccttcctcaatttctccaatgtcaagaaacagcaaattaacacctagaatcataccaccagagcgccccctaggggccatgcagtgccagatgaaatctctgccagcacaaatattatttaatgttgactgaggaaaagaggctctgcccgtctctgataaagcaataaagtctagattttgctccttagttagatcagacaaaaatttatatttttgttattcaaaaaatttaagtaattattaattcttgtcctatcatttgatttatggttaaatatacttttatgtatacgtatagtttttacatattttacaaaagtttttaaataagacgaacgattaaacatgtttaaaaaagtcaacggcgttaaacattgccgttaaacatttagagaaagtgggagtaatcggtagaacctggataattggacagtggagtggtgtctgtcggtgcggcttctcgatcgggtgcgcacggtgagtgaacgtgatcgatcgatcgatcgatcgcccggggcatcgtgggaggatcccgggatccacacgaccagatcgtaaagaggagaatgtgtgtgtgatgtgcgcgcgtgccggcattcggccgaatgctgtggtgaacggccggcggcggcggcacatggacggagttagtagtacattgattgcttcgatccatgatccaaaccaaccaacgacctgtgatgaatgctgagcctcgccgattggccgtcgctgtctgttccatcggtgagaaagtccaaatcacgtcgttatccgccgcacctctatgctagcgcttagctcaggacaaggcaagaatgatctactccctccgccccaaagtataagaacataaaatcagatcaaacatttaaacattttttagtcctgtgaatctgaacaaacaaccagtctagattcgtagtactagaaaatatctcatctggtactagattcttaggccatagccaacgctccatgctagaccgtggtctcacctctcccgagatgaatatttgcgccacgttagagggagtcgcaccccaggagaggttgcgaaccttagcagaggtgcgggtagtttcgtcagaccacggctctgacatgcaaggaaaaggtgaggaagcgcgttggggagaggcctcgccctgtgccgtcaccctgcgccgttgcaattaactcactcccgcgcattgctgccatgaacgaggtcgagaagggccttcccggcggcgcatcggaggatgacagtaaggtgcttcatcgcgagaagacgccgccggtgactgacgcctctatctgcaccgttgttggctatttcgtcgccccaaccattgttccaggcagctccgtcgccgaagtcatcggaccgttgcccggatccctattgcgtcggctcgatctccacctccaccgccccccgccgtggcgatcgagtcaggcaacactgaggggagagaggggagaggcagagagacggcgtcgccggagacgagaggggcgaggcatgcgtgaggaagaggagcgaccggcgaggcgtgcgggcgcgtggaggaagaagagcgatatgtgcggcgctgcgcgtggggtaaggaagggattggatgggctgagagaatatgacaatgggccatgtactaatacgcaattttttctctacacaaagggctgacatagaaaaatgtttatgggacccacttcaaagtacggagaatggttgcttaagccgggtcttggaccgcttttgctctcgtggatagtggggatgttgcctgcgttggtcttagccttatattttgggacgaaaagagtactaggactgggcaaaggttgctttgctgggcttcgcagatctctgcgagtaaatttcaacatgagaaaacatacgctgattggtactctgtttaactgtttttgaaaggcgcactgttactcctactccactcgcttcaatttcggctcgtcagcgcaagatcagacgatcttgatttactccggaatttcctctgaaatctgtcaacatattgttgttccttttttttcccatttgtttgattgtttgacatggcttctgaaacttcctccccttgttaaacccacttcacagctagaatcgcacagaatacggaaatgttaaacaccggtatcccgtttgggctcgatcgggacaggacaatttttttagcaatcaccagaaatcatcacgagcttatccgagtcccactcccaagagagacacaatgtttcttgtgcttatccgagtcccactcacaattctctcaccgtgggcatggcgcgtgagatctcgctggcgccaacggcggcggtggaggagccggcggcggcacctgctcgcgtccgccggcggcggcagctccacctcttcagtgtcgccgctgaagtgcacgaggtcagtgtgggagagcggcgtgagcgtggtggtggcgccgacgccggcgcccaccgtgttttcttcggttgacagtctccatcaacaggaggttcttcattttcttgctttaagcagtgtcaagaaaatcggtgacatgaattggtacgagcatatagatgatacatcgatcgaatctgatatgaacttattcatgtccactccctgtacatatatttgatctggaagttgacggaagcaaaaatcgtttccccatatataaacaaatgaagtgtattacatggggtaaacctttttgtggagtaaataccagccatgatactgaggaggatcatgacacctcccaagtatcacatgatcgtacttaggtataatctatgaaactcacatgaaccatgataccagtcatgatactgagaagaatcatgatacctccctcatatcacatgatccttctaaggtatcatctatgaaatatgatgataccagacatgatacctgagcagaatcatgaaacctcctacatatcacatgatccttctaaggtatcatctatgaaacctgatgataccagacatgatacctgagcagaattatgatacctccaacgtatcacatgatcttcctaagatatcatcagtgaaacatgataataccatccatgatactgaggaggatcatgatacctcccaggtatcacatgatcatccttaagtatcatatgtgaaacccacagaaaccatgatagcatacatgatatgtaagtaggatcatgtgatacttcacaggtatcacacataatgatactttgcagtatcatgtatgaaactttcaggtatcacacaagatgatatatacctagcgagggatcatgtgtgaaaccttcaggtttcatgataccgagaaggatcgtgatacctcctaggtatcacatgactctactaatgtatcatccatgaaacccgtaggcaccatgatagaagccaagatactcactgtcttgatggtgttactctcattcacagatttttcctgcatatcacctcgattcttagactgggccttctcaacatgttgtcctcccattggtgtcaagttcattgatgcaagctttggtgtcaagttcattgatgcaagctttctcagctaaaccttgtattgttttgattgcaagatcatatccttgtaaaacacgattccgaggatgtttcatggggaagcagaagagccagcggacggcgaggcttccgctggaaagaagcgaggaatcgcgcgccgcaattccgaggaggtttcactgggatgtagaggagctggcggatgatgctcgcgccggtggaaggaagcgaggaatcacgcgctttctaggaggatttgccatgatgcggagaagccggcggacggtgcgcgtgccagcgggaggaagcaaggaatcgcgcgcgaaggcgcgcgcttccgaggaggtttcgctgagatgtagggaagccggcgtttggcgagcgcttgtcgtcgttcacgttttgctgcaatgcacgcaggtggcggacgacagttgctgagagcgatgtgatattggtaccagaatcgtccccttttttaacgggattctggtatatagcatccccccacagaataataacatctccatgttttgtcaccactcaccaatggaccatgagggcagcagacaatctagaaaagattaaacaagcgactctaatgaggtaatagcacaaacaaacctatactttcttgaaaccacagacaaacatcttcttgctgcctatacaatcaacggatccatccccaacctatcaattgccctcacaatccctcacatttatccgttcctatcactgttcataagtctatttgaaaaagaggaagaaaaagaaagaactgtccgtaagactattctgctactctcatgtccttctctgtcgacaaaaccggcaacagattgttcaggttaaggcacggtaagattattactactcctaccgtgcatgagagagagatagagagagagagagagagagagcagggcctacgcttaaagccgccattattgcggcacccctcccctgccacaataaagctaccacttcaaaccagctatatggacagctatcctaacactctactactacacagggagagatgatcactttgaagcaaacaagaatagcaacctcagcctctgcaatgattcagtgcagttgcaccccccaaaacatggcccggaactcgcagcttatttttttgacctatacggctaataacttttctcatgtgtgttccatgcgtaacaaataagcatcgaatctaaatcagacactttaaatactcatatagctaactctttaattgatttggatagttaaactaggtccttgctctaacgctctttattttaccatctccaaaataacaaaggacccacatgtcagtctctactagcattcgttcttccttttctttctccccctcttcctcttcacccgctggggcaatggacgagccgacaacgcgaggccacggcagggtcgctgggcagcatagcagtgggtcgcggcgataggggcggtgacggagggcggcggcagaggcgaggcatacaacggcggcagtaaattggcacgggtgagacaaatggctgcgacaagggcgaggtgatgggtggcagtgacatggggcgaggcagcggacggtagcgagacaggcgagccgggtacaggaagcgacggacgacaacgggatagacgagttgcagagggaaagcaacaatattatatcggcgtgggttaggcgagccagacgatggcagacatagggcaatgacggtaggggcaaggcagatggcggcggaggcagcaacggcgaggcagcgagcgacagcaggggtgaggttgccggagagaagaaggggcttgtgggagagaaatttggtgtggggtccaccatttggcaagtgggtatggatggccagat

SEQ ID NO: 58261 - DNA, 12037 bp, Oryza sativa
  unsure (1)..(12037): unsure at all n locations
cgaatagagagtgtgttggagtatgttgttttgctagatttgccaaaattcggcttggagagcaatttggaaaggctattggagacttggagttgctctaacgaatggaacaatggattaacatacatgcttcctaagctctcaaactatgtgatttttaaagccttttatgtacttctgtaataaatttatttttagtttcttctatttatcccaagttcatttttagagaaattattacatcggagtttgtgaaagtagtgaataattatatttaaagtagatatagtcagaaatagttgcattaggatttgataaagtaggggtattctattttttggttttgtattggtatatgtgggatatgtgaaaaatgatcttattttggtacagaggtactccgtccgctaatataaacatttttatagttgaacacaaatattaagaaaataggtataatcaaatgggcgaaggttgtgattggtttagtggtgaaggtaggtgaggaaattgaatgttagagtgttgtgattgattggaaagataatgttggtgaagaaattgttatattttagggcaaatatttaatgctagaagttgctaaatcttgggacgaagggaatattaagtttataataacgaatactccctctgtcaaaaagaattcaatcatggggatgaatctgaacatagggcttgtttggttcaataccctaccaaaatatagtttttgcactaccaatttattggtagggtagagttgtatatggttcgaggccaatttagaaccaagctttgagtagaatatagaaaatatcaaattggatattggcaatgcccatgatttggtttcaaaccaaaactgtcatatacactgttcaaactaccaaaatattggtagggcacgttttggcactaatccaaaacggcccatagtgcatgttaggtttatttgcaagattaattttttccttctgaaaaaggagggaatacgctatttgtgccgttgaatagggattataaattatttaatcatttagcgcaaaagaacaaacctcccaactgccatttagtgaaagagaagggattgtactatatatttcacacaaaacaatccctaatactttgaaacccgtgtaaatcccaacaaacataactccttctccttcactttttctctcactacgccacacaatacacaacctcctacaccatcgctgccccatgatgacgttgcttggcttcgccgattggacggaaaatgtcaatgaatccaacaagccccctacaatctctactcctccgcaagccaatggcgacgaggtgcctctatctgttttgccctcgccaccaacaccaacccactattcgttgtcgaccgtgcggcttcgttgccaccgccgtcgtctcggcgtctactgcctcccacgatctcctccctcccctcctcccactgccctctcacccgtattttaacgtgggaccctagtttgtaggtcattgatgggagttttgtgtgtccccagtgttaaagaagaagggaggtcgttagagctaggggagaaaggtttgaaacacgaatcgtgaagcacatttgatgatccaaaatctataatatttaggtatagattttctgtcgatagaaggtaaagctatcctgaaaaagaatgccctagcattccattccacatcatcacttgcccacttgagagttgagatccttcctcctactccaccggatcgctttggagaaagctgttgcctacttggacaaactcaacgcaaactgaagtttacattagggcatcatcaatgtttgtggtgtagtgtaatcttaaggtgggccctataaatagtgagccattgttatagccatacccataatgctatggttagaatttagccacaagatggccacatagaattgaaaaataattgtttcatctcttgttcatgaagtgaatgagagagaaaaaatattttctttttgcttgtggtagaacttaagcataaggtgcaccctaagctaatgctactttccacaatgtatatagctcactttacaagtgcaatcattatcttaaagttatctttttcatacattgtggttgcccttagtagaaaagaaaggggaattaaacggctgcttgttcgaagctggtacaatcatcgtggcgaggggcctctagtagtttaatggaggcgtgattaatgatggtaatctacggcacggcatgtttttggttccaattggggacagcggattaatctaatccgagggagggatgattgctgctgctgatgctgctggtcccaacagtggagcacccctgatacggagcagagcgtgaggttcctgcgcgaaatccagtggggatggatccaccattcacgacaactaacatcgaatctcaagcatcgagtgtgcggcaaataccatgccaattaaacaaaaaaaaacttgtactgctatctctgtagccctctaaataatgacggtactaagatccgtttaggtgaagaaaaatgtggtcaggacagtggtatgatactgtatttactattccaaggcttaattagcagcagtacactagcagtactgcatactgtagaaaagttcagacaattgtttctctgatcgagtctgaatgctactgcatacgatattttttttctcactttttaccgcggtagtagttgggggtggaatcaatcgttgtgagggagagggaccaggcagtgctatgaacaggcaggcagaagcagtggtgcttactgtggtcataggattgaaatgtgcaattctggtgtaagccaacctgaatgcagctgctgctgataggggacagcgctatcttaccccatcaataatgtaagtgcagggtgcaggaaaaaggttgcaaccatggccaaaactgcagcagtatgactctctcttcctccccctcctcacacatggaccaccaccaccacaaccatcatcatgatcaatccatcccctctcctccatctccattgcattgctcccacaattatcattgttatcaccttcctcaccttgggatggagtattatagtctttcttctctcataaccaaggaagaaagaatagcatggcattgagtagacaacattccactactagtggcatgtaaaaagagctctgtagctaggcaaccctccactgtcacagtcacaaaggcacaaacaaacatttggcaacacattttgctttgcacattgttcatctaccatgcatcaccacaacaccttatggagcaagaaggaaaccaccaccaccaccttccttctcgaattataaagcaccatcatcatcatcatctcttatgaaaaactatagataattactatacctaccttcgccttcaaggaagttgagttctcctttaaaagaaaggtgaaaacgagctaagtaaaaaagaaaaaagaaaaagaagaaaaaaagaagagcgatctagatgggactcatttcccatggtgtatactggttgactgatcctgagagcatctctcaaccatcatgatggcgatcacctgtgacctgatgagcttcttcctcagactcctggttggttcactttcttgaacaacaaaatgagcagcagcaacaggaggaggaagaaagcaatccggacactggagacctcacatcaccgagcagctgttcgggttctcgtcgctgaagtagttgtagggatcggcatgcgggtgcggctgcattgggtagtgcatcgggtacggcatcggcggccggccgtacccgtaccccatcgccgggtaccccgccggagcagcgccgccgccgtggccatggtgaccgtggtgaccatggtggccgtggccgttcatcatcatctgctgctgctgctgctgctgctgctgcatcatggccatgtactgctgctgggccatggggttcccggccgccgccgcggcctgcagcatctcgggcccggacggcatgccgccgccgccctggtagaacgctgccggtggcatgccctgcacggcgccggcgcccatgtgggggtggtggcccatgggcatggtcatgggcccgccgcccatctggcccattccggggaaaccggcactgccgcccatcatgttcggcctcatcatcatggcctgctgctgcgccggcatgccgcccatcggcccaccgacaccgccgccctggccgccgccgcccttcttcccctgagcagggtggttgccgccgccgttcggggcgcctcctccccccttggcgttgttcggctgcccgccgccgttcttgccgccgccaccttggttctgcttggcaccggagtctttcttgccgccgccagcggcgttgttggcgttccccttgatctgcacggggatctcgttgccaccgccgcccttcttgccgccattgccggcgccgccgccgttgttgccacccttcttgtcgccgccaccaccggcgtttggtggcggcatggccatctgcttcatcatcttgggatcgtcgaagtagtcgtcgtcgaggccgtcgtcgtcgaaatcgtcctcgtcatcgaactcgtcgaactcgtcatcaaactcgctgccatcgtcgccgaagtcatcctcgggaggaggaaggttgaacttgacggacttggggtccttgatcggcgcggccgccgcgaacggcgccatcttggcggcgtccatgaactgcggcaacttcagccccttcatctgcagctgctgctgcagctgctgaatctgctgcggcgtcggctgcggcatctgcggcggcatcatcatcttcacgtctttgctgccgcctccaccgttgccaccaccgccgccgccgccgccccccttctggcccttgccgccggcgtccttgggctggcccttgccgccgccatccttgggctggcccttgccgccgccgccgtcaaggtggagcttctgaaactggttgttcaccgccgccaccccgaccttggaaccccatagctccgccggcttgccggccttgttgagcttcttgataatggtggccggatccaccaggccggacaccgtcaccttcccctgctcagcgtcaatgctagtctggtacacacctgcagagataaatccaacgagcgtttcactcagaaacagggagtaaaaaatcacccagaaaattaaacaaccatatagctgatgaaaacaatttggttttaaaaaatttctctgtttttcataccttcaatcttgtggaggatcttcttgaccttcttctggcacccatcacagtggatgttcactttcagcacacaagtctgggaatttgggaggaacagagaaacacaggtttaccaaaacggcaaaaacagagatgttttcgaagaaaacatagcaggagacatgggaggagcacaaagtgaaaaacaaaagctagctgcccctgcctgatgaaaatggcagcaaaaacaaggagaaaaaacagaatgtctgtatcaccactagttctggttttgagttgaaaagaagcaaaaaagaagaagaaaaaactgacctgaatcttcaggacttcctccttactcatccctgaccacctcaagtgcggctccccccaccaacacaagcacaagagaggcctcctcacagatctggcacataagagtcctcaaatcagggacataacaacaacatgaagaagacagcagcaaccagcaaacattgccttctctcaagaaaaaaaaaactctatgatgagcaaaaacagagaagaaaaatgccttcttgctgaagataagttaatggcctccaatataatatctctccttcacacactcacacaaagagtaagtgctatggagagagagaaacatagacaggattattagagttttgcgtgtttgcagaaaaccaagagggatgggggggctcctattaacccggtggtccagagcagaagaaggaagagaaggaggagcaagaagagagcctcttctctctactccacactactcctgcaaagcttaatataaacacacaggcaacaccatctcctcctccttacccttttattttgctttcgccttcggcagtgcagcctgcctggaagaaggcctttctcttttgcaccctccacacagattgtgaaggaagggaagcctggggctcttgcaaaagacttgaagagaagagagattaaataccactttgtcacatgtcagtaagtacagggagatgttcaacatgtgaggtactcagatgttacacccaagcttgcgatgtcggtttttttttttttgcttttttgtaaaagtgtccaggaaatgttgctctcctgataatttcatattagcccctctagcctctgtagtattatgtagcattttggtcctgggtttcttgtgttcacctgttcatcaggtcaaaaagatttttctgaatagttctagagggacttgtgaaaatttagcaaattgtacgtaggagaacaacgacgtacacaaatatgatccatgcagatattaatattttacgtgaaaaatccatgcaaccattcaaaccattggttgatgcacgagcgcttgtcctattcggtcgtaactcgtaacatatttcgtaccactgacgaataaggtagctttaaatgatccaattgtgaaacgtgtagtcgttatgattcgccaacgtcattgcaatgcccgtacaaaaagatatattacattttagttttgtcgcacgccacattatttgtcggcatagacgttacataattaaagaaaccattttcggttatatacgacaacaactggccgacttcataaactcgacaaatccgtgttgccagaaaccgatgaaataggcacaccccgtttgctcccgtttatcatcctactacttcaactcaaataaggaattaacatggaaatgcagagcaaaaataggagaactccattacatgacttttttttttactctgggcaaaaggactcaaccataattaccctcttacgaagggactaatgcgcaaaagaagacgaggagggggttccctgtgctgatcacgcccggtcaatcatgtaacacgcggctttggggcatcgtcacgctgtgcaggcaaggcaaggcaaatgtggtccgtagacgcgccgcggccacgccctctcatctctatctctctactctatctcccctggctgcgccgcgccgcgctgccgtggcgagcgagccgtgcgcggcgtgggctgcgcgcgcggtacgtcgtccactactgcaaaccgccgcgagcgagacgatgatgcggtcacaccatcctcgcgtcgcgccgtggcgtggcgtacgtagcgcgaggcggagcggcagcctgcatccatccccaagcctgtggtgtcagaggagggtggtgagcacaataactactcaggctttctttttattgatgacgccccttgtttggcctttgctcctctgcagtctgcatgcgtttccaccctgattttcttggtccactcttccgttactgcctttttcactactcctactctccaaaaggaagagggagaaaaaacggctttggtcacgctgtgacggatggacggttcagggctcatgcggagtagcagggtattgcagtgcagctgttgttgtggccgatcgtttggatccatcgattcgaggatcggtcgtggctttgttttgacgttgctgacggacgcgaatggcagcagcagagggatcgatcgatcgatcgatccatggatgggtgacagtttgcgcgtcgctgtcgccgcgcttcttctgctcgtgcgtgacatgcacactgttcgtctgtgcgagggtgcgcttgactgttccctccacacggcatcggcgctaaaatatcatatgatcagttccagcattcgagccatgtatatggactacatgatcgatcgatcgatcaagcagggaacagttgggttcaggttcagagaggattggcacgactctgtgtttcgtaaatccgttgaatctttggagatactactagtattacaatatcaagcaaagaaaactactgtatctgtcacaagccaagatactggtactgtactgggtgtagttgagctagagatatgattgcatcatcacgagcaaatcgaggttactatggatttgttcgtatagtctcatctttgacgaagaggcgccgcaccggtcatgcatgctgctggagctagactgatgtcagggtatttgaggtggtgctagagctacactgatgtcagggtatttgacggtttgcactagccactgatttttcaacctgcggaaatttgctgtcatccatccattccatgggttacagatacatctactggtagctgtacatgcatgcatatacgcatgcgctcctaactgatcgactaatctctgtatgcatttgctagtatcgtgtttggcagtccaaggcaagatcatcagtatcgggatacatatgtatcgtagattcgtagtttctatgatattatctgggtgaaacgatacatgttggttttaggatcgttttcagtgtatcacattagtatcggaatatggagtgtaagattgttagaatcgctctagtatcgagatactaaccgtttaaaattagacattatttgaattcaaaaaatcaaaactatctaaatgcatttgtgttcatgtatctttaaaatcaatgtaaataaaactattagcattagtggatgattttctctttgacatatctctctttattatggtatatattattattactttttttagagtggctatatataattaatataaattaatattaaattattttttaagaaaaatatcatagtatcatggagctaagttggatccagatactaacaacctttgtccagaggctagttggacacacatgcatatatatccatgagtcccatcatttcacctccagttgattatatgatgtactacccccgtccaaaaatatagcaatgagacatgtccagatacattatcctggacccatcctaggttgctatattttgggacggagagagtatggtttattagtaataaaaaacaatgtatagtttaaaatttttatatatgtatttttagcgacttaaaaattaatattaaaaaaaacaacgatgaaaaatgatcaaaattgactttaaaatttatattttaaatttcaattttagcagcagccgataaacgttcatgcctgtacacatacttttttttttaagagaaaggcagcaatgtacaaatacttgattactactacaagaggacatatggcagtagtcgacatatatacacgtacagcgtacttgaattttgtacacatgtagtaattgcttgctcgcattcaggcttactactgtacaaccacaccctgaatgcagtactgcatatccgtgtgactctccagtctccactagtgaagtatttgttctctctcccatatgagaacaagaggctttatgatcatctagtcattgacactagcaataaattggctcgacgtattcttttgcagctgtgcttgcgttaacccatctccataaaactccaagagccaaacagaaaaaaagaaagagataagagtgatcagagttagccaggcccagctaagctagctaggttcgttgtggcgtgccttgtgagtgaagaactgaatatgatttcgggaagatgtaagatgtaacttggaagtagttgtggtgaaagagatggctgcttgtgctggggtttggccggcgccaactcgtgggacaccttgtagagatcagatgttactagtgatcgacttttgcaggaggaagctttcatggagagatgcatgcatatggtccggatggatcggattagttggtgtagaaaaaaggaattcagaaggggccagaatatgaccgattttaatttgttgagatatcgacgaacgttgcatatgcattttggtggtgttcgcctagcttagctgcagcctacagggtcagccaccgccatgcaggaatcagtcggtgacatgttttttgactgatcatgctttgtcagaatgtgaatgccatatgcaggagtagatgtagatcactgcatgcatttttttttgcaatcctgcgtactccctccgtataaaaataaacaaacatagtacgaagtgtgataatataaatatcgatagattatatatcgtggaagaggattttgatccctcgaagagatatctcctcgttgtttgcatatcacttaaatggttataaaaaaatttaagaagatgtattaatatgtgatatatcactccacaaacatgcaaataaaaattcaacttctagatctcgcaacgaaaaaaacaaatttgactctgaatatacgttaactagctgtggttcaatttgttttttcgttacgagatgtagaagttgaatttgaacttgtatgtttgtggagtgttatatcacatattaatacaccttcccaatttttttcaattttttttattaccatttaagtgacatacaaagaacgaggggatatcctctcgagggattaaaacagtttccctatatatcgtactagatttgtttcttgttttagaatgaagggagtacgtgcttatgttctgaattctgtgattgaactaccgaaccgaatatatgatcatatcggtcgatcatggcttggcttcggacatgtatggaaagcaaggaatggtttttggccggctttgcacttgtgaatccaagtgacagcaactgaactcacaagacaatactccaggtcgatcgtcgacatcagctacgactctgacgtacgcctacggaatcgatgcaaagagatcagttgtcctatactataactttagctaattgcaaatggttatatacacttcattggataccgacgtgttcctacaagacgcgacatacattcatgtcggcacgtcaggttcatgagcccatgtttgatcatgaaacgtcagaaagctttgctatgattcatcatttgcaacgatcggtggcgtgtttgagaacactaattctccctagccatcgtttgttttggctactgatgtaaacctgagatgttagttgtctggattcaggatgcatggggagcagacttgacatcccaggacatcgattgatcggcatcaaaagtactgaggaagacatgattacctacacagctcaatgattaatcacatgacgcctttctatacaaaagaggatgataaattcttcgtttgcgaaatttgaaacttgcttcgatcgacatggaaatcaaacaaagaccgatctactagcatacaaatacataatacattgccaacacatatagacaagaagtatactactcgtattagccaagtagagaggcagaccttaattgattaactaatgaatgacccccatcatcagaattaaggaggaccggtagtagtaccttgtaagcattgctaaagcaaaaatcaaacaagacgacgacgtttatccacaaacctacaaatgatttgatttcagatgtgatccatttaccgggcttctttaatttatcgtaacgccaacgaaagatttaattcctcatgcggtcttggaatgatttgattcgatgtggaatggaacaataatggaagcagattattgaattgaactatgggcatctacgtacgtagcaggggctggaccaggttgctgtgttgatctggatcaaaccaggccggcttggtcgccatgtttgggccacatacagtacggtacagctctgaactgatgtatgagcgtctgtatagtcttgtcgtcgtcatgggcctccgggaccacgcgtaggtacggggttgtttggttggtatactcatatcaccaaaacttaccacacttcatttagctaatatgcctaacatgtggctaacaaaattgaagccacacttcagccatagaagagcaaacttgccacacttttatgtgccaatgacatgtgggatccacatcatggtgaaggaatcttgccataagtgtggcacgaaccanacagatgcctaacttag

SEQ ID NO: 58262 - DNA, 2177 bp, Oryza sativa
tgtaacaataacttcaaaatatctagtttaaagaaattagaacaacatatatagatgtcttttaaagtactataaaaaaagtaaacatgtatctatttatttatttattgtatatattttaatagaaaaataaagttaaaaatatattttggagaatggagagcgtgttattgttagaattatggaaccggatggagtactaaccaacaaccaattgatgcagtgatgatgatgacaatcatgttatcacacaccgtatggaactaactgataagtggcttgtaatggatggtaggtacaatacacagatgcaaatttggatggagtgccatcagaagctagaacagcaaacaacaaattaatagtgcacttgcttgattggaagctaaaactggaagaataatcatcatcagttcatcaccaaatcctgtacgtaaatgtgtgcttacgagtgaaattgatacccaagaatattatgtggggtgtggtttcaataggttttcagtgagagaaaatgatgttcagttattaagaaagtaccttgaggtatttaaatttcacactaaaaatactcgatccgtcctaaaatataaaaatctaggactgaacagtctgtccagatttcctagtactagcaaatgtcacatccaattttagtttcttatattttagaatggagagagtacctaatacttaaaagtatcaaattttgaattagaaaatatgatactagtagaagacaataagggttgttttggtttgaagccctaccaaaattttagtaatgccaaaacttggcacagcaccaacaaaattttggtagggttgtgttttttctaactctattgaattggtaagatttggcctcaatccaaatagctaatatgtactattcaaaactaccaaataattggtagggtaagaattggcctcaatccaaacatgccctaaaattttattcactggtctttgtagacatgtgagtatgatgtacggcttccgtgcaacttgtaaaatgattaaaaaaaagagcatatgcacatgacgataacgtccaaattaatcatccagagcacgagctgagatgtctggagtctggacagaactagccctagtgatagtgctaccactgctgtacatgaagtgtactacatcagtagtagtacgtactgaaggcgaagggcgcggtgtacgtaccatggtgcagtgagagcggatcgatgatcgatcgatcaacctggtgagagtggccgatcagcgtagatgtccccatgactccatgcatgcagcgcgaatgcgatggattcatcgatgtgtagtgcacggctgcttccaggcttgacagcaacagatcgctcgcgacgcggccaccgcgggatgctgccggcgcgccgcaaaatgctcctcgatcggggccggaaatccacgcgatcctggcgtatgtgaaactagctggcttggatagaagaacgccctcaacacccaagtacacggctagcccgatctcgatctgcccttctgagggacttctgatgtgaagttagaggatcgtggtggctgatatgtaggtcccactactcatggatccacctattagtgatcacgtcatgaggcaattcacgtcagaagaaccgattcccttctcagttgagtcttgtgaatcatgatgaccgatctagagtactcacattcacaaaagcctgtgggtgtacagtaggaacagtactgtgagatcacgcacgctggccggccgttgttggagctgtcagtcaaattggagtgacacgcaccgtacatttgggcatttggcgtcgtggaactgcggcaagaacaagatcccgtgacgcgataaccgatctaactactactagtactgtgactgcaactggcgccgtttgccgcagccaccacgcacacactacacgtaccttacgaaaatccgtagtgcgaggctccaccggcttcgtcgtaccaaattcctgccatctttcgctgcctactccattccatatgggagtatcgtcctgtacagctacgctttattctcttcccttccgatcccgttgcagggaggcagggaccaatggacctgtcattcatggtccggcagcctatacagcccagcaatcagcagaccacgcttgctattacaagcaaatactcctaggggcgcagga

SEQ ID NO: 58263 - DNA, 1367 bp, Oryza sativa
ttgtttgcatgtcatctaaatagttataaaaaataaaaaaaaatgacaacatagattaatacgaaatatatcactccacaaacatgcaaaactaaattcaacttctataagttgcaacaaaaataacaaattaaactgaaaatagttaccgcacattcgcaacgaagttgaatttaaacttacatgcttgtggagtgatatatttcatattaatttatattactattttttcatattttttatgactatttaggtgatatgcacgaaacgagggatatctctagagggatgattttactttccccaatcctccgccctgattgctgaaagctgagtcctcgagatcacgggccgatttgtttggagcagtatgggccgtgcgcctcgggcagtgctactcgcgaaagcccaaccctcgcagccggcccatcacagactatggattccatcacctatcacctcttcagtcttcacccacgtccctcgacaccccgtccattctccttcgcgcgccgcccgcgccgtcgcccatcgcggcggcgatctccaccaccgggagcagctggcggtgccgacggcccgcgtcctctgctcttcttccgccgcaaaatcctcccctccatcgactcctcgcgacttcgtccgctgatctccatccatccatccaccgtgtactacccgtcgtcctgctgctttccgtccgcctccggtgagcacccgtgccaacgcgacgcacgtcctctttctttctcatccctctcgttctatgccccgatagatccaccccttgtgaattggagatctgaaaaagattttgtaagaaaacaattgtgcttagttctagaatgacattgtggatttttatatttgtgtatatatattttttggtaataactgttttgagtcctgtccaacaaactcattgagtgaagagtatttactcttttacttctgtataaagttgattttggagcttacaggaaagcttataaggtcatgggtcatcatcgtggacataaaacctgtatttgtgaccttttaattattactagtatatctgtgttagttttatggtgctgctttgctgttctgatccacattttgcgccttttcttgacaaaaaattatgcttcagtgctgggaagatgtggatgggtggttatgatctcagaagaaacttgaagagggatgaaaaaactgattttgtcggaatggattcaaagaagcaaagaaatgcttctcttgcaagaaaaaaggaggaagagtttgcaatgaaggagagacatctgagtccttgatttcaggtttgccggtgcttcctttttctgcatgtatcttatagctctcgccgagcattcacagttgtg

SEQ ID NO: 58264 - DNA, 1966 bp, Oryza sativa
atcacttgaagtacacacttgcatgattacaataaaaatgtttaatctgtttgttttatacatatctgaggagataagatgatgatttttcctacataactcttattccatttcactttattttgtccagttcaaccagtgtggcctgtaatcctgttctgtttggtgccaggtttatgaaggcgggccactttttgattttgatggggactttcttggcatgaacctttccctcactactgagggaaccttatttgtgccaggggatagagttcttgatcagcttgtgaattggatactccatcatgaggttaaatttgctgcacggttagcggctttgaaggcattgaggtatgttttgcatattctgaatgggacacatatcctgctcctccctgccatacgtgatttaatgcgtttagctgttttttatgccaaacagcttatgagacttgctggttttgcaataatgtggatagttgggtgttgttccttttgtagggtttttgacattgtagttcctctgcagtttcaatgtgttatgttacccttaatagcaatatgattctcttccacctatatcaagatgtttctgtgtccaattggcacatgccatcgctgccctgtactagattagtcatatgttccaatgtttatcgatatttgtctaattttattagagaaaggaacattttgtccagatttagtggtcacactgctatgatgcctcctgatactggatgtttttttataacatttgctcaattctctcgttttcttgaaatagttttatgcatactactccaggtcttcttttatctatacttttcttaacaaggatcaatatggggatctagaatccttgggctatcccgagcccccaatatcgaatggtaagtcaattcctgtaaatattgtgacttttcatgcattgtgatttttttttacttactgtatcacttacaactattttactttgtatcttcaactagatggcatgattttggctaatacttttgaagagccttttggtaacgtgtgtggtaaaggtgtctggagtgaactaagtgaagatgttgcctctaacatatgtgaaaatattgtcgcacttgcttcattcaatggtgattttacagtattgtgttgtttactgtttcatatttgtactttgatcataactaactaatgatcaaaattatgatattcaggagaaaaacgaagttttgcatgcacgggttttttttattgaatggaacgagtgtgccactattctgacttcagcgaacttacttagagatcctcgtgatgcagacaagattatcgaaaacttgagggttggtgcttctaaatattctatgatccctgttcatttgattaactgctaagagtctcaattgtgttgtttgcagattaaagtgttgcttccaaacaatcggcgcaccaaagggacagtacaacattataatttacgttacaacgttgctctagttagtgtgaaggattaccgtgttctccaaccagtaaaaattcaaccttataggcattacgctagtgaattactagctgtagggtgtatcttcaaatctggcagattaatggcctcaagagggcgacaacttcccatcggtgtcacacatgaccgcaaatttcttggttattctcaatgtacaatcactaaggtaacagcttctatttttcttgtctactatacatggtcaaagtaagtactagtttgcatcagaatatgaattagctatcatatttaattgatattaccaagtataacttctccatttcacctggctaggctggcattggaggtccgcttcttggtttcgatgggaactttgttggcatgaacttctacgatgagggagtagaaggaaccccattcctatcatggtgtgagatttgcgagatccttaaatattttaagacaaaagagtatgtctaggtctttttgtgt

SEQ ID NO: 58265 - DNA, 5025 bp, Oryza sativa
attttttataagctcaaaaacatatagggtgtgtttagttcacgtcaaaattgaaagtttagttgaaattggaacgatgcgatggaaaagttggaagtttgtttgtgtagaaaaattttgatgtgatgaaaaagttgaaagtttgaagaaaaaatttggaactaaactcggacgtagtatgaaattcagcctttgaacgcgtgcaagctagtagcttcgctcgtcatcctcgaacctgacgatgaagaggtattctcagatctgacttctaagccccttattcttgagccagagagagggtggatcggaagggaggagagatcgggagggagggggggatcggatgagaaggggagggttaaagttcaaaatgccaatatttgaaaagcactatctcacaagatatgtattattttttaaaatcgctcccactacagtaaattaggaattgaaacaaaaatatataggttaaaagtctcaaatgctaaccatatacttgttactgcacaaaagtaaaagtgttactgcactgaaggtatacgttaccacgtgtttatgcagtaacactatccaaaaaatacagtaaaacgccatgtagtaacatcatgatgcgattgtagtaatgtacaacagacaagtagtaacaagtaatagtatagtattactacttgtggagagacaatatctctcaagtgatgtaaggttttttaaaaccgtttgcaccatgatgctagaaaaaaagagctaatcaaaagtagatccgtcatgactatatttcaactatattttaacgctgttactgcaagtaagacacagtgttactgcatagaggtcgtcgtgttactgcaccgtcctgggacgagagctgagaagaggtgggtggtggggggagttagtaggcgggtttgaccggtgggaggggcctttaaccgaggtgggaggtgggttttgggccttggtaaggaggggaggtgggtgtgacccttgggagggaggctgttctatacccggaagaatagtttttctatatatatgtgtgtgtgtgtaacggactcaaattttcagggaaaaatttttgcaaaatatttcaagtcatgctcttctcgattcttcctttgagtaatctcacttttgatcttttctttgacttggatctaaactttatttgctaagttaaaagctttctttaaaatccctttttaaattttacaaaacctttccgtttattttatttaatctttaactttggctctaaattatatttcctttgaatccattcccgaacatctccagcaaatactctttcaattcccgttcaaccatctctagaacacatgaaatattaatctctctagaattaatatcttttcatttagagcttactacactaccaccaaatccacttttatcttccaccaaatacttcccctttgatctctacccaaacacatgaattatcaattcttattttctccagaaccaatacctttcctttggatctccacctaaatattcccatagtccataaaatatcattgtcaatctccctaagttaatatacctatcccttagaatttattaatcaaccaccaattccgtccgtagaaaaattcccatccacatatactggaggttaaaatcccaaaatttatccaaagttagtagataaattaattatattttctttccatttgactattttaaattttaaaatattagagaaaatattttgtgatgagttctatatttggttcttattgaattcttttaaaattggagcatctttatttttatccttttcaaatttatatctcaaaaataaatatcttgattttattttaaacagtatttcaaactccttttacttcaaaaaccttatattcgaatttattttataaagtttaaaagaccctcaaacattcctcttttaaattttatctcctttaagatatatttaaaaccttccattcaaaaattcccctagttttcaatttcttttgaattctatttaaattcattgtccaagttcaaaaagtccacatactcccttaggttccattacctttgaatcccatctaaattccttgaccatatccttggcacaaagaataatatattcctaaaataattgctcttgtgctaaggaaattccaacttatattcttcactcaatttccccttttagccaaaaatatacataataccaattttagaattcaaatcctatttattgccttcaactaattcccttctatattcccaaaaatattttgaggaatattattaatttcccttcctatttgagtgcttccaaataaattccctcaaactccacctctaaatattgcactcaaataaattaagaaatctcttttatgaactctttccaaattcaaattctttgtaaaacctagctatccaaatcaagtattcaaattagacttctttctttttgtcatcgggccgaaactccgttctttcttccttttggcccaatcttttatcttttatttttttcctcctccctcttgggctgccggcccagctaagccgagccggtccaattcggaccatagcccagccgcctctctcctcctccttccaggtgtgcgtgttgtacacgcgcacggcgcacgccgcctcaaactcccttccgtcgtcacgaagtaatcggcgccgtcttttcttccttcacgccagcgtcgccgtggtcaagccgtcgaccgcctccagaaccgcctctccccaccgcccctctcccctataaatagccggccatccctccccttctttacatacaaacagagctccatctttctctctcttgccatgtccggccgtcgccgtcgtcggccgatctccctcaccggagcttcgaaagccaaacccttgcgccaccaactccgcctcgccgaggtgattccattttttcctatttcccctctcctttagccactgccacaagcactaccggcaccaccatagccggccagagctgagctcttgctgccgccgttccggccattctatttactccctatgccttccaccgacctccccggatgcatagcgagcgggaacacgcttgtccgccgccgtcgaggccattaaaccaccgaagcaccggtgccctgtgccctcttcccctctgttgttgctcgggagaagaaacagaaggaaggagagaagaacgggaggaagaagaagagacatatgacagtgggccccgctgcacagtaaacttcctcttttatttgatttcaatctttagacaaccgtatctttccaaccacaaatccaattccagtgaacctttgatctaaattcatctaatttcaaaccctcccttttgataccaaatttcctatttaaaattttgtttaaatacccttttaatttaaacctatttgatttatcttaaatccctttaattttaaaatttcttattttatttaaaaccatttttaaattaaattatctttaaatatcatttctttatttatttaattaccttttctttatttcttttaaaataccattttaaattttatttctttaatatattttttaaaaaactctatttgaattcaaatttctttaaaccattcttttacaatccttagccaccaaaaagccgctgtggaaactttacaccttctatggagacgttcgcgtggtctcaaaccccgatgtcaaaccgttggtcgtaaaacccggcataacctaatcctaaggtcgaagtgtcgctcttcgcaccccacgcctcaacgcgtacagtggtcggagcctcactactccctcgacctccacaagcatgccacacactagtccttgagctatgtgcgaccctagctgctctgttgtcactcacaactgcagagtaacactattccgctccacacaaatctcctaactcactagccgttgtgctacttaactgtagcatcgactagacgagccgatatttagccgttatgctaccaaccttagcatcggctaaccactccaaatatctaaccgtcgtgctactctattctagcaccgactagaaaaccaaatccaccaaatcaaccccacctatccattttatccttttcctcaattccaacatttagaaaccaaaacctctcttttgttttccaaactaaaatttattttgaaccattcctttttccttcgccttgctccaattttatttattatttggtttttatcatttctttgtagcaatttgcttataggctttatttgctatcttttcgtattcgtacgttagaccgtacagcaagttttatcagcatccaaggagctgacgtggacccagatggctacgctaaagccgcaagaaatcttaaggtgcaaggaaagacataattaaaatttgatcatatagaaaacttgatatgatcttcatatttaatttgatgcataataccttactcttttaacatctcatgggtagatgttaaatgcttttaagcatgattgcatgagaacatagaaagaagcattggttatcattttatgtgatttactattccaaacaactttacaaacttaggaatccaattaaaatgggcatttatgagttgagattataaatgctgtgattatgaatgttgatgaagtttgtgatgttggtgtggggagtttggaaagttttgggtggtttaaccggattataattacccccttataccatggaaatgacatagttgcgtccatccacacaatcaagtaattggacttagcgtagtacattgtcccactatatgaaagactgttgggtggctctatgagcggttttggggtgaacttgcgtaaggagtttgggcggcagtgtttcacaacagtgggattcatgaaagtgtgacgatatagataccttgcctaggcctggcaagagttcgaccactatgatgaaccaagaccccactgtgtagtaactagtagtaagtgggaccttcgaacggctctggtgtccttagccttgcaaattgttgacatcgtgtgggggctgcagga

SEQ ID NO: 58266 - DNA, 12250 bp, Oryza sativa
  unsure (1)..(12250): unsure at all n locations
gagtttagtagtttagcactttagatttttgttgtattttgaagataaggatattttagtttggatcttttcaacgtttaacaattgtataattagcttgtataaccaaatttgtataattaattgaaagctgatctgtatatcaatctgtgatcgaaatcctggacgatcacgagatcgaaatcctggacgatcacgaatgaattttcggggcaccaagcctaaattgggtgtccccacagtgtgtatatatgtctaaattcattaacatcaatatgaatgtgggaaatgttaaaatgacttacattgtgaaacggagagagtatataagaaacactgccaaaactccaaaactgggcaatactgtcaaataaccaaaattttgacattaaatttggtaagattcattttggatacaatctaaatattcccgttcttttggtgaagcgtcctccctcccctctcatgcttcaagaagcatctccgtcggatttgaccatgctaaaaaagtcttgattttgtgagctcgacctgctgtcaggaatagaattgtcacacataaaaaaatgagttattttaggtaatggtcaatttagcaatcgttatgggcagtagctaatgatggagatgcctatttggacggacattgtctcctgaacagacttgttccatgccctttcttgtgctagttgtagggaccaatgacatgtcattccatgatccagcaggcaatagagcccagaaactcacaaacctggcaatttcaaccaatacagacagacaaggcatgcagatttaacaccaggatttggaggtcacgactcacgatcagtgaggcagtgaccaatcttgcattcaaatatgttaagatgataatatcgataatttacatgtgtacatcctaaacagaacctaaatcggcatgttttgccaatacacggcacatgttaatgggactttttcttcatccttaggaagctaaccaatgtgattctggagggagcacctgtgcctgatctcttcttgattgctgtcgttttacacagctttccatctcttacggtagtcgtggttgtagatgatacattatagaactgcatacatacaagttgtgttcaagttctaaaaacgtctggatgaagatttcacttcttctcaagaactgctggagagcaattacctcgcatacaccgtgcaaaagcaatctctgaaatgggtcctggacattcagtacaagcatatctttaccactagtgtcttcgatgaaggtcctaactcgttcctgcaaatgtgaaaaacagataaaccaatataaaacagctactgaatgaccagcaagtgcagcacattatgcttctcaagtacttatgcaatacaacccaaatgcaaaatcatattgtaattattaatttccacttgcattcacatagcatgtgagtgcatacatcaaaagtttcacagaaatgccaaatgccgacaaattagaactcaaccacctcatttctgactgataacatgtcgtaacacaaaatcaggtcacccttgtttatggctgaagcctgagcagtagaagagtagaactgcttccttttcattaagaagataactgtactaaaaattgtagagacagagatgcaagagcaaacaggatgtcgtttaaaaagcttaggtaccccaatggtttatactttgtaatagaaagccaagagacagatgcatgtttatatggttgcgaaggaatattctagatcttagatgtatgtaaagaaatctgagaccctcaaaagtggcaatcattttagatctagatgttctttagatggtccaaactggtgtaacaagatagatattctaatgcaattgaacactagaaacaaaaactccaaggaccctaatttgcaccagattgtttgttaaaagacatctcatttgttcctggagaatagtgcttaaacttttatagttgtaatcattgatcacaataaaaatccatcaacactactagaagtagataacacaggaggatatactgtcagtttttataacataaatatcatttgatcctttaaaactacaaaaccagaaagatgcaatctgatgcagcaaaccaaaaactctcaaaagcaaacaaatgttagcaactgttgtgacaaacagaaacacaaaaaggttaattcaatgagatagaaagccatacttcgtatatttcaagaagatctgggaggaaatttctctttatggcttctcttgtttgacgatctatatgatgccaagaattgagagcaaccaattcatctctgtccaaatggttcttctgttttgtagaagactgtttcatctgttgcaccaatcgtgcctacagatgaaaagcacagtaagtaaaatggatccataaaaaagtgcacatgatacctaatgctatgcagctcttatttctcattgcacagagtagcaacacactagtatacctcaacatccatgtcaatactcctgaaggcatcccattcaccgacacttgtcctgcagaatgcagaaacgggcagttcctcacctacatgcagaacatagatcggtgtaatatagaaatgaaatgttccctatctctataatagtacatgaaaaatgtaacctgactataatgcctgcattaaatgtcaatgcaattaaagtgcacaactgatcataagtgtttaaggaaaaaagtgacaaacagggaaactggatagcatacagcattctcacgaatccgtacatttttagttaatgacataattcttgttaaagttaacgtgtgcatgctgtaaggaaaaaaaattgtttctcattctaatgtcaacacatagtaaagagtatgcataacatggattttatcttcttcataacttattactactctctaaacagaatgaaacattcaatgacttagtaccccctaaacagaatgaaacattcgatggccaggctgtaagacatgcaatatggtgttaaaaaatgtgagcagcactggatcttaccccatggtggaggagcaaaaaggcctttgatttcttccacatgaagacgggggacaagttcaatgagcaaccggtcattcaaccacctacgagatctccgattactaacctgtgcaacattgcaatctataaaccatcaacccgcatattcttaatgtcaaagataacaacatactgtatcaaatataacagggtttttttttctgagctgctattccatagatcatcatccatttctcataacagggatcaaaccataatttcattcaatcataaaactagcagcaaaggaacaaaatcacttttttattttccctaataggatgagccgcctcaccttggcggccatgtcctcaagaacttcaatcttcctctcaatcatctgcccacgcgacttgacggcatctccacctaagttcacaaaatcgaacaagggttaaaaatcgcttgcgtcaggacgcattggggggcaattcggagatacaaaaaaggaatctacctttggcggagtcgaacaaggaggcgtagaactcctcctccctccgcagcagatccgcgctcgccatgctcgacttccccgtgcttctcgcgatcaattcctctcctccgccggcaaggcaggcctcttgctccgattccgggatgtgcgtgttctagggctaaaattggggaatcgcaaacggtgtcggtgtctcggtgatcgctaggggagggggaatatgcggcggaatcgcggatgcgactgtgcgacctagcagatcgcagtgggccgagaagcccacagttgtggagagcaactagtttgggcctaatgtgatgggcctcccaagcaaatgaaactgaaaaaagtgcaccgaaggtccctcaacttgtcagcgagataaaaaacgtcctccaaccgcaaaaccaccttaactatacaaaaccggtcacccgaggtccttcagcagttttgatcctggttttagtctacgtggcagctgagttagcgtggaccccacgtgggccccacgtgtcagccaaccactctctctctcccctcttctctcacttatctcctctcgggtaagccggggcgggtggggaggaggtcgccggggcggccggcgacgcggcagcggcagcacgaggcgatgcggccggcaacaaggtggcgggagccggggcagcgccgcatccacgatcgcctgccgctgttctcctgccgtcacccggaactccgacgtcggcaaattctaacgacgcccactagctagtctgaccaccatgagcagactccctcaggattccacgaggtagcgagcaaggacctgctcctcctcctcgtcacggcgccggcgccgacggcgcgtgcatcacgctctagtacgtctccaacgtcatcatccacaacatccatgtccacgactgcgtccccgccggcaacgcgaacgtgcgcgcatcgccgacgcactatgggtggcgcacccgctccgatggcgacggcatctcgctctactcggcgcgcgacgtgtgggtggaccactgcgcgctgtcgcggtgcgccgacgggctcatcgacgccatcatggggtcgacggcgatcaccgtgtcgaacagctacttctcgcaccacaacgaggtgatgctgctggggcacagcgacgagtacctgctggactcggcgatgcaggtgaccatcgcgttcaaccacttcgggatccagctcgtgcagcggatgccattgtttgccgtgttcttggcttgttttgcttgtgagttgtgatagcagaagaggggaaaaatgttttttttgtgtgtgtgtgtgttggattggatttcgtctgtttgtttctcattttgtttcccgccgtcgcgtcgccggccacgtcgcctcgtgctccagccgccgcggcgtcgccggccgtcccggcgacctcctccccatccgccctggcttgcccgagaggagagaagggagagagatgggagagaagaggggagagagagtggttggctgacacgtggggcccacatgggtcccacgctgactcagctgccacgtagatcaaaaccgggatcaaaacagccgaaggatctcgggtgatcggttttgtatagtcaagggacctcgcatatctggttttgcggttcaaggacgtttttttatctcgctgataagttgagggacctttggtgcactttttccaatgaaacttgtgacgcctaggcccaaggggataagcatgggtgccccaggactaatggttctttttttggtattctcattcgagatattcttaatttgtttccatccaacaaaaagtatctcaagataccattatctcatggtatcaaatcgtttccgatcgtcggataaaacaatgcacatcctgcccagttagatctaacgattaaaaacgatttgatatcggtaccttacgttattttttattggattgaagcaaatatcttcttacaaagaacactgttctatctatccctataactcatttacctatttgtaatcactttttaatttaatatttaactatttgtcatccatatatcaataacatgtggatcctcatatttatgatatgtatgtccagtgataaatagttaattgccacctataaaattgacaaatataagggctcatatgttgttgatatatgggtgacaaataatttaatatcaaatttacaaatggcaaatagttaaatgtacattaatcacgtccctgcctgatctcttaaaccacctctctttaaatcctgctgattgctggtctcatggatcatcttctctagtgagacaccgattctttgggtctcacgagtcacgtgcgtgggtgtttcttggtgtcaaactcgacctgtgtttgattgctcgaatgtacttagcctggctcgtatgtcttatccaggttgagtttggccttggttggtaaaatgcaataaaatgcaatagagggtgtttggttgtatgcattagatgagcctggtttatctgagatgttgtttagttggttggataagaaaatttatacgcaagagattgtgtttggttgctcgtatgtaccttgaatccaattatgttttttctattgtaagagtataatcctaccaagtatatagaaataataatgtcttaagttcataacacttggggtgagttcttatgaacaatttacaactacagctttctcattctctataaacacgcgctttaaaaccgttaaacatcagcgatacgttttatgtaaaaaccttatatataaaagattcctttagaaaaattcaaataaacctattatgtcttagtttcagttcccaacaaacatacaagctgaactgctcggtcgaactcgaacccagcctatacgactgtcatttctgaagccaagcaatacgaagctttgtttgaggctttgagctgctacatgaatggatccccaacgatagcgcataacaaaagatctactagtatcagtcacacgataatagcattctgaagctgtcgctattaaaagtcgttgttgccactcgaatggaaccatattctatgaacgtttcctcctcaattatccgcaaaacagaaatcacgtgtgtttgtctcagttcgtcctctcctctcctatttttctgttctacaagccctgtgctggcgcgtcaaaatatccttgcagtcttaggctaaatttagttctaaactttttctttaaacttccaactttttcattacatttacacaaataaactttcaacttttccgtcaatcgttccaattttaatcaaacttccaattttgacatgaactaaacacatccttacacgaagtaccactgttttactttgttttggatgactagatgatttgtgatgattatctaatggtaggaacgaattggttaactattatacttttttaaaaaataatgtattgaaagtttttgaaagcttagcaagcttttcatgagaatagaacagcaggctggctgacccgttcgcggaagatggaagacgacgttgccgtccatcccaacacgcaacgccgccggccgcaacgcgccggtttccggtccgatccgcttcacacccaccacgtctgcaggccagccgcacgacgcaagcaaaagaaaaaaaaaacaaacagaccggataagattacctactactctcttagaaatacgaatctaaactataaaccttatttttttcttataaaaatataatattttacattaatttccgttagcacgttttcaaactatataagttttgtgtgaaaaatttctatataagctttaaaatacatccattcgtcaagtttgtcataattaaaatttaattaattatactacatgtcaatagttttttcgttttacgtgcactaacttaatctgcgtctttactagttttaaacatcatttatttgttccactaatatcgtttagatttataattttaagaatgcaaactagttataagtaagacgaagggagtaagagttatatgtctttcccaaacagctaaaaaaaggccgaaaaacagcggagatttctatggaattcgtctagaaagctgcgaatcttcccttaggattcgcttatccttgccaaatcctctccaaattcaaagcatcacttatttttttttttaaaaaaaacggcaaacacgagtccatgagaccacgagtgacgacgagtagtcctccacccctacgcctcgccttctcctctcttcttttcccacgcaaacgccggagacagaggaggagacaagagtccaagaccaatgcgaggcaacggcagggggcgggaggaggaggggaactccccaatgggccgccggttgcgggccgtctcggcccacctcctgccgccggcgtccaccaccaccaccaccggcggcgttgacctcgccgccaaccccaccgccggcgagtacgcgcacggtatgtcgtatcttcagtcccgtgtggtgatgcccgcgattcggatctctttggggttggattcccagctggtcgagcagactagcacttttgcttttagataataatctaaaattgtttctgattcccaaacggtggtggtaatacgcgtcgcaacactgtgttcatcggatttagttatggtcgtgtggagaggtttcgcttttctgaatttgtgctgccgagtccgcgcatcagttccatacttccgttgcttagctcggtagtatccttctcgctattggattagagtaatcgcttctaaagctccctttatatatctaaaaaattaaaaatatttagagtattcgcttgtgtgctgaataaaggtaaaagggatgaggccttttcttcctttttttagtatgccggcacacgaaagttgtggacttgtggattccccaactactgcatgtttgatttatctttcttgacaaaacagcctttttttagtttgtaactcaatgtcatagcttctccagtgcagggctacagtgctgtgctccctgagaagttgcagaccgggaagtggaatgtataccggtaggttatttatatttttggctgcatttgcttatgttgcagctcacaattgctgtttccaatcttgcaggaatgcgaagacacctcttaggttaatagatagattccctgatacccctgatattgcaacgcttcatgataatttcgtgtaagaatcctcgaaatctcatttgagcatccggcttttatttcttaatattattctcaacttggcgaagtctcagttatttacaaaatgttatgctatgatttatcaaattcttgttttgaattgtcagcaaacatgtgagtgcacaaacatagagttaagcaaaatgaacgctagttctgttttccctaggatgaattgtatcaggaggattcttaggaaaatctgattacataaaaagaattattggcaagggaagctgttctttaagctattttattgaaaccttggagccggaaaatgtttgtatctataagggaaaagtgagttaacctttatctattgttagatccacagcctgaatgcagatggtttttatctgatggttttatgaaagctgataaatttagatctgttgcaggctacatgctttacaagaaaattattattcttcaaatttaagttctgtgctaagttctgaggcaatataccccaaattgcgcaggtatgcagttgagacctttagggactgtagatacctgggcacaagaatctgcgctgatggaacagttggggagtaaggattagttcctggatatatgtgttattattggcttttgtagctttgttcaaatcttttaaatgatatatgtatggaactttgcagctacaaatggatgacatatggagaagctagtacaaacaggactgcaataggttctggtcttatttatcatggaatacctgaagtgagtcataatggtcgcaacaagtaccgtccttctttttttaactagtagcaggcagatcttgtcacacatggacaatgatataacatttgtatttacacttagagagtcccttttttttttaacttgctttattttttttaactctgaaccagggtgcatgcattggtttgtattttataaacagacctgagtggatcatagttgatcatgcctgtgcagcatattcattcgtgtctgtgccactntatgacactcttggtatgcactattcaccaaatgatcatctatatccttatcattcatctagcaacaatatttatgtaatctgcaggtccagatgcagttcagttcattgtcaaccatgcgacagtagaagctattttctgtgtgcctcaaacactaagcactgtgagctttaaccccttatctcagccttgtatagttattagtttatacaatcattaaaatttgcacttttcatgtcactggtaccagccattaactactgaaggtggcaagtagctagttatttccaggaaatagatctgtgctttcaggtgctgatctcatcctgctatgaacacacaatgtcaaaagactgcacactgcataaactgcatgctcatcatactgtttgttcttaaccatatccacatacgcacatgatcaatgggctgagcgctgggccctgaccatgaaatatgtttatgtggattctgatccttgtttcaaacactacatcagtttgtacctttaatttaatcatgatatattctttggaatgaagtatttttatgtttgcttatgtatatgtctctatttattgcagctgttaagctttataactcaaatgccatgtgttcgccttatagtggtaagttcgaaccatttataattagtatgttcaatcgagcagtcatgattttttaagaatctttgttctgttttttttttcttaacttgttttgtataggtaattggtggagacaatgcaaatatgccatctaccccaacatctactggagtggaaattataatttactccagactactcaaccaggtgaatttgctacatgatccttcagtttttgaaaactatattgtactaccttcatctcaaaatataagaacttttggggttgaacaagggtattaaggaagtatgtggagttaaatggcagaaggttttgattgatcgaaaagaggaagtagatggataaattaaatgagggaagattgcgattggttgaaaaaagaacgtaggtggagaagttgctatattttgggacaaacttagaatgctaaaagttgctatatttttggatagagggagtatatgggatactagtcttaacacctcatatagttttagagatgtctgcaccagatgagtttactaacactatatattgttcattgtatttgttctattccacgcaaaaaatgtatttgttctccaatttcagtcaaccgaatcaaactgcataccagttgactgcactccgtcatgtatgttgctctgattaaatttagacttgttccaaatgatttatccatatcagacaaagttgatgtggcatctagtttccacttatatttgtgtgagcagtgtgcctacgttttcatttttctttcttatggacacacatagtatgtgcattctgtacatattgtctttttaagttttgcgtcaaatgcctgcatatctgtatccagtcatatacataatctttggtgttagattgaaggttgctagcacttttgctcactatttttccatcgcttttgaatcttcaactcagggaaagatgagttctagaccttttcgtcctccaaaacctgaagatgttgccactatttgttacactagtggcacaaccggcacaccaaaggtaaataacccatgtttctgattattctttgctccattcaaagggcctttctaattcgacctttcaatcttgtggcacttgatgtcatatttccagggagttgttctttctcataggaacttaatcgcaaatgtagcaggatcaagtgtggtcattaagttttacccatctgatgtgtgaggagtttacattaaatctagattcatatctttctgctataacttaataaatttatatcatctctaaatgtttttgatagtagtcatgttgatatctctccacaggtacatctcatatctacctttagctcacatctatgagagagttaaccagattgcactgcttcactatggagttgccattggattctaccaaggggtatgcagatccaaaaccattcaggatgttaatttggtagttctttgcatttgctgtttgtgtaaataatagaacatgtagaacaatggagtttctgacttagaaaaggtatatatcaataaccggggccaggtgcacatgaaataaaccacttggaaaagcaattggtaatgctagttctcctgtaactgtaagttacccctagacataggagcagaattggatcaggtagtgcaatatttctaactgttagataagaatcatccagagatcaattgaacacagcagatttcgacagtctaatgtcgtttatataacagttctgaagtctgaactttctactcttcttaatacaatttcggttggttgagtttcggccgacccggctaaaaaattgaacacaatagatgcattttatgctggacctttcacctacaagatatcatcccattatagtagttgttatggcatccttgtcttaaatggatccattttgttatctcatgttagtttactgcacctctatgttgctcaccataatccttt

SEQ ID NO: 58267 - DNA, 805 bp, Oryza sativa
tgtttgtaaattagggactaaactttagtccctctcacaaaaatataagtctctatcttagaaacttatatttttgagcccctctctcccaaacaccctcatatatatatcttgcttctaaactgttaatactccaccatccgttataaaatataaacaatttttagtatagtgtcaagtcaaatatttatatatttaactattaattgcaaaagaataaaaaaatcaatcatatcaaattgatgttactagatttatcattaaacaaactatcacaatatgcgactctttttatttaaaacatcttacttttataaatgtcattggttaaagtagtatctcgaataccgtgtcgaagatcaaaagtgtttatattttaggacggaggaagtaataaagatgtaagaattttatctataaataaattatttgtaatagctcaaccaactagacatgcactattttgggccttctggatcaatattttcccaaccactccttttgcacatcgatatttgcatgttcaagcttgaaagacatatgatggtagggatgaaaacggagcggatagtttctgtccgctccggataaaaacggatacggatacctttcggatcggataattctcggatattttggatacggatacgaatacggatattttctcccggatacgaatacgaatatggtatcagggttttcgtcggatacggataataattcggatatccggtgaacagtgctattcggatatccgcaggacccatgagacataccccatttctttctaactctataaccttca

SEQ ID NO: 58268 - DNA, 745 bp, Oryza sativa
cctgcagcccattcggaattaatatttattttgtcatatataaattaacatactcagtttggagttcataagttcagtacgaacaatctgaagataaatgcgatactatatatatacgggagattcacacatagagtgactgtcgtatatatatatatatatatatatatatatatatatatatatatatatatatatatatatatatgctatacacgttagaactctcctggcaaagcataccataattaaggagcttatgattcttagcatatactccctccatcccagaatgtttgacgccgttgactttttaaaatatgtttgaccgtttgtcttattcaaaaaatttaagtaattattaattcctttcctattatttgatttattgttaaatatacttttatgtatacatatagttttatatatttcataaaagtttttaaataagacgaacggtcaaacatgtttaaaaaagtcaacggtgtcaaacatttagggaaggaggtagtatttttctacgaggaaccattgattattggctagctatctagcaaaagtgtcacacaccatgcatgggaagaatggcagttcaaaagccctagccagtgagatatataaaaccaattaagctatttattatttctcaatccaaaagtttagaacattatgatgggggaaaaactttggaggtagaagtatttacagaagctctagctgaagccttaattcctcacaaaacacg

SEQ ID NO: 58269 - DNA, 1330 bp, Oryza sativa
ctaaagatcatctttagtcccggttccacacgaaccgggactaaagatcatctttagtcccggttcgaatgctgtcaggacctgtcaggcccccccgggatctttagtcccggttggtaacaccaaccgggactaaagatcttaactttagtcccggttggtaatcccggtgatctttagccccggttggtgctaccaaccgggactaaagatcttaactttagtcccggttggtaataccaaccgggactaatgatcccggtgatctttagccccggttggtgctattaaccgggactaaagtcccacccctatatatatgtcttcttcctcctccagctgcccgagcaagcttcaaaatttcttcaaaaaagaggggaggtcatgccaaaatttctattaaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttaatttgctaaacaaggttttataaaatagttgagaaggaaaactctagtgaaagttaatcttaaataatagaaaacaaactaaaatgaaaattaaaagaagtaaaacaaattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaagaggcccataaattggacaagatgttggaggaccacagaacttcgttgtacccaggttgcgagcaggggca

SEQ ID NO: 58270 - DNA, 1653 bp, Oryza sativa
aaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgcaataaggggtatccttccagacaatgtccgtgcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcatccagaggcaagcgtcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtattgattgatgacagtgggatgacaactgttgaccttaacaaggttgga

SEQ ID NO: 58271 - DNA, 4964 bp, Oryza sativa
cggccccacaacgccacgccgccgccgcggtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagcgaacgaacgaggacgaacgttaacgtgaaatgcaatatatatatatatatatatatatatatatatatatatgttacttcgcatttatcctaatacattttttttatcttgcagaaaagacgtgttgtcggagtcgtccgtcaagcctgagtggaagagctagccctagaaggaattggagcagacaagtgacgtaataatataaatgattgttatatttgtaatgcaattaattaagattattagacctgtaattagacttatcacgtaaggttgcgtagggttctaatgtacaacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggagggggaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgacaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgtatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattactttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggacgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatccttcctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggccccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagtctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctatgaactataccagctggacgccctcgacgtctctattatgagttgctggattttgtaagtatatcgttcagttagatttcttactatacgtctcctttaattaattaggtccttgtatataagtagaccatagaaaataatataccccctttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaaatcttgttaagttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtaggcgcaaagcaaaagcagggaactaacttgtgcggctattacatgtgcgagtattgccactgccttgcagaccaaatcatcaccacaagagagctcgatgtacgtacaaataaattcaaattttcattacgtagcgatttcttgttaattactaattaatttcatacattcatatagtttattcgcatgagggataacctgaccacacacaaggaattatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaaggtcacgatctttagtcccggttggtaacaccaccgggactaaagattgctcagcctttcacccgagactaaagatagcgatctttagtcccggttggtactcccggtttggaaaccgggactaaaggggggttaggaaccgggactacaaagggtttctccaccagtgatatatatatatatatatatatatatatatatatatatatatatatatatatatatatatatatatatatatatatatatatatatatacgtacacatatatatatatatatacgtatatatatatacgtatatacatatatatatatatacatatatatatatatatatacatatatatatgtatggttgttttgcactctcgagagtacatacaccctcccctgacagtggaacatacaataagatccacttccccggatcgaaaaaaaaa

SEQ ID NO: 58272 - DNA, 4899 bp, Oryza sativa
agcgatctttagtcccggttggtactcccggtttggaatccgggactaaaggggggttaggaaccgggactacaaagggtttctcccccagtgatatatatatatatatatatatatatatatatatatatatatatatatatatacgtacacatatatatatatatatacgtatatatatatacgtatatacatatatatatatatacatatatatatatatatatacatatatatatgtatggttgttttgtactcccgggagtacatacaccctcccctgacagtggatcatccaataggatccaatttaccggattgaacaaaaaaatgattaataaataaatgatgtaattaacaatcggggatgcatgcatgcaactaataatttgaaaattagtctgcctgttgcatgcaaagtagttacgtttgcattacacctttttttacttcataatattcggtatatatgtaccacgaccaacgttgaaaatgccttttcttttttagtatccggtatatactgtgtgtttatgtgtatgatttagtatgtacaccgtattacattttttgttgttggactgtatgcatttttttaatatccagtatgtatatacttgatcttttttagtatggcatatacttttttatgttagtaacagtatatacctttttaaattaggagagcagtatatactttttttaatccggtatatactggactagatcatgtactggttggttgtaggactacgtaccgctttaatttctttgtaggattcactatatattagaccaaatactgtttttttaggtacgatagctcttccttttttcagggagagtagtagtctttaagtagcagtgcatgctattttattttagtaagtcagtaggagtacatactgtttttaaacttagttgaagtatatacttgttttaacttagtataagtatataacttcttttaattagtaccagtatatgctacatacttttcaattactagtatatactttttatgagtatatactgttcttaaacttaattagtagccgtacatatgtttttatagtaagttaattagtaggagtgcacactgtttttaaacttagtagcagtatataccttttttaacttagtaacagtacatacctatttttcaacttagtaccagtatatagtttttgatgaatatattttttgaacaaacataaagatgtttgataaggaaaaaaatcaaaacaacttataatatgaaatgaagggagtagtataggtattttttttccacgtaatagtacgtaccatttttgtcttatagaatagaacaatacgtaaatttagtatgtgtagggttgctaattttgaataaactgtatcagtcaatgattgataaagaagtgtcgtcaatcattggcaaagtatcgggttgctgcattctgaataaagctaaatgaatgaaatacgctagaagtgcactgaattctgaatagacaattctacatgcagggtaacgaatcggttagcatcgatgggatcacgccaaacacgcgccggagagggaaacgagtattaatgtgccagcttgctggatcaacggaatcacggactcagcgccgcgccagacgaccatacatgctggagtgttctgttgtcagcaccatctatgcccacgatagatgtgtctcgcatctgcatgcaccaaacaaatgcattcatcataggcttaatcattctatatatcaacgtcatacttcatgtctgcatcctcgtctgcaaacaataacagagatatacccaatagaaaaaggaagattatgtattatcattctacaggaaaaaattaatcaaacaaaactggaacaagaaagaaagggcttgccttgatcgttgcacgggcgctaaggtcaccggcgctagtttcgatcggtcagccaaagtgaagccaccgccccctccgcgtagacagcgtcaccgcacgggcagacggctagataggaagagccgatggatcgatgccgtgataccgtcgccacaagggtcggcaccgcctgggaacgccatgttgctgcagatgaatattgtcgccacatcccagcaaatcaccgatggatgttgccgccggcgtggttgctcgatccccaatggatcgtgctgtacctccgcttcgagtcgccagtagctagcgctcgatccgaatacagcggagagagcgagctgttaccatcgcggatgggatgggaaccaagggatttatacgacctgttcagaaccgattagtgcgggataattaaacattaggagaatattctttaaaaaaatggaaacgggtccggtgagtgcatccgctaacatggttgatcgtgggtggctactgatcaacggtggatgggagcaggtgtacgtactcctgggaatatagaaccattttcatatatatatatatatacacacacgtacgagttgaacatagctcaactggttaattagattcattgtggtggaacctcatcacttggacaaccggcttcaagctctaaaaaattgggcggatgcttgcattcatctaattgtcttcgttggtgcttataaagatattatgtgtatatgtttacagtggtgagtgtgcgtattttatgtgtataccgtatttgggggaaaacaccacgtatatttctatatggccataagtaaaaatttatttattgaatgtaacttcttatttaatttagctcatacagtttgcgcagataatttaatttggtttggtgaaagctgacgtctgtgacacttttgtctatgcatatatggttggcactcagctgtgctgttaagagttaaaaagtggcaggctggcctaggaacagtacattatctaacatgttttaggataattctcaccacatgtacagtgccatcgatggcaaaggctgacctgatgtaaaagaccccttttgcaaagccagacatgattccttgtcttttggacacatctgatcggttgatccccttaacttgaatcatcagtaccataatgttcacatttgttggaaactactcgcactagaatatgcatgaatggctgcaaacttgcaaactttgtgatgatctgcaaactagaatatgcaaatcatcacgaagtatggctggatcgatcgatctgttgatcaaaattgctccaaatcttcgcaggcagcagtgtaaatggtaaatgtgcgggatgcacagatatatattagtggtgaattttcgaatcagagttttgaaataatatttaaattctaacaaggagtttggctgtacaccactactcttattttgttgtatgcacaacacatctgatattctgatgaatgaaatatctgtcaatggctcaatgggcgacaaggaaattaatttgacacatttcaagccgaaaaataggcgcacattgagtttctctattttttttcttgttttaagaaacagggacatacacatggtgacatggatgtacacaggacgcatgagtgcatgacacggttataagagcaagtttaataatatagccaaccgctggctacaaatcatctatagtcaacttaatagccaattcatacaataattacatataagcatatatactacaaaatcaatatctggtgtcatacacatgtgcgtcttggagtccgtgctgcaactggctacaaatatgtagcccgttgctcttatctctcctcttttatccacttaaaatatgtttatagctagcttatagtctgctattgtacctgctctaaagaggtaactgagacatgaagtgcttgctagcccaaagataaaacactaagggggtatcctagggacttattttttttttgagagaaggattaaagtttagtccctctctcccaaatacccccaagatgagtactcaattatggagaagacatatatacacatgggatggagaaaaagagggagagcatgtagctagagctatgtatatatacaaatacaaagtttatagctaggatttgagaatttttttaaagggagggagtacactatagcggggacatggcgtgcacgaatgcatatgcacatgcagctagctccatcccccatccgtgcagaggataacgaaacaaccatcagttagcctagcacgcatgtgcatgtgcatccatcgatcgatggatgatggatcaatcgagctactcgctagctagctagcacccactttcgtcaagcgctccgcgtccatctcgcactccttctcgcgcgcgcacgcacgcacggtcggcctagctattcaccaccaccttttccacagtagtagtgcactttgctcgatcgcgagatggagctggctagcgccatcataccattgccatgcatgatgcacatctctctctgccttttttttttcttggtgtgttggttgcatgcatggccaccgtaccaccctgcctaggctgctcgatcgatcgatcgtcatcatgaattcatgatcgatttactagctagtttgttccgttagagcaggtacaatagcaggctataagccagctataaacatattttaaagagataaaaaaattgagagaagagcagcgggctacagatctgtagccagctgcagtacggactccaaaatgtaatgtatgtatgataggtgagaccagatattaatagtatagcaagcaactattgtatgaattggctattacattggctatagatgatttggagttagtagtgggctatatattaaacttgctcttacttccatatgtttatatgttagctcaaccagtggcagagccagcagtttcgtaaatcgtgagcgattaaaagtatttttcggtggttgatcaattttttcttagggtgtgtttagttcacgccaaaatt

SEQ ID NO: 58273 - DNA, 2624 bp, Oryza sativa
ctgcagcccttattagtgtggattatttattttcatttaaaaatatgttttcttgacgaactttcatttattatattgcttagacattttgttttaaactactaattaagtttattataaaatattttgttaccctcaattaaatatataatatcatgcagtcattcgacaaataactaatctgttgcaaatttagaatttttttttctcccgcacttagtttcaagcatagtgcaaatacacattgcagtttgacacattgcgcgatattcattctgtgtccgaagatatataatgttaggcacacattagatgttatgtcaagatatatgtagtgacggctccatgcctagggtagctaggcctcgagtcttatgtgtaggacaataagtttccatataaatttcatattttttcttgaattttagagaactaggataaaataatacaagctggctccacccctgtcaacatgcatatgcaacggataatactgttcttaataataagctcagattacaaaacaggtgcactttagctagctaatattccttgccccagcaattattatgagtttatcaccatgcatctcggttgccattatatgcaagcagctagtagccagctatcacagcacgtgagctgatgatgcagcccggatttcactaatcatgccacccatgcacgtaaatttcgatcacaatcaccccacggccatccctgcatcttgtaactaatgataaacattgccagtatattttacatttgacaacaaaattctattttttttcttcatcatatatcatttgtgagtgtgtgagcgtgatgtgcacgtgtgcgtctttcaagcaataaaaaaaaaactaaggcttatcttttatcaacatgaaaaataccctttctttaactacaattgctttttttaaaccttacttccaacttgtttacacttagacgacttgatttgtgaaaaaaaaagcatttcactcgaaaaatatataagaaagaatgaatcgcttaatgtgagatgtactccgtattactaattacttctcatatcataaaatatactacttcctccgtttcataatgtaagtcattctaacatttcccacattcatattgatattaatgaatctagacatatatatctatttagattcattaccaccaatataaatgtgagaaatagtagaatgacttacattgtgaaacggaggaagtaataacttagaattaaattttacaatagacttagaactgaatcaaatactaggttaatgacctatccattaaatacttagaactgaattttttagaaactatttggatggatgccgcatctcatgttagttacgtcataactgcttagccccctttttgttttgcttctatagtttagcgtgtcaaagaggcagctctttgctgctttgccacatatttttgagctaaaagatatggtgagaattttgtttaccacacttttgatagatgcctaacttaaggtgtggcaacttgaaacacccaatcaaccatgcccttagtcttcgtgtttccggcatgtcgaaatggtgatgggcctaatccacacgctgaaagtcccaaaggttaagacttaggcccatcagacccaataccggtgtgcttctctcgaaaagcccaaatcgcccagttccgttcccccgatcacgtgacgccacgtgccgcgtcgcgttggcatccgatggccgcgatgccacatctcctcttctcttctcctctctcttcggtttctcttctctctgatttctccacggctttcttctacctctctcgccgtccttactcctctccctgctctgatccagccgcggcggcctcgccgcgcctcgcctcgcctcggcgcgctgccgccggcgagaagggcgcccgcaggcaccccctcctcgtcccccgagcggcggggcatcctcgtcgtcgcgtgcgcggtcggcgaggaggtgggaggcgacgcggcgggccttcgtgttctgcttgcgttatccgtctcgggttcggatcgaatcggaggtatgttcctcgttgttctctcgtactcgtagccctagctgactcggtccctcccgcgcgcgtggattccaggacttgatgagtggataatttggttgatttccatccctccaattaacctatccactttcttctgggtttcgttgatgcgtagtgtagtgctagtagcagcttgtgtttccataaatgtttgggggttctgcttatgccccatatgtgacgctcctgccaagctggattgcgttctgttttattactgtaattgtcaatggccgaatcatttttagggctgtgtgtttagttggcgagtatatgcaatagtggctagtagctattccattttatctgcaataagtaaggtcggaatatgcagtagcaagctatacaatttcctgtgcattgtagcggctagtgagctataccattttattgcaataagtaatgtcggaatatgcagtagcaagctatacaatttcctgtgcattgtagcggctagttagctatccattttatctgcaataagtaatgtcggaatatgcagtagcacgcgatacaatttcctgtgcattgtgcag

SEQ ID NO: 58274 - DNA, 3886 bp, Oryza sativa
ttgtggaggtctagtgacttcttgaagtgggcaaagctatgtccatcagaaccagaaattggccatgctttgatgcgtttggttatgactggccatgaagtaccacatgcttgcgaggttgtatgatcttctaagttaccaagacatactgatttgtatacatgcaaatgccatcttctaagaaatataacttatccaaacagtgttatgcaaagttcatgtttgacccttgatatattatcaaggtataatatttaattagtgtcagtatgattatgccataaatttgttaatttcaaaaaaaaaacatgcacatcagttttattccactcataaagtgactaacttatggaactcaagtaacatgcactcaacttgatgaggtgtcggtgtttaaagtggtggcttatggaattatggaacaaatcagcttaataaaaaccagttgatttggagtattgggatttcagtccttttttggttcgtgcttcttgtggcctatgggtaacaagtatctattactcttgcgcataaccttatttatttcactgcagtattggaagaaacaagttataattgtataagatctgaaactcactgactcacctgtatttgctttaaactggccagtgctggctagtgccctgttgattgtgaaagaatttgctagtttccacattctttgcatcatatattagtaggtttatactgagccactttttaagccattgcttatatagagtgaagtgaagaaccaatttcctcatttgaaaactagaagttatccatctttgtcagtcttgcgttgtatttagttcagtattcctagtgttgttaactataagttactgacatttgactgtggcctgtgggttgcttgaaagtaatcaaatttgcagaatactgatatgcatgagccttcgttggtattgatatgtttgtgttatcttatgtaaacttaatgtatccaggctacttagctaccatcagattgactatggtttggtttgaattttactgttgtatgctgttcccttgccgtctctgaactttccatttcaaatgttttgcaggttgaactcctaatactgtcctaccacttctacatgtcttcttcttgtctcgatggagtggatgttctagtcacatttgcagctaatagagtggagtcgtatgtgtcagagggggatttttcttgtttagctcgcttgatcactggagtgagcaattttcattccttgagcttcattctttccatccttatagaaaatggacaattggagttgttacttcaaaagtactctgcaactgactcagccactggggcacctgcatcagttagagggtttaggatggctgttatcacctcactgaaacattttatcccaagtgatgacgacgctctttctctggtatatatctctctctctctctccctctctctctggaaattttggtttctgaaatgtattgatgtctgagacacgttcttttaccatccaattagtctgcatacaatcaaacaaccgacataatgtgtgatccaatctaggtccaaagccaagtagtgcatggcctgaaaggagttcatttatcacaaaggagcatcactgtggatatatctgatgacctaatgctttgtcaaagcttaaaactgctgattgagcacataccatgccatcttcgcttttgtgcatacagaaaatgtgctaacaacagcttgttttaatctgctagagattatctagttgggaaatatatgaggtttgttagtaaactagagatagagatcagattagtttccgttatattcaacattagtttcttggatgtcaagtcagtccatcctatatataaagcgaccccatttatcatattatcaatcaagcaatgaatctaaagttagtcaaataaacctcagaacatctcttagctcgacagggaagccctgtcagcgcaatttgacgacgagtgccctatcctctgtctaactatcttcatgcccttatcctagccagttcataagttctatctgttgattgagcacattcaatgccatctatgcattagtatgtacagaaaattcattgagcaattttagcttatttagcatctacatgaagaataaaagaaaacctgagactttagtttccttcatagttagtcgatcctgacagcttcacttttacaatgacaagacatacctcctggctgtttctttacattcttacaacctctgtatactatgcaggtatataagcactttgacatgaagcatgaggctgcttctctccttgagtcacgtgcagaacaatacatgaacagctggttatctcgatatgacaaagaaaggaggaatgatgagctccttgaggctatgcatcaccttgttgagatggctgaggttctttcaacaattgatgctggccaaaggacacaccgggcgtgtgcgcgagcttctctcctatcacttcagatccgtatacctgaccttctgtggattggtctttcggaaaccaatgctcggcggattttcgtagaacaatctaagttccaagaggccctcattgttgctgaagcatacaacataaatcagccgatggaatgggctccagttttttggaaccaaatgctgaaaccagatctaattgagcaatttgtggctgagtttgtgttggtgctgcccctgcagccaccaatgctactcgagcttgcaagattttaccgggcggaggttgcagccaggggggaccagtcacacttctcggtctggctttcgcccggaggcttgcctgcagagtgggtgaaacatcttggcagatcgttcaggagccttctccgtcgaacgagggatatgaggctgaggctgcagttggcaactcttgcaacgggatttagtgacgttcttgacgcatgcaatagtgttttggacaaggttccggagaacgctggccctctaatcctgaggaagggccatggtggtacatacctccctctcatgtaaatccttccattttgatccatcttgttcaactttcggcagactgaatcttacaggagttcagtatatagtgaggtgagaatttttcccgtcctttctttgggcctgcgttcagcattctagttttttgatacatatggatgaagccatgggagatattcggtttgtatatatacaagcattctgagtggataagatgaacatagccgattgagagtgagtttttgcggcttcagtcggtggaagttttcgtgtgggttgtagcgccgtactcgtggtgcctgatgtctgtagtttgttgtaaattccattgacccaaccatgaaattttgtacaattttcttcacgtcacttatgcttcacaagatactcattgatatgctggttgtctggatctgaatccatcgaactgccatgaaatctgaatccttcaggaccaattgtgagttcagagttctggcagttttgagccccctagtcctgcttgagaagatatgcacttgatcagattgtgcctttgatattcttgataagattgtgctatttgattgagattgtactgttcattcccaacaaccctggcggcgatcgtccaacgccggatggataattcttctcacgtggattccaacaatccatgccacacgagacttggacttcttgctaagaaaaagaaatatagcattccagtaggccataaggaaatattcaagcctaggacggccccaatttcgtctgccaccaccaaccaaaccaaactcctcacgagcgtcgccggcgaggcgaagcagccgtagaaaaacccaagatcagcgagttgcgtccatctctcgccgtctccctcagctgctcagctttgatatgatagctcaagggcgatacgtt

SEQ ID NO: 58275 - DNA, 8382 bp, Oryza sativa
ctactagtacttcactgttatacgtggtgatggagagtgcgtacgagtggttaggaacagcttaatatttttcagttttccagctaatctttgtttagatttttcttttccatttgtcttctataattacttttccccgttctggaataattggcagtaacagtaataaaacttaaaactctataaagttataaaaaatactttccatttttccatcttgcttgtctctttttaaaaaatacttaaaattatgtcataattattaaaatatctgatgtcgaaaaatattacaatacggttttcattcatcacaatataattatttaaaagtaatttgtggttaaagtgagatgatcgtaagtattattgcgactattattaacaaccggcggtactataaatcaaattaggacaatgttattcatcacagtaacaattgatcaccccattctctaccatttgtgtagttttcccaaatcgaagttcaattatgcaaacatgcatttgctctgcttatatttataagccaaaatttaaatagaacttagttttgagtttgattttttttctaattgtactttactttacatcatttactaagtacatgtactttttaataaacaattcggataagtatacgagtgagcgcaacaatgcttccataattctaggggatgctttgcttcaaccatttggtcgaagcccaaaagtgagtaatgaaagcttcatttctctacttcccacgtgtcaccctgacgtgcactgctggcagctgacgtggcactcccgtaattatatatattttcccctggaagcttcctgccctgcccctccttttcccacgaatcccgattccgatccgattccgcggcgcactgtcaatcccattcccattcccattcccattccctccccccgaaacgaaaacgaagcaaaaacgtctcaacctctccgcctccgcagatcgcctccgcgccgcgccgccgccgacaatggtcgccgtcgacccgccgccgcgggaggccgcggccgccccgcccgccatgaagcggagcgcgagcttcgaccgcgtcccggaggaggcgcgccgcatcctgcaccgcctcgccggggagctctggggcggcgacgtcgaccccgccgcgctcgccgtgtcccagctcaagggcgccatgaccaacgaggtgttccggatcacctggcccggcggcggcggcggcgagggcgagggcgagggcgaccaccgcaaggtgctcgtccgcatctacggccagggcgtcgaggtcttcttcgaccgcgcgacgaggtccgcaccttcgagtgcatgtcccgccacggccagggcccccgcctcctcggccgcttccccaacggccgcatcgaggagttcatcaacgcgagggtacgcactctctctctctctctctctctctctctctctctctctctctctctctctctctctctctctcccccatcactcctctgctcccaatggcaatggctcattctcctcgtgttctgctcagacgctctccgcggcggatctgcgcgacgcggagatatcctcgctgatcgccaagaagcttcgtgaattccacgatctcgacatgcctggacccaagaacgtgtcactgtggcagaggctgaggtacgcatccccttcactatttctttatctccattaatggcgagaaccacgagcaatccccccttccagaggctaatttcactgtgcttcatgaatcaggaggtggcttgaggaagctcgtggcaggtgctcgcccgaggaggctaggcagttcagtttggagaagctaggtgatgagatcgcaatgctggacattgcattgtcaggggttgatcagagagtaggattttgccacaatgatctgcaatatggcaacattatgatatatgaagaaaccagacaagtgaccttaattgtaagcgactcagtatctccttttacaaatgctccgaaatcaggcgaacagctctgatgcttgatttaaacataaatttgcatctgggttgcataattgaactagtatgaagcatatgatgttggtaattcttggaatgggagcaattgcttaggtcatattctgttaatattttgctgtaaataactgctgtcttgggatctcttttatccttcaggactacgagtatgcgagttttaatcctgtggcatttgacattgctaatcacttctgtgagatgtctgctgattatcattcagccacacctcatgtgctggacttcacaaaataccctggtcagtactgatgatagccatatctgttaagttctacctgcgcgcatggctgtgtgcatttcactgagaaaaaaatcggcttgtttgacacctctgcatatttcaggcattgacgaacaacgcagatttgttcaaacgtacctcagctcttcaggtaagcaggatgcaccttggcaccgttggcccgatgaaagaaaagggaaaataatgcactttgggactgaatgaatactgatgctgcattttctgtaatgtgccatgagtgattttaatcttgattgttccttctgtttatcaggtgagaacccatcagatgcggaagttgaacatttacttggcctgattgcaaaatacagtcttgcaagccatatcttctggggtctttggggaataatctcagtaagctctcttaacacagcggccacgccaatggcaaatgtgtatagataatctatttagtgatcttacaaagctggttggtatctgtttcttgtctccaggggcatgtgaacaagaacatcgacttcgagtaccaggagtatgcaaggcagcggttcgatcagtactggaagacaaaagatcaaacgctgggatccaaatccaactagttgatcacacagacacacagagcattcttctttcatgtcttgtgatccttttcttttatatagctttgtctagtcttgtgaattctcaattgtgtgtgtctgtagcagcagcagcgtagctgccaagtttttactgtaaaaatctttcggctccttgcaaacatgtccttcgtttccgtatcatgcgattggagtagggcagtaggctgggtgatttttctcggaggagattttctccggtgccatgtgtgcagcggcggcggcagcgcgcctttgcagagtctccacgcactgcaactgctgctgccgtcgtcaggctcgccggccactcccactctcatcgccgatagcacggagcttctgaatctttctatggatctgaattgaaacgaacaaaatgcaaggtgccgaaacgaaatcgctggtcctagattctgcagaattgatgtctttatctgtaagaaagattcagttgaatggcaacaagggcaccagtggtctagtggtctagtggtagaatagtaacggcccaactattcattcttcaaagcccacacagaaaacttcgcctccatccatggacttagctccttactctatatgggccgaataattcggcccataaactctctcctcatctcctccccaccctaggccaatacatccgcgcgccgccgactcctcctcttgccccccctctcgccgcgccgccgccgcctctgcccgtcagacacacctcccccctcctcgaggacaagggactctcctctctcgccggcggcggccgtcggcgacgacgtatagtactccacccccactcagctgtactgacgcggcttgtgtggatccgagcttggattggtcgattccttctgttctcgtgagtcggtcttgccctcgcggttcgttttgctctgccttttttttaggttgctatctgtatattatgtgaacaatggcgcaccgaagttcactcagattcttgactgttttttgttgtttgctgttgctagttagccgctgttgaaggtaaccatggccagtgccaaccgccgctgaacagaaggctatggaagggggcgagcaggaggctctggatgaaatggagaagaaggtgcacaagtactcgcgggggaaggctgcttaccttggggtgagactgctgctaaactacttcttcttcaaaaatctgcgtccctgtttgattcacatgtgtatgtgtggtttatgttgggtttatcagactcttcgcgacaagaaattgaaagggcagctcgccgcaagagagaagctctatggacactccgccaaagccgccgttcagaccgagaaggtgcggttgttgattcttgtaatgaatgtttctgggagcatatgcaacacaatgggagaattgagaatctgtcgtttgttgatctttatttttgcttccaattttgcagtggctcttgcctaccgagggcggctatttagagcctgatgatgatggtctggagaagacgtacagatatcagcaaacttcgctccgggaggacgtggatcttttgagttcaagaaagccatttgatatgatcttaccttgtaagtgtctaaatctgttttttttgttctttgaagctgtgatatcataggcggcttgttaaatcaagccctaattttttcccctgctacattagatcttgataaatgaaaacccctatctcaagaaaccatcatcttgcttaatttatccattactaattttggtttaaaaaaaactaaaaagaagtgtagaaggaacaccattagtgttttcaattgaattattttatttccaatacacttattttgtagccactataaaactttccctgttcctcttctgtaaattcccccttcttcacttcttctaattgtggcaggggtacactgttctatttatctggatgaatgctgatttttttttgtttaaatatatataaccatagcatttatttatcttcatttctgtatcatcatgtaacaatgtatcttttttggaataattgctagatagcacttttcatctacttgctgctattaacttttcggatgacaaccaacaagttatgagggattgactagctcttctcttatgatgcagtacttggcccttatactctaggatacacgggaaatggccggtatatggtagtaggtggacgaaaaggtcatgtcgctatgatggatatgttgaatttggaactcgtcaaggagtttcaggtcattttttcagaactcaagacttttcccagcatgcattttttttccttatatgagtcatattttttacgtcttcctactggtatttctatccatgcgtttatggcactttctgttgtagtagaggtttctggttatgaaagaacagaaccatctttatcctggtcaaattcctaccatgtcccctattctttcaagttcttttccctgctatagtaatcaacatgactgtttttaatttgcacaggtgagggaaactgtgcgcgatgtggcattcttacataatgagcaactctatgctgtcgcccagaaaaagtaatttccttaatatactcaatctttgcaatatttttccaatgctcataacataggtcaacatgttccatattctggtcttgagtcttgacaaagatgtagacaaactgagaggtcaatgaagcaaaaagtgcaagaatcaacctaggctgactatataaacaaactgagaggtcaatgaagcaaaaaatgcaagaatcaacctagtctgactatataaacaaactgagaggtcaatgaagcaaacagtgcaagaatcaaactaggctgattgctcagaggctcagagctttaaagtttaaacacacataagtacttctagcacattatggtttggtttgtggatcaattaggctatagaataatgcaagatttcctgtatgattcgttataaaaatttgctggagtggtataattctatgctacttccgtgaacaagaagcctaatttctggcagttttttgaactgctagtacatagattgaggatgagcaaattgagcaatgtgcggtaggctggggtagaattgccttctgagttctgattgccctactggagtataagtcattgatctgtccctggaaatgatgatcattcctgtacatggcagggaacctttgtttttttttttggccagcccagaggtggagccacaccaaaatttggtttttaaaatattttctatattttactttttttttcactagcgtgtaatacatagcttatctccacagttttccacgtctatttttgatgaaatttgtgggcataactccaaatattgtcaaacattttatgttacctttccatgtaatttttagacttcctcatgtgatattcttttaacaggtacccctacatatataatcgacatggcacagaaattcactgcttaaaggtaattatgatgtaaacacattggctttctgaatgaatgtgcctagctattgatgattttgagaaattgttagttttgttgttgtttcacatgttttcagttaacatgcaggaaagttaaaactttatagctatttaatttttactttatgtatgtctatgctttgatgtggtatactggtatctctcaaagttcagtaaagatttgaatgtatatcttatcttgtttaggattctgaatgttttgtgtccacaggaacatggtaaatcgttgaagctccaatttctggaaaagcactttctcttgtcatcaataaacagctttgggcagctccattaccaagatataagcactggtgagatggttgcaaattacaggacaggtctgggacgtactgatgttatgcggctaaatccttacaatgctgttattggccttgggcatgctggtggcaaagttaccatgtggaagccaaccagtgtgaaaccccttgtcacaatgctgtgccatagtggccctgtgacagccattgcatttgacaggggtggtcatcttatggcaacagcaggtgttgacaggaaggtcaagatttgggatctcaggaagtatgaggttataaattcttatgctgcacgtgcacaatccctggatttcagccagaaaggtttgttggcctgcagcaatggatctcaagtagagatattcagggataccgggggacaggattataaaatttatatgaaacatagaatggtaaagggataccagattgggaaggttttgttccgtccttacgaggatgttctggggattggtcactccatgggcctttctgccattcttgttcctggatctggtgagccaaactttgatacctttgttgacaaccccgttgagacttccaagcagagaagggagaaggaggtgcaatccctgcttaacaagctccagccagagacgataatgcttaatccgaacatgatagctaccgtaagaccttcaaggaagaaagagaagaagaccaagaaggagattgaggaggagatggaagacgccgtagaggctgccaagagcatcgagttcaagaagaagaccaagggtaggagcaaagccagcaagcgggccaagaagagggaggaagaagttttgaaagccaaaaggccgttcctggagcaacacaaggaaaacgatgggaggcctgacaagaaacagcgggtcagcgaggagattgagctgccaaaggccttgcagcggttcgcaaagagtaggcagtgacaatggagcacagaattttctttttctttttgtttgctgcaacctcatatttatcactagtgtgcattgtatcgtgtagctggcaaatgtcatatctgcttccttgtgaaccataggcttttgcacatgaggcaatggtgcacagaagtaagcacccaaattttgttctgaatcttttgtgatatgttggtcaaatgtgcatgtgaccccaacggtgtagccgtcggctgttggtgccttgttaatgtcagtgctgaagtatagagtagcactacatttacagcagtattacgtgctgagattcagttcctctggtgaccactctggggaatgctattgcttaatcatcattctggagcacggttgcataaatgcatagctactcgttcagttgtatttgcagcttgcgttttgtacaagggagcatgttggctgatggtgtttctctgtttatcactacagcaataggcatcactacctgatagttaccgaaacctttagatatttgaaagcaacacaacaaatctgtatcctgcaataaggagcaaatgcaagttatcaaactatatgaaattaccagtcagttttatttcatcaagggcgccagtggtctagtggtagaatagtaccctgccacggtacagaccctggttcgattccttgctggtgcattttttcagtattttttgcctttcatatgctgttgttaaataaattttacctttccctattgtttgcctttcatatgctgttgttaaataaat

SEQ ID NO: 58276 - DNA, 751 bp, Oryza sativa
actcttttttttcacccttttgaggtatatttttgctcttacatataccatgtatttttttttaactttttccttttgtttttattttcctatgcgtaagggtaaattggacaaatcatatagattttgcatgaatgatgacatggcatgtccatgtggcgattttggtgggaccaaggactatatcagtccacatgataaatttaaaggacttgtttggacaatataaaatattaaggactaaaatgatccaggagcgaaactttaaggaccatattagctattctcccttaaaaaaattaacttaagaaaatgttaaaacgacttataatatgaaatagagtgacgtgcattttgcagtgagcagctgcacgaacgtaccacgccggcgttctcctgccgccgcgctggtcgtcgccgatgtacttggccgagttgagctcgtacttgtacgtcggcgcgaactccagcaccccttccgtccacccgtcgaacgcccgacccttccttagctctcgcttcagctgatttattattcagacataataatcagagagattcagatcaaacagcaagattcagatgtgccacacagaaactttagggcccgatcgattgactatgagctaattataagctaaaatggtttattagcgacgaaaacaaaatttatagataaaacttttatacatgtagaattagtcacttaaaacccaatgctagaagaaactatttaaaatattttataatc

SEQ ID NO: 58277 - DNA, 2752 bp, Oryza sativa
tgtgttcgcatggatatcatcaaacttctcatcaaatgtcatgggcctacaaaaaagacacacaatgttacaatgttagagacatgtataaatataggaaattaacatcacttaaaaacaaaaaacactcactggccggctcttcctcgaaaacggatttcaatcgttgaattccgatataaaggatagtctgacagtgacttattgacttattgtactctaaaatctttccacataatactgcatatgtgtccttaacatttactctcatcttttgacaagcagagttgattagataatcaacttttgtgttagataaatccacttgtacagatatattaaccccacatgccttgacaaataatgattgtaacccctgcaaataagaatcagcaaaaagagcatataaacatcaacatatgacaacaaaaacaaatgcgagattgattaaaacttgttagtaagatgaagtgcagcaatgcattaaaaaaatggcgcacacattacttaatgtatacagattgatctctaagctaaaaatgaggttatcacattgttgctctgacttaaaatggcatgggtagcgatgaggacttggggatggtatgcactgcgatgatgacttgggtgatggcatgcactacgatgatgacttgggcgatggtacgcactgcaatgaggaatcagatgctgatacatgcaggaacgttgactccgataatgacaacaataggtttactgacctaggtggtgacaacatattcaacatagattgtgataataatttcagtgatctggatggtgactatgaagatagcgaatgaaaattgctgcgaacgaaagctacacaagagcaacattgatcagttccatcgagaccatttggtatggttgaaactaaatagataggagcctaacattttgcttggtgatgtgtttggtatttgggatgcagtatgttgtttattaccttgtgcccatgtggtgctaaggtaatgtagcttataagtgcagacctgtaatggattgatggatgttttattaattaaatggttcaactattgaactgttggatgtttagtaattttgattggcaggtggaatgggtcatgttcaatttgattagcggagctgtgaaatagtggttgcagttaaaattttatttgctttgtctggcggttccaacttatttccttgacggctacaataactcaaaaatggataaacctgtcaggtttccaccctcaccaaattgcataataaatcttgtggtttaacaccgtaatgaaaatgattaaacctgggggggggggggtgaacaccgacacgaaaataaattaaactggcggtttcatccaaatctctagcggtgcacgaaattatatatgcgacaattagagggtgttaccgaggaattgggcaagaaagaagatggtggaggagcatcttgcttcacatggacgacctccttcacctcgtccagcgtgttgtcctgcagtcaagacaacccaaagaaaagattataagcaagggcagatagcaagaaagagattgctcgcatcttgtcaagcgcacctgatttttctttttctgatttttcaaaccattttttagatgtgttttacaacagttgaacatgctgcggtgctcaggctagctaggagcagtacctctcatcctttctcgatcgatagtgtggtgtatggagtacgtgatgcgtttgaggtttagggtgtgatggggaaagatgaagtgagaatgcaagatctaagggctcacgcagtcacgctcacacgcacacgacagaacgaaaaaacaccagcgtaaaagaaaagttttattcggatcatcaccttcttcttgcacagcgtagagtcgccggagaactgtctttgcgcccgtcgccgccgcgtccatgcagcccttggcagcttggtccccgtcgccgccgccgccgcgctcgtacggccctttgctcccgcggcgacggcgacggcggcggcggcggccgcggccgccggagtgaatcatggtctctgtgggagtcactgaggtggagaaagaactgagggaggaagaagaactgaggggaactgaggggagctgctacccgcccggccctccgctctccatgctgcttctctctctaagcgagcgaacaagaaaggcagggcagagagggagagatcgatagcctatgccttcctctggggctctgggcgctaaccctaggcgctagctagctacccctagcttgtacagtagttgcacctcacaggcacacattactgcaggacacacacacccagcgagccacacgcaaccagctgtccagctgcttttacttttgcttttgcctgcaacagggaagcaattcaattcaaggatacgcgggtgatatggtgattggtggagatttttacctgtgcgcgttaaaaaagatgacccctgccttctgtcactaaaaagttcaagcctccctttataccatcgtcgaactttatcgcgccctccacactattccatctgtttttagtcctaacagtgtcaaacagcgcagtcaaatgactttgttgtccttagggttgagagagaagagagagagagccgggacggagggcaccaccgacgaagagcactggacggcggcggtggcggccgcggacgccgcggcctcctcggcggcccccatggcggcgaggatccagcgcatccccgacgacgaccccgctactcacatgcgtcgacggcg

SEQ ID NO: 58278 - DNA, 1382 bp, Oryza sativa
atggtgcaggcgtattgattggtggggcatcgtgtggattggctgcctgatcagtgactgacactgatggacatcactgtaccattttgccctccaacattagtaaggcccgttccctaaaatgttttccaaaaaatcagatcaaatcgttggatacgtgcatggagcattaaatatagataaaaataaaaactaattgcacagttaggaggaaaatcgcgagacgaatcttttgagactaattagttcatgattagccaaaaagtgctatagtaacccacatgtgttaatgatagattaattaggctcaaaagattcatctcgcggtttcctgatgagttataaaattagttatttttattcgtgcccgaaaactctttccgatatccggttaaacgtccgatgtgacatccaaaaattttcttttagccaactaaacaaggcctattcgttgttaacttgttattccctatgggcctcatttaccttctataaaaatgcaagaagaagtgaagagcagtgaccacctatcctacagtttcaccatggctctcctcattttcgtagcatcgcagcaagttcaaatcagatcgaatctttggatacgttctgccacgacgacaccatctcagctggccaaacgttggccaacgatgacaagcttgtctcaaaaaatgcaaggtacgcactcggcttcttcaacacaggtacaaaagcgtctggaaaaactaacaagtggtactaaagctgtgtttagttccaaagtttggatccaaagtttggatccaaactttagtcctttttcatcatatcaacctgtcatacacacacaacttttcagtcacatcatcttcaatttcaaccaaaatccaaacttcgcgctgaactaaacacagcctaaggaatatggttcaatcaggttgccaaaaaacttctgcatgggttgcaaatagggataagccgattgatgatcccgcatcattggagctaacaatcttccgtaatggaaatcttgccatcttaaaccgctcaaccagtgccgtcctttggactacccaagctaacatcaccacaaacaacaccattgttatgctcttaaatagtggaaatctcatcctaacaaacccctcaagctctttagaagtttttttggaagagctttaactaccccacagatacatttttccctggggcaaagcttggatggaacaagatcactggcctaaaccatcgtattatttttaagaaaaacttagtagacccagctatcggtatgtatcgtgaagagttagaccctactagtgttaatcaggccttgcttgcaccggtgaactccacgccatattgatctagtggagcatggaatggcgagtatttatcct

SEQ ID NO: 58279 - DNA, 2975 bp, Oryza sativa
gccgcaccgccgtcctcgtcgacgcctcccgctctgccgatgattacatcctcgccgatatcgtcaccaactccggcctgggcctccccgaagccaccatcttcgcatggtcatcgctgaccatgaagaagagcggcggcgagtgggtcaagtcctccattccccgcctccctctccctgcacatctatgtggtccaaaacacttgttccagatcgacctcgccttctccctggacagcggccgcatctgctgggttgatctcctacagggcatcttgttctgcgaccgcatcttggcaccggatggccccaagttggggttcattccgttgcccactgggtattgcatcgatgtccatcacaggctccgccatcagatgatgccactagcccggcgttccatggcctgcgtctctggcgccgtcaagtttgtcgccttggttggcttggaagatattcattgcccccccaatgaggtgatgctcaagacatgggttctgtcccctgatttcaaggagtggaaggaggatagcaggtccttatctgtggaagagatgtgggcaagtgagagcttcaagcaaatggggttgccatgtgttgtaccagtttcccctgtcctcagcctgacccaagatggggtatgtataccattctgaatgtcatcgagcaggtacctgcacaagttgatgaatttgggatcgtcgttgtcgatgatgacctggtgcccattgccaattatatgatccgcttcgacattcggcgaaacaaggtcctgtcctccacaaagatatctcaacatggtgaattgcagtggcttatacccaatctcattgccactgacttcactgcatacctacaggaccaccaggtacttagtttacttgctactgcatgctacttaccctcagcgccacccagtgtacttctagcttcatatcctaactgttttactgttctatacttgtttgttttagacgtaagtgatatgtggacgcttatatttgtcacatcaagttagtttcacttgcacaactaattaaaaaatattgacatcttaatttggccagccatttatgttgaggtattgaacacagtttagtgtgtcatatgtgtgccagcttccctcttccggtcttctcatcaggaaccaatgagcagtacaaggctcatgttgaactttgctagtagtaattttcaaattaagaatcggtatcagcctaagtctattcaatgatttagtagagtgtgcactatgcagaggctcaaatttaaactgaaattttaaaaaaatcagcaacttccgtagcattttgttgttatgtcgacaaaaagtacaatacccttattaattctcacatttgcatttatggcttactgttttgccacaatacttattttaatcgattttttcttactttatagccatacgctatgatgctttcaatgtactattcctatatgggacaagcttaagatatccagtttgcggaatgcttgctaagtttcacttcttcaatacaaacctgagtgaattgtctaattaattacttaattaatgattgtagaggttttgaaatcaatttccgaatgatttgttgacacatggttgatgttgtgttctctttagtgtagaattttttcatagttggtttcacttatccaatacaaacttccttctcttgtcttaaccactgaaaattacctggctcatgttgaactttgatagtagtaattttcaaattaagaattggtatgagctaagtttattcgaagaggcacaaatttatgcagagcctaagcttgggtattagtttgagagtctttttctccaatataaacctgagtgaattatattgcctaatgaatgaatatagggagttcttgaaaacaattaccgaatacattattggtacaagcctaagttgattctaaaagatgcagcatgctgaagtgcaacgtgaatcttaactgatgctggcaacagtagcaacctttgtacatttacctttaactacattgatgccatggccactaacctcattagctacatgccttgaagtactgctgagtgcacactttccctctttttaaatgttcaaagtttattgttcaagcttaatttggggcatatacaacaacgggatcagatttaaaccatactgttttgacagtcatctttatttttgttttggtagagagctgaagaagcaggcaaggtaggagcaagcgccaaggggaagcgcaagcagatggagtactactgaatgatatgtagtatatttctgctatttatcatgcacataacatatcgctttttttagcttacatcctgtgactgtgagatgtaaggtcaaatgtgtttaggttaaccatcagagcttattttgtcactaccagaccttattttaatgactaagcctagcagttaaactgaatggtaaccagtatgtatgtgtaatcatcgtggatttatgtcatactactaatagtgttgggctcttcaaatccaacattgtaccaactcctgagttgaagtttgtgcttgatttcatcatgctttcttggccttaggtttaggtgccggtggtgggaacacggccctgaagacccaggcagcaagaacagcgccaacaaaaggcatatccagtagacgtagaattgctcccatgtgttgtggcgattgttcacatatgcccagccaaacgcctgtggaattgtagataatatttaaccaagattagttaccagaaaacaaggaacagtagccaaaaagggcaaatgagaagagcggcaacttaacatcagatcctactggatgtataaatggaatacagtagcatgaattcaaattacaggaacaatttgcaatgcattctcaactctgcaaagatctcgatttcagaggtatacaaggaatttccactaaattacctaattgaagtggacaggagtgaccaaatagaaattaactgagt

SEQ ID NO: 58280 - DNA, 3764 bp, Oryza sativa
tgtgttgtggcgattgttcacatatgcccagccaaacgcctatggaaatgtagataatatttaaccaagattagttaccagaaaacaaggaacagtagccaaaaggggcaaatgagaagagccgcaacttacatcagatcttactgaatgtataaatggaatacagtagcatgaattcaaattacaggaacagtttgcgatgcattctaaactctgcaaagatgtcgatttcagaggtatacaaggaatttccactaaattacctaattgaagtggacaggagtgaccaaatagaaattaactgagttaccctctgcagaatataagtataaccaggcactgtttttccatagtttttccccataaacaacaagctaggttttgaaataatgagatcactggcaagggttttatgcttatcgtgtacactccaaccaaaactgtggacgtccaataataatactggctccttcctgatgaaggagatttaaggaaatagtggaactttatgaaaattacacctatttagttgcttcatttgacctgttgcttagtactttgaaacaagggcaaagaaaacataaataaaaagagcttagcctggcagcatgtttggtaaagcaccataaatagatgaacatgtaaaaggggatgggtaatgcatgatcaacatttttattgctcaggttttcagcccaaatgacttgggactccgtttcctactcatcaacaagctaccaaactatcgcgggtgctcctgaattaatcctagctccatgttgtcttgaaaaaccaattgcatagaactagtaagcatcatgccgaattaatcctagctccatgttgtcttgaaaaaccaattgcatagtagtagcatcttatcttgggcatttaactgtttgccactggagtttaattatttatcacttatatctcaatgacgcgtggacctttatacgtataagatatgtagatccaagtgacaaatagttaattgccacatgcaggagtggtaaacagctaaatatcttatcttaccaaacaaaattaaatatcttatccagtgacccagtgatctaaagaaataaacaatacaacagaaaaaaaaaactttttgagaaatcatattattttgaaacgtgaagccaataataatccacgacaaatcatctagctggtgactgagatgatctctgctacaaaggcaacctccatgtcggctccaggagattcagatgccacggacaaatgcatctgccatgcttgggaccgggactaattcagcctgtcaatcaatttggtcccggagaagcaaatgatcaagcttaagctggctaaatgctctcagatcagagctgtatctatggctatcaatgaagctcttcgactggtccagcttttcagaactgttcagacataacagatttagctttcactatttggattagatttcattcagaaaggtagtgattgggttatctgcacttgatctctgaacaatgcataatcagaactggaatctacagcgcgaaaaggccagtagcctagtggttacaagagtctaagtagtatcttaggtcctaagttcaactccctatgagagcgaattttccagaatttaacggctttgtgctttcagtggtaggcgatgtacccgtcgacagcgaggcgccacaaattcgtcaatctccaggatttgccaacctagtcttcgaagatgggcgccacgacttcgtcaatctccaagatttgccggcccagtcttaaagatgcgggttgggtttacgtgcgtgcatttataggggtgagtgtgtgtgcgttgtgagtgtaactcgtttgcatctaaattagcagaaactttaagcggtggtaaaagggttgaagaataattccagttcagctgtcacatgagtatgctaaaaatcctctaaaaaaaagagtatgctaaaaatgaatagataacttttatttttttaaaaaaaacaaacaaacaaagaacagagtacatgcaagtgtggttcagctcatcagtcaaagaacttatttgttatgtgtgtagttgttcaggagattgctgattcgttcaacaaaaaagtgctcatctctgaagactagattataactgatcaaatcaagtctacatgccgctgccaaatgattgagaattaacgtgcagagagaggccacttgcctgcttgcccacgagtaagcaaagccagcaagtttaaggtatccaaagcagcattagcagcagcagatgatgatgatgatgattcagagatccattgattacagccttctcacatgatcacatgagagaagctagatcacaacctgtgagcacacacttccagcagcacgccttcagaaacattacttaaatgctaatccaaattgcatcctcctcgctggtttgacgacacttcgtcaggattagccggccaaacgccaagattctcaaacctccattaaattagggccttcatacagaacgaccggattggagctttttggaacataagttgaatatatgatatggtatggtatctttacccaagacaagctagcatcgtggatgaaaacataatttgcagattttaaaaaccgcacgaatctttccacttttttttttcacgaaactcttacatataacttccagaaaagaaaatgaaatttgttaaatatgctttgtatttcaatccgtgcctctacttgctagatcaagctagcaactgatcatattggtgcattagttagttgatgaagaaaaaaatatacatagaaaaaagtagcagatagttggaaatgacatggatacttggatccaaagggtatcatgggtggcaccaccacaactctgatgcaaaacaatcaaaagtctaataacagaaagtggcccccatgtgacagcctgacagaccagtgaccagccactaaactaatcatgcacattatcctcctcaaagctcaaatcaatgcctccctagtgacagagatgcactgcatttcctacttgtttctttctaatcactggtgccacatgcattccagtcaactggcagtagtgcagtactaatgtactatcatggatcatggcaaagctagtgacatggtgcttcaatctagcttcccagcaagtatgcaagtcttttgtttagcttctaatagaagtggttgtgaacatgcatcatacatgtttatttcaataatggagtagtacttacatacttacaggctaacataatcaatcgattttttaaaatctcattatggttattacactcgtaggctgcagctggtctgaaaatttgaagagtgcactggccaagtgtccgtccgtgttgaaaagatttacaaaatacacatatgggcattatgataatctgtaaattacatagacaaattttcttagcaacacataatcattcgccattcggattctaggtattctagaagacaagcatagcactgacacttggtgtctctaggtaaatatcatcaagaataatctccagttattcttcgaaaaggaaaccaagctcagtgctagtgagagagattgagcaagtactgataccttgaactgtagagaatacaagaacacacaaactaattactgataaatttataatatccattcataccatccaccagttcaagagcaaacaagaccaatgaatgattgaaattacattcaggtcgtccaatcaaattaatgtgcatgctcttgggtttgtcagtgttccgaagctaattacctaaat

SEQ ID NO: 58281 - DNA, 6158 bp, Oryza sativa
tgtcaatgagagctggtatcgctgctgatacgtctgctgctttacttttccgaatactctcccaaccgacattactttttcctccactgagacatgccgaaggagttgaactccatcatgagccactaggtggctatgtatcatcgtacaaaaggcaggtatgcagtgtttcctgcacctacttgctacctattctgtatttgatgtattcaatttcctttttatcagttttctcgaaatatatgctaataggcttgtcactaaacggctacattatccagactctgttctgaatttttttttcattaagtactgttagctgccagattacatcatcatgactaaagtagtttagctacaatattgcaaagctagatttgtctagcctctattgttttgaatagaaaaggcaggtatgcagtgtttcctgcacctacttgctacctattctgtatttgatgtattcaatttcctttttatcagttttctcgaaatatatgctaataggcttgtcactaaacggctacattatccagactctgttctgaatttttttttcattaagtactgttagctgccagattacatcatcatgactaaagtagtttagctacaatattgcaaagctagatttgtctagcctctattgttttgaatagaaaattaaatcttttggtcatttttttgtaaccttttaggagtctctgtatgcttgtcgtcaacatgctatgataagtttatatcagttcttttggagctatgatgtattcttgtatattttatgactgctaggatattatgttaaaactgttttaaaggtatcatcaaacaagttaatatagatattgctacctaccaaagttggaatttgattatgtcgtaaaatatatgcaccctacatgttttagcttcatattgacttatattttcatatgtgctccttcaactgcacaaagctggaagttcctgcatctgaagccactattgatgccactgcgcaaggcattgcttccatgctatgtgctcatggtcccgatgttgagtggagaatatgtaccatctgggaggctgcgtatggtttgctacctctgagttcatcagcagttgatttgcctgaaattgttgtagctgctccacttcagccacctactttgtcatggagcctatacttgccattgttgaaagtatttgagtatttacctcgtgggagtccatctgaagcatgccttatgagaatttttgtggcaacagttgaagctatactgagaagaacttttccatcagaaacctctgaacaatccaggaaaccaagaagtcaatctaagaaccttgctgttgctgaactccgaacaatgatacattcactctttgtggagtcctgtgcttcaatggaccttgcgtccagattactatttgtagtattaactgtttgcgtcagtcatcaagctttgcctgggggaagtaaaaagccaactggtagtgataatcattcctctgaagaggtcacaaatgattcgagattaaccaatggaagaaacagatgtaagaagagacaaggaccagttgctacattcgactcatacgttttagcagccgtttgtgccttatcttgtgagctccagctgttcccttttatttccaagaatgggaaccattcaaatctgaaggactccataaagatagtcatacctggaaaaaccactggtatcagtaacgagctacacaatagcattagctcagcgattcttcatactcgtagaatacttggcatcttggaagctctgttctccttgaagccatcatctgttggtacttcatggagttatagttcaaatgagattgttgcagcagctatggttgctgctcatgtttctgagttatttcgtcgatccaggccatgcttaaatgcactgtctgcgctgaagcaatgcaagtgggatgctgagatttctaccagggcatcatccctttaccatttgattgacttgcatggtaaaacagtgacctccattgtgaacaaagctgagcctctagaagctcacctgacccttacaccagtaaaaaaggatgaacctcccattgaggaaaagaacattaactcatcagatggtggtgcattggaaaaaaaggatgcttcaagatcacacaggaaaaatggttttgcaagaccactcttgaaatgtgcagaagatgttatactaaatggtgatgtcgcaagtacttctgggaaagccattgcaagtttacaggtggaagcttctgatttggcaaacttcctcaccatggaccgaaatgggggttacagaggttctcaaactctcctaagatctgtactgtacacagaagcaagagctatgcttctctgtagctcattgctctggcagaagctcattgcatctgccgaaatgcagatgtctgcagaaagtacatcagctcatcagggttggagaaaggtatggtcattcctgcttataagataccagaatatgctatgaagaccgtccttggttgtcagcattcttatacacaatgataatctttgtttttcatgggtaggttgtggatgcgctttggacatgtttcagcctcaccgaccaaggcttcagctgctatcgttctgcaggtcaagatattgttattgttatatttacatacttgttatcatatttaaaagcttcatattgtatgtacctttgaaaaaaaaagttccatactgtagcttcttttgttctcatttcttggtttcaaagcatcagcatcattaccgatataaaatatacccatttcctcagtcatcttccccgactcttgtatctttcacaggccgagaaggacttgcagccctggattgctcgagatgatgagcaaggtcagaagatgtggagagtcaaccagcgaatagttaagctgatagcagagcttatgaggaaccacgatagcccagaagcattggtgatccttgctagtgcttcagatcttcttcttcgagcaactgatggaatgcttgttgatggtgaagcttgtactttaccacaattagaggtaacaccttcattcatgaggtccttaggtgcaaatcccagtgaagaataatcagttctactttgtatggttcatctcgcttactgaccggttcatctcgggatcaattacgagcagctattggaagtaaccgccagagcagtccatctcatcgtcgaatggggagattcaggtgtatccgtcgctgatggcctctccaatctgctgaaggcatgtcctcttctctgatctcactcacgttcatgccaaacttactcatcatcatccatgatccatcatcctgactgaatcttgatatgcagtgccgtctatcaaccaccatccgctgtctttcgcaccccagcgcgcatgtccgtgcactcagcatgtccgtccttcgcgacatcttgaacagcggacaaataaactccagtaagctcatccaaggggaacaccggaatggcatccagagcccaacctaccagtgcttggcagcaagcatcatcaactggcaagccgatgtggagagatgcatagagtgggaagcccacagccgccgcgccaccgggctgacgctcgccttcctcaccgcggcggcgaaggagctcggctgcccactcacttgctgacaaggccacaccatgactgtcactgcaagcagctgctgtaggatcagcgagtaggaaaggatgacttgccggccagtttcctgagatgtgatttaagactgatattagctgatgttcccaagcatgatacggggcttgctcccaagatgtgatttttactttacttttggttaatgtgctaccgctgacattagatgttcaagcatatgaaaactgcttgtgctgtaacttgtatgtctgtaacgtaaaaatctttccatatggtaaccggggaagcagaggtatatccttttctgctgttgtatctatttccagtttcctgctgaacttgcaaatgaatattcagcaatttccgttttgctcgtagttcgtgaacgttcagcggtggatcatctgtaactctcatttgtttatagttcgtcacgaaaatatggttccgactttctccttttttttttttttttgattacgagtgttttgcacttttgcaaaaagctccacgcgtttcgacggaatatcgcataggtcctcggaccgtctgacaccctgttatgttttttacgtataacccctcgtcctcaaaaaaatacaatgcgaagaagagaaaattccacttatagggtgttatgtttcttacgtataacccctcgtcctcaaaaaaatacaatgtgaagaagagaaaattccgcttatagggtagcgctgcaaattagaaacaatgaatataaacgatgcatttgattcggtaaattcgttaaattatgcaataacacagcagacagacccgagtaataattgacaagcgtgagatcatacgtgttccatttccaccaagcgctcggttttttgagaatttgatttgatggaaaacttactctagcagaaaagtatcaattatcaaaggacacagacttctctgtttacattatctattatacaagactttcttctaaccaatgtatggtctgaatatctgtaaggttacaacaccttttaactagaaatcattcacacaccaaaagagagtgcaaaaaaaaaaaagggtgaaacaatgctctcaggctctctgaaccaatacagctttaacagatatacatggaacacagcagtaaattcatcaacaactaatgcaccatcctcgtcctcctgatccttgttaaccagagcatggtttttgcaagcaacagaaaagaactaatattgcaagcacaattacgctgaagcaaaggttgcagcttcaatctttcaatcaacacgcgggacctgaaggggactttcttggttgtaatgtacaagatgtcagaaaaaagtgaagatgatatcgacatcttacaagctttgcattgcgatacccagatggagaggagcatatctatcggcaatcgatgggacttctccagcaattaaggtgatatcagatcttgaaggctccgggggaactaagcaaacaagctgcgggttttcatatggctcacatcctcaacaagcatcatgactcatccatggagggttcatacgagttgcagtgcatgaaattctgatgttggggaggatggttgctttgagctccaattccatctggtagggagttgatagtgccatacgctgaacaatgaatcggatgatgatttgagtgtaaattttgccgcaatgggttgggcggagcatttaacacgccggcagtttgtgtttggccagtttgcgctgtatgggagttaagtgcatccgttacattcccaaaagagaacgaattgctttgaatatttgcagaaggaaattgacatgctggctgtgcacttgtatgctgcaatgaccccggcacctcccctgctctgtgctcaatctcagtctgtgcgtagaagagaagcatcaggcaaggatttgagccgcatacacatactggaataacaacagagctaggggaaaaaaaggaaaaaggaaagaaaagggaacgctatggcctgcctattgtactgaatgaattctcaaaaggcaatgtggttttgatttcagcaccttcagtgcttcactaaacattttcatggctcttatgtacatacatctgacgtaatacttaactagtacaattgtttcatagtataatctccagaccctggctatacaaattgtagatgtgctcgaaactgaatcattattacacattcataaagattatactcatcagacaattcacagttgtagtagagtcacatttgatcctattggttagccagcaatgtgtgacatgatccacatgcaaaaatcattctataaattgaacactagtaagtcaccctgactctcaatctttgcatatgacacaaggcattggctagcataaatgtcaaacagggattaaactaaagaaaaagataaagacaaactgacctgcaggaaagcaactagatcggcaacagacacctccaaaccttcttgatgcttgctgcaaatccatcgatagacattctcctgccaaaattcagaaacaggattgaatcaatttgataa

SEQ ID NO: 58282 - DNA, 2227 bp, Oryza sativa
aggtgttaactcttccccttggttaaaaaaaaaagatttagctcttccattaccaaaaaagttgtctgtcttgtgattttgggcagactgctaaaaaggtcctgtcctcgtgaggtgatgctataaccgtgctctttgcagacaattaatggaactatggaggtgtggggcaaactaatgttggttttacaattttgcaggagtaggattacaaaattgcacaccagatagttttgctgctgaatatcagaaaaccatgaaacctcttcagcagcgctgtaaaccaactgatacaggaacggcggcaaaacttggtggcagtacgatgcaaagcctgaaacctggaaaatatatcaacaaatcatcaggtaatgtgttggaatcttgttcccaatttcctttactgtatggtgtacctgctgcacttatcaaacaaaattaaaatttgaagtagaaaataaatgtctgttgctacaattgaatcaagacagttccatgatgtcgttaggtgcccatccatatgccattgtttttttcgggaatacgcaaggagcgcattttttccattaagagaaataaaagttatttatggagtaaagtacatatgccattgtgtaaagtacatctacgagtaaaactggtctcaaactcaacatgtgctttacttttcaggcaatgctagcacaaaatacagaagagctggtgcctcatcacctcaattgtatactgaaaaacaaagtgcaccaaaggatggtagctttatggaagcactgttccatgattctaagaatgtgtctgctcgaccaccctgccattctggaaagatcgcacttcaactgttcccaatagatgaggagtttcagaagtccctgcagcaggtgattacttcagcttttgcaagatttctatgtgtgattattgtatacgacctcgttcagattccataatgtgtggcttgctctgtataattaacagaaaaaccacaatccttacctggaattgactgtggctcctcgaaagaaaatatcctcagttctgcagcatctcaacacaaaatggggcaattctcagtgtgcaagaggtgaactcatgctcttccctgacggtactaggcttgataacataaatggcagtgagagatggactcgtagtgattcttgcacagcagctgatgtgcatgttgctgttggcagcccttcgacatttcgcttaaggttcgctttcttctccagacctggtttactttacttttgtttgcatccatgcatatattgagcacaaaacttatggctgaatatcacatcttttttcttagatatggttggtttccacccaattttggggaacaaaacagtggagtatctttaggattagtgcactctgcaggcaatataatcgacaacgagcctttagatcctgttgtcagggaacagaaacagatgactgctttgagtgaattcccgagtaactttgctgcaccgtccactgaggccaacacagtaaagactatggtaagttcaaacgttatagttttctttcaatatcatcaattatattttgacttgacctaacactgattacatgttttcagaaacaggataatcaaagcaaagagacaccactttcatggattgactgcatatctaatataagttttggagcactattagctgaagctgcgccttctcaagacagcaagcagttacttccacaaaacaactcaagtctccaacagatacctcttaccgctgattcatttgatgctgctattgcttccctgattgctcggcaacaagcaagtagccagccgaaggtgtcaactccatccctttgggatgcagaagaaacgtgccatgcatttccttcccagaatcgaatttcacgcaggacacctggtacaactcctagcagttgtggtgctagtaccttgtctgtcctaggcacaattctggaatctggtacagacggtgagaaggtacctctattagccaccattcacttgctcttctaataccttttttcttgccaaggacactatgcatttgcttatcggcttgtctctgcagcaatgttctactgaagatagaagagaggaaccgaaccctcaggcatcactcttggccaatgatgacaataatgtgaagccagacatcccagtgtactcaccagagcctctaataaacattgatatgttctatttgattcttaaagagctgatctgattctt

SEQ ID NO: 58283 - DNA, 1486 bp, Oryza sativa
ttggtgccaccagtttagcagtttagcctgtcctgtttgataaaaggaattcttctgactaagaagtctgaacaaccatgaactttcctctccttcttgtttttttttgggttcttctcttgtgaatccatgagtttataggattcttgaaatttcaggtcaaagaagtttgaaaggcttttgtgcagatccatggacctggttcgctttgtttgaccatctgattctttcatttattggatatgcatgcagagacagaatcaatttcaaagagagtgatgcaatgtacgcagcaacttgcctggagatctgcatgcaacatgctgatatcaatagtcaaattcggtgttctgaacaactatggctaattaatactgttactctatcttgtgcagctgctgcctgctggtgcccttcacatattcacacatggcctgaatctgattcatctcatcaaactcccctgaagatgatggaattgaattgatccaaatcaagcaatatcacaaaatcagtaagcaaatcttgacagatttacagagtttctgaacagaataatttcacaaaaaagttacattctgtaataataaaaatgttcattttatgcataattagtacatgtatggctccagctacatgaatagctccggctaaactgccaaatggtagggttaaccgaaggggttatagtatgccatttggcaagagaaagattagccagagaattaagaactgccgccgcatataaacaaacatatatattaatgaatgaggctttggttttatgatcaacagcacttttggtaggattggtgctagccagtagcaatcatgatcaatgtcttgattccagagtaatggatctcgattagcaatgataaacatcaagacaaaccgccaattgtgcctaagcatgcgccaaaatgtgctttttgttgtttaacagaaaagattaaagaatactggaatgataggaatgagcactcctaataaacttatttcaagcaaagcttactaatttgacccattgatccatctcgacactcaaatttaagcatatggcatctttactcaatgcgagatgaggtctcctttggaatatatgaatatatgaatttacatcggctcgatattattcgcactatacaactaaagcctaatatttttcttgtgaaaatatgcgataatgcatttttttcacctttaacactaaattgaaaagcttttttttgttcccacagtttttttagatggttttgatcctacagttggtggcacttccacatcgactacgtagggtcttcgacattatgtcaacttccaacatatgggctgtggtcccaattaaatcaacccaaaagtatttccttttttttttcttcaaatccttcatagtttaatcttggattctgtttgattataaatgtctccaaaaccttcaacaataggtgataagtctctctataaagttttttaaaattcttct

SEQ ID NO: 58284 - DNA, 906 bp, Oryza sativa
ctggtgtgttatgccggcgcccatgtttttctctctttgtttggactgttattgaagttgacctcgttggagacaaacattttttgttccatcgacagtggacagttcacttcaaggagtatattttggaggtaatagttcttctgctgctgctgctgctgccagccagatgtcgaaccaaattttgattgaattcaatcaaatctactatttcagatttgaatttctcaaaaaccatttgaactcctccttgatgttgaccaattttgagctggctcgaaatcaaaaaaccagttcacaaatctcaatgggttttccacgaaactgcatatcctggctagatactctcttgcagtatgtgatcttacaattttaagtgattgcagattttaggaaccaatttatgtaatgataatgcgtttttttatttatttcagtaactaaacaaagcgaagaatcataggatcacaggggatgcaagtagtacccctccgtctcatagattgagtttttttttttctgggacgaagaaaataacatttaaacttccttcttcctaataaaaccaacccagtatctgatgctgatatactataataatacgaatctagacagttttttattcaggttagtcttagcacgaaaaaaccggtgtgatgccaatatcgcagggtagaagtagtagggtgaaggagatacagtaatctcacagggaccaacatgacaagttgagagagctggtgggccccaccacgcccatgctacccatccggggctaggcatatccatccatccatccatgcatgcgctgacaggtggggccgtcccctcccctctcggttgggtctccccgcttgcttaaattattcgtgcgcgccccgggtcgacacgcggacgcgggcttgt

SEQ ID NO: 58285 - DNA, 1168 bp, Oryza sativa
cgggtgggaaatagcgcgggcactaccaccaccaccaccaccatccccggaaaaaatctttttctcgcctctccttcctccgagccgtttctctccctctctctctcctcctccttcccctgcgcctcctccaccgcccgtgtcgccgccgcgcgcgtctatcccctcgccgccgccgccgtctacgccgcgtgaggtccggattggttgaaaggctgatcgaggtaatgcttttttatttttcccgtgcggttttagtttttctgtgctgtgcttggtggttttttctttaaaactatttttaggctggttttgatgatggcctttctaaggttgtcgtgtatggggggcgaggtggttcgggtggatttgtggtgttatgttgaggggatttttgtttggggggagagagttttggtggtagatgcggttgggattttgaagacgtgaaagggaaattagttttgaaatttgacggcgaggttgagctgattagtattgtaataattcgtggcatcggatagatcaacgcgagatggatgcttattactgcgaatttcaggaggtttttgtggtttttttaggcgagtagcgttgattctagctggattttgctgcttcgtggaggcgtttagatgtggtgcatacggctgtggatgtaatttgtgcggggataattactgaaaattaattcgcagtaagctagctctgctttaatattttttcccctgaaacagtaacaagggatcccttcctcatttcgttaacagtggaagtgaatacagacaccaaccgatgagcagagacacctgtaattaaacaccaaaagaagaacctgttttgttcctatatattttccatttctatgctttaggtaatatactttctggttcggtgtcatagtacccgaaatagaatctttgcttgccaaaaaaagaaagaataacaagatagaacaacatcattaaattctgtcttagacaatacatttataatcgaccaacaaaaacagaccgatgagtgacgtggaataacaaatgaagtataaatgtcacgaaaaacacatctattgattttgtgtgataagccataggagcctacgaggaaccaagtgaatggttctgtacaccacatccattagcattaccataaatttggggctgcagga

SEQ ID NO: 58286 - DNA, 1283 bp, Oryza sativa
aaagatatcttgatatctttaggccctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaagtatttttgtctataataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgatgcgtcatatataagtagcatatgaaagatagtaaattaaattgtgaaaaactctaatatatgaatgatagttttaaaaatatattaaatttaatacttttaaaaattctccagtcaattataatttgcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctctttgtgatcgctgcgtgagtaaggggtgtcttcatttgataggaggatgctagggtcaatcgtcaccgtgaaagggggttgcccatccaactgatcgtatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaagga

SEQ ID NO: 58287 - DNA, 754 bp, Oryza sativa
tcgatggatatatgaccagctagctgatcatcagcttgtggatcggagtcggagaaggcgaaggacgacgacgacgacgacgacgggagagctaggtagaggaagcaagctaccagatgaaggtcatctcggcggaggcgcgggcggcgtcgtcgtcgtcgcgggagggggagtggacgtggcggccctcgtaggtggtgatcaccatgcgggggtcctccgccagccgctccacccgcttcttcacccggcagttgtcctgcgtgcaccggtaatagctcctgcatatatatatatatatatatgcaaatatatatccacaatcacacacacagttaaccacatatatacttcagtacgtgtgtgtgtatatgcgtaggagtgtgtaaatttgctttaaggttatcacttatcaacaagaaaatcgattttgattaatcttgccttttcttgcaacacaacgcacagatcaaaatatagtatagtaatacggagtagtattgaattagggactaactaatacgcgtcgctagtagcctagctagtaaatacatgttcggatgacatccaaacaactttttagtacggagtataacatactccaagtagttctgtttagcgttatggcaacggatgcttttgctagctagtagatctacgcacgtcctaaagcttagatatacctttctacccggtactgctcgtgctactctattctacctacactctacaaatatggagtatagtttttatg

SEQ ID NO: 58288 - DNA, 1185 bp, Oryza sativa
gtgttgctcttatcttaaaaaagatggggaggagaaaagtgcagctttggactgttcagagtcttcagagtgatagtgctgttgtttagtgctttgcaccaagcttccatcaaatcttgtctccaatcacaacaatggcttacctacaattgctcaaagtggcaccttttctttttggattttgggatccattcaactgacagtaccaaagttgggttttgtcccaaaatcttcttggcagtaaaaaaaaggttcaatttctagaagggaaaagaagctactagtacaaactctgtgttgtctggccaatgaaaatgtggaatccaaacaaatcaacattttgtactccaaaaaataacattaggaaactgaattaaaaaattatttttgagaaaatgttacattccaccattgctcttttttttaaagaaaaacttccattgcagaattggcgtttttttcaagctcaaggctcttttgaaacgcatggattttacagaatagaatataaatccttcaaaatgttgtgaggtctttatcttgtttggtttttattagtttgtatctgattttggttttgttactttggttacatactcactgtgcgagtttatttttgtgtgaaccttataataattggttgtaactcattgagtaaagacccgaatgttttattccatgattaaaaaattaatccttcaaaaatccctcaatttcaaaggaggtctcaaacaaaaataaggagaaaaaaaaagttgtacagagttgctcatcacaccctaaccatttgtaaaaatgcccagatgagaatgtggagggcggcgcgccgtacaggctgcggcggcgaaactcggagacgctgcgcgcgcagtacatcaacaccaaggagctcaagctctgcgtcggcacctggaacgccgccggcaaggtcccccccggcgacctcgacatcgccgactggctcggcgccggcgccggcgagcccgccgacgtctacgtgctcgggttccaagaagtggtgccgctgaacgccggcaacgtgttcggcgcggaggacgcccggccggcgcaggcgtgggaggagctcatccgcagcgcgctgcggcgggcgcggccgccggcgagtagtcggccccggtacaagtgctacagccaccctccctcgccgtcgcgcggggacgcgac

SEQ ID NO: 58289 - DNA, 764 bp, Oryza sativa
ttcctgcagcccaggaatgaatttttttttggacggagggagtagtaaggggtgtgtttggttgggaggttttgggtgaacgggagatggcggcccattttttttttgcctgtttggttggtgggcggaagtgggattgggcggcccaaagaggaatatacctcgcagatgccggatgcaaccgcccgagcggccgggcgagcagggcgagcgcccgaggtcgggtcgcttcaccgcgcatcagcgacagccacaggtcaagaggcgagagcgcggcgacggaaggcgaggtcggcggcggcggctgcagcggcggaaggcggggatgagcgaggtcggcggcggcgcgagatgcgggcggaggcggcggaaggcgaggttgcagcggcggcggggagggccgaggtcggcggcggttgcggcggcggaaggcgaggtcggcggcggctgccgcggggaggggcgaggtcaacggcggcgcgagatgcgggcgaaggcggcggaaggggaggttgcagcggcggtggggagggtcgaggtcggcggcggctgcagcggcggggatgggcgaggtcggcggcggcgtgagatgcgggcggaggcggcggaaggcgaggttgcggcggcggcggggagggtcgaggtcggcggcagcgggggggagggatgaggttggcggcggcggcgaggaggggcgaggtctgcaacgtcggagaggcagagcacggcggcggatgcgaggcattttttttctttttcttttt

SEQ ID NO: 58290 - DNA, 1493 bp, Oryza sativa
aatatatttatttaactagaacaaatgtccgtgcgttacaacaggtgaagtctattttaatcttattactgttatgttatatggtttagttaagatgaaatttactgtgggagttcgtttggatatatatttttaaaaaaaatcatgagctgcagttaagtccgattatcttaagttagcatgtgagtttttttaaatagacttcttgtatgatttcttatgtattaccaaaagtgaacgatattaaaaaccgattcaaatacggatatatatttccaaaaacaaacgaacttaaaaaccgactcatacatgtatgacgtaccaaaataacggcaaaaacatcttaaatttttataatagtagagttaggatcggagtgtatatttttggacagtgaaatcttcccaaacaatcgatatagcacaataatacacaacaaaccagacgactgttttgacattaattaactactcctaattaatgtaattttatgcaagttaatcatgaataatttcattgtttgatctgatctgcgctcgttaattgttttgcagcaaatcaatttatgttattaatccttgtctttccattgcagcaaaaaaacattctccttacatattttggttccatcttttttttatcactttcctggtcttgctttaatattttattgagggattcataaacaacacatgtattttacagcatggatatagctactagctccttcctcaaaacatatgcgcattagctgcaatatgcaatgcatatatataaattattatggacttggttaggttgctagacaaaaaaagcaatatatacgtgaataaatgttatcatcattcggaatcatgttaatttgtacatacgtgcaagtttgaatttggtgataagacataaagatacgatacatagggcctgttttaaatccactggcaaaatttttcatactgtcccatcaaatgtttgaacacatgcatagagtattaaatatgaacgaaaaaataagtaagtacatagtttgcgtgtaaattgtgagacgaatcttttaagcctaattgcttcatgatttgacaatgtggtgctgagtaaacatctgctaatgatggattaattaggcttaataaatttgtctcgcggtttacaagcggaatctgtaacttgttttattatcgtctacgtttaatacttcaaatgtgtatccgtatatccgatgtgacacggcaaaacttttcacccatggatctaaacacggccatattatatatgggttctgagctctgaaacagttcatgcatgttagtaattcaccctcaagtacagctagaagtagagaatgacgaccttaattcacttgtctaatacctcgaacaatgatggaaggagaattcttggctttaattagttccactccattatttttcccttaaagtatcacacatgataaaaaaaatgaattcaaatttaatttcacagggaactatcagaaa

SEQ ID NO: 58291 - DNA, 879 bp, Oryza sativa
attcctgcagccccgacctgaagaaagattacattgctcatattgcagtcatagtttgcacctcagattagagtacttctacaaataaatccccattactgaacctggtcttttcgtgagagtatcccatatggtaggtccacgttggccctcattcacggcaccttcatactggtaatatattgaccagaaatatccatcagacatccatctaaaagaactcaagtgaaattagagatcttttggtaacactagacctggtaagctgaagaagctgtgccaaagataaaaccgggagggaagtctgctctgcttatagcttcaacacaggcagaaaagctgacaaggatatgaacaagtgttaagagactcatggccttcccttcagtaggtagcactaactactaatgtccacagtctatagataagtagcagacaggattgtaagatatatataaaccttgttgagttggtggggtgtgggaagcaactgaaggctgatcatcacttgtcttggaatccaacgcgcgtctctgctaagtagctcttgtggaggtgacaggttgcaatatctctatcacactggacattttatcaaaaagggaaggaaactttgacatgtccaactctgaaagtgtcacgggtgtagcaaactaaagctttacttgagtgcaacaattccaggcgcattaaggatttcccaggattccagcatttaagaataaaaattgtgtaactgagccagtctttaggaagctacaccagtttgagaggagtgcaagcaacatggaagaaaggctgtgttaatatcacgataacacatttccttcctaaaataccatcctgcagtattgaccccccttttttttctcttatgca

SEQ ID NO: 58292 - DNA, 3622 bp, Oryza sativa
aatttatcctgagattatagcacagtcacacacttatcccattggaaagaaaacggtttgcttgcacggcagagcctttcaagaattgaatagctccagtgatagccacacgaaagggacaggagcgatttgctgatggtgaccagtggaacaggcaagaatgtagtgcacgtgttatccatgaaatccctcacatgtacacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccgcccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgtcatgtagaaaagcgctcgccattatcctgtccgcgagcacacgaaggcgttcgttatcctctgctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttgttctatcttttgtatattctttttggcgttccttagctcttctagatagtctactgcacttcgtcctcagaatgagactcactcacgactaattacttacctggaaagtggtgatgagagaaaataaggccgaataattgctcttgaatggagtgactgagctatatatggcacttatatgatgaactgtactaaaatctgcacttatatgaagaaactcgtactaaaagatcatatgattatcctagatattcttgcctaagaaacatcgtgagcatgattcatgtcatatctcaaaagcagctgattattacattttatgtcattttcataagaaactctgacaagatatgcataaatttttatatgcaggttaaatttatgatcaagacatgcccaattcaaatgagggtaagtttcaattcttttttggtctgcagcttgctatttactcaaatgtctgaaatttccctttttccaatgcagcttaagcgatgggagaggaagaagtgtaaaccaaacagtcttcctgtcctgcacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatggtcagcattgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaaga

SEQ ID NO: 58293 - DNA, 10724 bp, Oryza sativa
ctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaacaagcttagcaattttttttttgaaacaacccgcagcgatgtttctattgatatagtaggaaaaaaatacaaatatatagtgctaaaagatagcgatgtttctattgatatagtaggaaaaaaaatacaaatatatagtgctaaaagattatagtcagaaaaaggaaaaaacaaatctgatttgccattgataacatgaaagctcaagagctcgtgctgacggctgagaatcaacatagcagatatggcacgcaaatatcaaatccaggtgatcgtaagcaaaccacagttttctgcttgcgttttgctccgcgagggaaacctgacacctgtccagatcccatgagacgaagatgcaacccatcaaggtcacgaaaacaacgggaagtcggcaacctgtgctgcacagtgcacacagcctttgacagcacgtgcgcagcgcgcgagccagatctagctggtagtacagatgggcagcatcggcggcggcggctcgccggaggagcgcgcggcggccggtgggccggtgtgcgtgacggggtcgaccggctacgtcggctcgtggctcgtccgcgccctgctccgccgcggctaccgcgtccacgccaccgcccgcgacccaggtacgccgtacgcgcgagctcgctcgctagcatcgatgaagctcgtggcgtggtgaaactgacgatcatggcggccggcggccggggtttggtggcagacaaggcgtggcgggtgttctccgccgtggaggaggggaaggaccagctgcgggtgttccgggcggacatggccggcgaggggagcttcgacgccgccgcgaccggctgcgtggcgttcttccatgtcgccgcctccatggacatccacgtcccaccccagaatggcaacgacaacaacatcggtaatttacgaagtttaatctccgccaaatcaagattacttccatcaatcgctactaaccgcatgcacatttggattagaccgtaattaattagttttcgtgttcttgatggattcttgaagaggagcacgtgaggacgcgggtgctggagccggcgacgaggggaaccatcaacgtgcttcaatcctgcgtccgcgcggggacagtgcgcagggtcgtcttcacgtcgtccatcagcacgatgacggcggcgacgacgacggcggcgaccgggcggcgcaaggccgtcgtcgacgagtcctgcctccgcgccgccgccgacgtctggaacaccaagcccatcggctgggtgcgtatacataggcgcgcgcacacacacacacacacctgctacactccatgaatcctctgaaaaacttagtgttccatggatcaatgaacattttgcaggtttacatcctgtcgaagctgatgacggaggaggcggcattcgggttcgcgagggagaatggcatcaatctggcgtcgctcgtgctgccgacggtggccggcccgttcttgacgccgaatgtgcctaccagcatccagctcctcctctcaccaattacaggcaaacaaattctccatcacacaagtacataatcatgtacagattgtactaatcttgcaatgatcaacagcattgttctgaaaatcaatttgtgtgttcatctccatatgcaggtgatccgaagctgtattctctgctggcatctgtgcactccaggttcgggtgtgtgccattggcacacatccaggacgtgtgcgacgctcacgtgttcttgatggagacggagcaagcggatggacggtatctgtgcgccggagggagctatccgatggcccagattgctcagattctgtccttgcactaccctcctttcaaacctgcaaaaaggcaagcagctgtcaaccagccacatccatgtctttcagatcatagtagtagtatttttttagggtcaagttgatcttgtgcttttctggtgtttgattaggactacgttgatctggtgtgttttggcatgaagctgcaggttaagcaaagatttccatggctcaaacccgtcggtggtatcgtccaagcggctgagggatttggggttcaggttcgagtatgatgttgaggaaatcatcaagaacagcgtcgtacagtgcgttgatcatggattcctgcaggatcccgacagttccaactgttagtggtagtagagtagtgagtagtgacgctcagtgagacagtgactgagccaagttgctgtctggttgggcctgaaaggctttctttcttgtactactagtagttagtacttgtaattcagtaatgtattgtattgacaagagatcaaggcggtatgaaatcagtttcagaaccacacacacacacacacacacacacacacacattttcagtattatccatgcagctcaacattcaccactatctcgaattgatgccatattcctaagcaccacaacatcatgcaaacatccactgataaacacacgcatttgcaaatctaaaaaaaaaaactgctaaaatcatgtgctttttttttctgaagaagaaacaacagcaaaatgtacatactaacaaatcgccagcatctaacagaacagaacaatacctgggatcagatcaccactctaaacaatgattcgattcctcaattcttaaaagcagttttgcagaaggaatcatcaaggtttacagatgacgacgaagcaagggaggagagctctcgggttgagcaggtagagctcctcgatgctggcgtaggcgcccaccttgccggcgacggagtcgaaccccggctgcgccgccacttcctggagattctccagcggccggtggatcctcccggcgaccaccctgcacaccagcagcgccttcctcacgcccgcgttcgccgcctcgtcgccgtctccgtctccggcgatgcattccagcgcgcgcttgctggtggaggtggtgaacacgccgacgccgtccttgatctctctggtcgccgagaagccgtggcggatgatgcggcagacgctgcagctgcccgacgtgcagagggtggaggagtcgccagcgccgagggagcaggcgagcgtcgtggcgtggaaccggaggagctcgttgccgtcggcgaggcagcgcgggtgcttcttggacagcctcgccgccttccccttcaccgcctccctgaactcctcgaaccgcgccaccgacctctccgcgttgtgcaccttcaccacccgctcgatgcggcccagcgcgttctccgtcttcgcccacccggccttgcagatgatctccaccaccttcctcgacgagtcgccttccaccagctcggtcactgcaagaacgcgcgccatggatgatgaaacagagaggcagagcaaagcttgccttgagagttcgtccatggtgtttggtgctccgcttaccggcgtgtctggagtggtggtgcgactccagggcgtcgtggttggcgaagcggtcgccgcagcggtggcaccggatgccgacctcgcaggaggccctggcgggagcgggcgacggcgcctcggcgttgtcgtcgtcgtcatcggcgcggcggagcggcgacatggcggacggggacttcctcgtcgagacaggggtggtgctgcaccgcagcaggagcgggctgtgcgggaacggcaccccgccgccggcgccggcccacgcgccgcggccgggggtgctgatccggagctcgcacttcgcgtccgacctggcggcgagcagcacgtcgtgggtcaccgggttcagcacgtcgttgctccctatcgacctcgggctaccgcatcccccatcgccttcgccggcggcggcggcggcgacggcgtcctcctgcctccggctgccaccgtactggctgtggaacacgtccctcaggttggcgatggaccgcgagcaccccgacctgcgcagcgccgccgccgacgtcgacgacgacttcttgccggctgtgacgccgccctgagattcctcccgctcgatcacgccgcaagaatcccccgatttgcagttgagcgacttcttgagcgccgcccacaccgtcggcatctcccccttctccggcgactccccttcctcgccggacaatccgattgctgccaatcaaaccactccatttttaacaagacacgcaacacacattccatgattccatctagagaaaaaggatccaaaactaaagcagatagtactaatcactgtatattcaagaaagaaattatctacaagatgaacagggggaagaacctgaatactgcaatgactgtgcactgctaactgtaagtctgtaactgctaatgtcattcattcctcatcattgccttcttcttcttctaccttcagctggccagagagtattactgtctccatggatgcaaagttcaaactgaacgggtctcattggcacatgcagctagctagaggccggcattatcttggagtaaactggtaggtaaaaacaattgggactggctggcctctgaaattgctctttggtcttatgcatggactatgccagtgacatgggctcactcttcagtcttgagacgttttgctacttccaaggggaccagaaacggacgaacggatcgtaaatgggtctgcggcttaggagaatctttggcactgcgtacaatgcacactctggtctaatctttgaacaaaatacagtaataatactgggctatggggattaaaaaaagtttgagctgatcggtaacagttcagttcgtgccaatgggctaagctatggcctgattgatcgacaaccggcactgaaatgcggcagggttttgttcatttgtcaccgcataatggcatgatccaaccacgcatggccgttagcaagtcctaggataccgttcagtaagcggtgatgcaacgtgggtgctcagttggcacggcatgagctgatcagattggccattttggctccaggattcatagtcaaaagaaattacatgtcctgcttaaacatatagtaataaatgcaaaagaaaccttgaaaatctaccaaaactcaatgagctaaacagtgtgaaacaaattaattttagagtgaagtgcttgccggtctctagtccacttgtgtcctctaaattcccgaactttcaaaatacattttcaagtctccaatttatcaaagtttatcattttggtcctaaattgacacgagcctattggattctacgtggtgattatctggcatgccacatgaacactaaagtgacatgtcagatagatattctagtcttttttttcttcttcttctttttccttcccttcttcgtttcccttctgtcgttttttccccacatgaatgggaaggaagacaagaaaagaaaaagagaaagaaaatgagtcaataccggcatgccacgtgagcgtcacgtaggatcccagaggagttgtggcgatttaggcactttgataagtttggagacatgaaaatatgttttgagagttcaagtacttgaatgacacaagcaaacaactttagggaccgaaacaatacactttactcttaaatttaggctatgtgcgacaaatgggttataagatgtgtgattggaaaaggaaaatgaatgaatgtctaggattaaatgaggtgtgaataataaatagctaagatacaataatgtcctttgaataatgttccatttgtcaaatgaatccttaaggcatgcatgttgaccagatgatcaccgaagcattaaatttgacaaaaaaaatctctggaaaaaaaggcgtatcaaacaaggactattttaccatcattcgaaggtggtgtcaaattatagccagccaatacatgaacaagttagaaaactgtcaaaacccaattcatcaatagttgagatttggtggtggtatattttttttccttttttttgattatgaccttttagggttgtaatcttgtaattttttttctctatcaatggaactttgcacggttgttaaaaaaaaaacagttgggacttttcaagaaaaaaaaaacggccggagcactgtcaaacgaactcactaataggcctcgaaatctgattgggcttttcacgaacaaaggcccataaaatgtagcccatttaggcccaaactgtacatcacccgtgattaaacggcccagcccaaacatcataacactggatagggtgcagacaagggtcccacccgtcagatcccaacacgtcatcattgccgatccgcttccagaagcagcggcaagtttccatctccttcttccccttggctttttatcgctcgatcaggtggcagcgacaacgagagggagagcgagagctaagttcgccggagaagatggcgatgcggcggtggagagaggatgcggtggcgctgtcgctgcgcgggtgcggattcggcgacggggacgacgaccggccggagaagccgcggcggtacggggtgacggagatgaggagccccttctacgccttccgccccgcccaccacgcgctccaggttctcggagagccccccgcctaatccatccccatttttgtttcatgcttctacgaatcgctgctgggttgtggaatttggtgtagttttaacttttaatcgcgttctgattcccaccgaatcgtgtttgaaatgaagccctatctgctgcataattcttcgtgacttgattgtttatttgttaattcctaaacagggccaccatattggaatcttcagtctgtgcgatcaacgatcagtgtcagtttgtagatcaagtggtacatttgtggatgtcagaatgcgtagcagctacagctagttttatcagttagattcttaaccaagctgttccctcttatgtcgacatagcatggtcccgtgattatatgaagtgcttaatgccatttgagaatttgagaattgaggatgcttacttgcaatgcaaatgaactttctggctactttattgctgcattgaagctgtgactaggaagattttatattactgtttcctttcaaatgaagaaaattctagaatctagataggagtacatcacttgaaaacagaatgaacctcctggttagggatttcaaggaataaaacagctcgttctcaaggctgtcatttcctgttctatttcaggaaatattggattctctaggtccttttgttgatggtttgaagtttactggtggatctcatagtttgatgggaaaagaactggttagagagattactgatttagcacacaagcatgacatatatgtgagtacaggagattgggcagagcatcttctgcgtcaaggaccttcttttttcaagcaatatgtcgaggtatgcaggcattttgtttgttttgaggtacattggtagtggtacactgtgatacacacttgtctctgaaaattctgaaaccacatgcatgacattagatgttccgtttcaggagtgcaaggcattaggatttgacaccatcgagctgaatgctggatctctcaagctcccggaagaagctctcctgagattagtccgcctcatcaagactagtggtttgcaagcaaagcccctgttttcagtgaagtttgacagttctgatattcctccatctggagatagggcatttggggcatacatagttccagtgaagcagaattcaggtaactataataagcaatcgctttctaatgcccttgtttagctacttctctgcgtactaagcaatgtaagtacaaacgcaagaaaacagcattaagggaaaagttgctcaacatacatttgtcaacatcagtttttccttggggaatttagttacaaagcaatttaatactatcaccgtatgtttatttggctatgctgttggctctgtgattgtactgtctacattttcctatgatgccttcctcactttgatgtggtgcagaaagagtcgaggatgttgacctgttgataaggagggccgagaggtgcttggaagcaggggcagacatgatcatgatcgatgccgacgacatttgccagcgcgctgactctctacgggcagacatcgtcgccaagattgtaggccggctcgggctcgagaagaccatgttcgaggcttccaaccccaacacctccgagtggttcgtcagaagatacgggccacgggtaaacgaatcttcaattcttccctgagaccctgaagctgtgcacaatgctatgcttattacaatgctatgctgacagaccattttgcaagcaagaagcttagactcgttcatgaggcatttccaggtgtatctaacgtgttgcgttgtgaatgtaggtgaatctgttcgtggatcactccgacgtgatgaacctggagcgtctccgaggcttcaacatgcgtggagtctgcaactctcccttattcggaatcggctcgcccttcttcctgatgtgacgacctccctgaatcctcctgatgtatacgaccttcctgaatcgtgccagtcctatctcgcatggaatgctgtgttcgtggtgttgagatgccttcctgcaataactggatctggatgatgtgtagtatgaaaaaaatgtactcctgtctgctagcagtatcagctcatgtatcgtatgtactcttcattctctactcctgcccggaaacttattactccttgtcacagtttatagggtgttcttttacaagaaaaaaataactcggtaaatgtttgactaataacaattgcccctaatcgtcgtattaacagtgctaaatattatacacgttatcttactagattcatattttgaagcattcatcgggaatatagcatagaataaattaatggttcaagtatgcaattgaagattgtgtaaaaaaaaaaagaccacctataatttggtacggaaggaatattatcattggtttgggcttgtttggttgggccgctaatggtgcgcagagaacatgggcctgatttgccgggccacatgggccggactttgctatgaggcccatttcgtcgtcgtcgtcgtcgtcgtcccgtctcccgaactcgccgtgcggcactcgtgctttgctcttctcgtctccccactggccgccgccacgtctcgtctcctcctcctcctcgccgccgccgccgccgccgcgggagaagggttgggttggtgaaagagagatgagggagatgatgggtcctccccgccgcggcccggcgtacaagacgaagctgtgcgcgctgtggaggcaaggcgagtgcaaccgcgcctcctgcagcttcgcccacggcgacgccgagctccgtggcccgccgcctcgttccccgttcccgcctcgcggtggacctggtatgcgcgcaccccctctccctcctccccttccccgtctcgctctccccttcccatctgcttttctgcttctcggcggttgccgtgtgctctcgatccgcagctaggtggctctaaatctgttcttctgcaatggaattactgtctccgccgatgttctattgtggacagattgtgccgattgttttctaggaaattattcagacggagtgaaactgggttgagtgtgatctgctatcagtttgaaaagtttgggggatattcatattttgagaagattcatggtgtcctaccatggccccaagaaagagcattctttttaaaataggagtatacatcgtttcatctgtttatgttggatttcgtttataaatcctgagaggatgggctgcatatgtggggaatatgacagacagtgcgggatgctggttgtacagcgaagtgaaagagatatcaattccatctgcgctgtgtgctttctgcagaaacttttggaaatgttgtggaactgagctagtagtaagagaaaatgattagaagaataccaaccatggtaacatctgacaagagctgccctgtaagataaacactgatgacctggtttctatctctggctacttgttggaagaaatatactctacagcctgcacctggtcatgtgatatcagcactagagtcatttatatacaaaactagagcgtaataattccatcagtttgtgtgatatcattttgttgtactgttttatcgcccatatattatccttttcttatagtactttggctgccaaagtttcatgaacaatgtgacatctttgctaatcatatttttgctactgtacaaattagctgttcccagagagattttctccaaccgactacttgcagaggatgacgcatcctattttcattgcacaccttttcagttggtaatcagacattttatggtcgctggaatgcttatcttgctacaggagatttcttgagggatatcatgtggtttcagtcagatgcatgttatcttaatgtgctaaagcacctagcagcttttgcaactaattgtaacaaatttgctgaatacacagcggcaaggtctcctcttgggctttattcttgcctgccattccaagtatgatcacagaaatataaaatttgaagtcaataccaataatatctggacaagtggaattaggtttgttcgacaatattggaatttggaagatctttcttcgtgataatctcagtatgatgtcaaaaattggatattccatccattattcacttctcatgactgacacgttagggctgcaggaat

SEQ ID NO: 58294 - DNA, 1852 bp, Oryza sativa
aaaatataaatttcacaattatcagttgtatctgtgatttctttgttaatgtgaacatagtaatctctttgtaattacatgatctatccatggttttttttgccgggtcagccaaagattggctgaccaatttcttaagattggggagaaaaacaaaggaatattacagcgacattacaaacagcgtgaacaagcgaaagagaaagagacaatacaacaacgattactcgccgaattgggagaagatcccagctaccctccacaccgcgatttcttcttttatattctcggctacttgctccgtggtcatcgacacatgctgaaaaattctagcatttcgttccttccaaataagccagcaaattaacatgaaggcactgtcgaagtccactttgtagctcgtccgaaaacggcgtcgcgttgcaagccaccagtcagcaagtctgctgtcaccgtctgccgggattgcaaagtttgcattgcaccatcttctgatctttcgccatacctccgccgtaaaaggacaggttacaaacaagtggtggcaatcctcgtcttctctctgacacagcgagcagagggggtcgtgcggccaatttcgcttcgcaagattgtcggcggtgagacatcgatccttcaacgcaagccacatgaagaaacgcacacgcgagggggccctggatctccacagtagctcgccataggggcagtcctcagcagctatgaagaaaacatcataagccgacgccgccgagaatttcccgtcgcccgtcagcttccatctgatctcgtcaggcgatgggagcagggagaaatcgtggacctcatcccataactgaaaaaattcgcccattgcttcattggatagtgcaccctgcagaccacggacccatttgttgttgcacaaggtttagcaactgaaagtctagcacgccccacataagaaaacagcgttggccatcgccaagcaaagcagccgtgcccagtccagtttgctgtccaaaaatcagtgttttcgccatttccgacaatgtacttcgccactgatcttttgccgggtcggcgaaggagccgaccaaatttcattaagattgaaagggggaataagtacatattttacacgacattatactgtcggtccagaggttaagacccctggaaacaggagtggggaggggaagcaaagaaagaaaaactgcggtaatgctagggctactcctcacaactttcaaataccaccgcagttctccaaactgctacttcctctttgatgtctgccactagatgctctgctgttttgctcttttgatcaaagactctagcattgtgttctttccatattaaccagcttaccagcaggaacagggtgtcaaaagcacgcctgtagcgcgtctgaaaactgcaccgcgctagctgccaccattctggcagagatagattttgacgtcctgggggtggaaaactcacgttgagctaagacctcagcaaagaccagactctaatggtgaaggaacatttggagaggagatgatcacagtcttctagctctgtcaaacacaggggcaagcaggatcatgtggccatccgcgcttagcaaggttgtccgctgtgaggcagcgacttttcaccatcaaccacataaagaatctcacccgagctggtgccctagccttccaaatcatctccccataagggcagcgtactgccgtaaggaagaaaaactcataggccgatgcaacggagaattgcccattggttgagaacttccaaaggatagaatcctccaccccttgctgcagctgaaccagctgcagttcatcccatagggctagataatcgagcaacgcccttc

SEQ ID NO: 58295 - DNA, 6105 bp, Oryza sativa
attcctgcagccccggcgcctttccatttctttgatcgcccacctaggcagctgtagaacagagaggaaatggaccggaatggccatcaacactgatttgatcaggcatagtctaccgtcaggtgagagtaatttgggtttccaacctgcaaccttcttagccatcttgtcaagagtgggttgaacctccgctttggtaggcttcctgatcgagagaggtagcccgaggtaagtaattgggaaatcttccaatctgcaggctagagtgttctgcgccaatgtcttctgagactcagcacatcttatgggggtaacggcactcttggagaaattgatgtgaagcccagtagcagtcccaaacagattcagcagagcttttaccgcttccacctcatgaaccagcggcttaagaaagataatagcgtcgtcagcatagatcgatatgtttggagctcggttcctcaagtttactttgtcgatgaggccaatggtggtagtttgctagagcattgagtgcattgtgtccattaccaaaacaaagaggagaggagagagagggtctccttgccgtaaacctttctgcggcttgaaggattcacccagggcgccattcagatcaaccctagtttcagctgtcaagaaaagggcagccacccagcttctccatttcggcccaaaccccctaaaacgcagcatattcagcagaaagctccaagacactgaatcaaaggccttcgagatgtcaagtgtgaaaagaagcatcgccttgtgatttcgatggaattgtgtggccaaccccttcacaaaaatgaaattctcatggatggaacggcctctgataaaggcagactgggagtgagccaccagctcatccatgcgaggggcaagcctgagggccaaaatctttgttgcgagcttagcaaagctgtgaataagacttattggtctgaaatccttcaaaagtgtcggtgcatctttcttcgggagaagggtaatgatggccgtattcaagagttcaagattttgtgagttgcctgtgcaaaatttatgaagagcttctaggacttctttttttattacatcccagcatctctgatagaagaggccagtgaagccgtcaggaccaggggatttctcattctgcatggccttgattgtagcccagacctcttcctccgtgaaggcatcatccagctcagataagtttgccctagccaaatgaatttcttggaaaaggatttgttttaaatcaccctgtgaggcccccatcacatattcgaaatgggtcttcgccatctgttccatatcctcctgcgtggtggcaatgacgccatcatgctccagccagagtatcttcaatttcctttggtgtgatttcattttcatgaagaagtaagcagtgctggcgtctccctctcgaaggtttctgaccctggcacgctgccgaatcctaattctttcaagtgatgcaagagccaaacagcgccctttgagcgcagctcgcagctgccgctccaagtcagatagaattctaatttcctgtgccacatcaaaacggagaatgatttcattcgcaatctgaagttgtagcctgaaattactcattttcttctgaccccacttagacaagatcttactcaaccgcgccatcttgacatacagaatgcaaaaggggtcggtgctatccacactgcgctcccaagattctttcaccacttccatgaatccatctaattttgtccaaaacgtctcaaaccgaaacctcctagagataggtttgaactcaccacatgtcagcaaaagagggcaatggtcagagtttgaggagctcaaagcctgcagatgcgcctcaggaaagagatcttcccaggaggttgtcacaagaattctgtccagcttcaccaaagttggtctggcttgttcgctgctccaggtatagcgtctgccaaacatgtacatttccttcaattctaaatcattaatcttgcttcggaaggcattcaacagtcgtctattaatcctcgagttgttcttgtcttctgctgcagcgataaggttgaaattgcccgcaattaaccactcccccaaacaaatctcccggatcactgacaattcttccagaaacaaaagcttttcttcatcaccttgtggcccataaactgaagttaaggaccatgatctgttagcagccaaccagcacaaattaacagtaacagaccaagtgccaatatgaaccacatcccctcggaacagagcactcttccaggcaattattactccccctctagtctcctcagcgggcaaaaacacgaacccatcaaaatccagaccacaaagttcataaattagcgactggttgacagcggacaacttggactcctgaaaacaaacgacagaggaactagaggagattacagactctttcaccaacgcacgcttagcagggttattaagaccccttacattccacactaggaaactaaaacctaacatagggaactggacacacttcagattagctgaaaagggaaacaaagcaatcaggccggagacgcgacctccacccccggaagaacttcaggcagaggttgaaggggtgcggccatgtcgatttgcaacagttctgcaatggcctggacatgatgcggaggcagcggttcatcaaagagcttctcgaattcctgaaccgcttcctggtttgcctcttcttcctcctcaataattcccaacttcttcatagtcaccttctgggctttggagatcgtgtgccgccgtgtcccattcccctgcagagccaaccgcgggcttcgccatggcgtgaatccttctaggatagttgcacggcgtcgagtcctagtgactgggacagaggccggcggcccccctaggatggatggaggcggtgtggtggagatcgacgaaatgaaggccgagattctggcttgaacctccggtggtgcctcgttctcatcagtcgcacgctcttcgcgtgcccgacgaccgacagctgccagagcgccctggtcaacggccaccgcttgggctggacacctgcggcggctgtaaactaacggaaactccgtcaggccaacgggcctggtcagtcgcgctggagtggccaggagcccatcttcagttgccgggagcacgatagctgacagcccatctccgtctgcaggcccatctccatccgtaggcccatcctcagctgcaagcccatcttcagttaccagcacctcttgaactgtccaggccggctcccttgatggcccgtcgtcggtcgcaatcgcgccaatgctagccgagtcgccccgcgacttcccgcccagcggatcaagcactgtatccgacgtcaccgccattaagggcaactccaccgacgaaatttcgaactcttcgaaagacagccttctcaccaacggcaacacggcatgctccagcattaaacacgctggcgcggtggcaggacgctgaagactcgcttcccctagggaagcacatccgtgaaccgagtccaccgcgtccggaaggcccgtcgtgggtgtacccagcgctgtctccgcggacaccaccggctccaatggcggtaccaccgccggcacagcagcaaccctatggctgcctttaagccagggaacgatgtgaatctcatgttcagaatcgcctatcctgctcaaggattacaggccgattagtttggtgcacagtttctctaagttggctgcaaagattatggcacaacgactggcgccgaagctagaagcactaatcccttgctcgcaaactgccttcattaagggccgctgcattcacgagaattttgtttttgtcaagggcctggtgcaacaattccaccggcagaagaaggcaacgatgatgttgaagcttgacatttccaaagcgtttgacactgtctcttggggttttctgctgtcaatgatggagtttaggggatttggcccgaattggcgaagatggatctcggctgccctcctaactgaagaaacaagcattttgattaacggggtgctgtcagatccaattaaaccggctcgaggactgagacaaggcgaccctctatcgccgttgctttttatcttagtcatggatgctctgcaagctttggtttctcgggcaaagctggctggtttgctttcgcctctaaatgcaagaagagatttgctctcggtgtatgccgatgacgcggtgctgttcttcaagccaacaaccactgaagccaacactatcaagagattgctgactctttttggtgaggcaacgggactcaaaaccaacttctgcaagagcgctattacaccgattcagtgcagcaatgaacaacgagttctggttgaatccatcctctcttgccgagttgaagacttccccatcgtctacctaggcctcccgctgggaacaaggaaaccaacgaaagcagagctccaaccgatctatccatggtgattgtgtgttcttatcatccagtaactcctgccaatctgctgaggaaatgccaagtattgatgttcccaacaaagaaaacaaggacaaagacatgtttatcttgcatgtgatcatacaggtagtacaaagttgcatgcagtatgttttgtcatgtgctaacttctgagttctgattaactatgaacatgcgcagtcactgtggaatttgaggtgcttcagagatgagattttaagggcaccacctgcaacaatcctacatatcaaagaaaacttctgcatcgctgacctattctatggaatcttctttgcttgggagaataatgacacaacggagtggatgttttactgacctctctgaaggttaatctctgtaaaattgcaaatgataacatgtttcagaaggtatgtgggtttctttgcattgtcattgttccacacttccatatgcactggaatgaacaaacttagatatacgagtgcaatgttctttagttggcaagctctgttaatcaattcgttgctgtttttcctgattaacatgtaaagtgccgaactaatcggtcggaggctaccatgatctttattctgcttcagaactttatccttcatgtatatttttctgccttcacaaggttaaacctggtgaatcaatttcagttgcaggctggaaaagaattgcttctgaggttgtggcaacgattcttcaagcactgcatatgtcagaaactcctctgcattttgatttcaacagtgagattgaggaacgtgaagtaagtcctgtcagctgcggagattgcatatgccgaacacacgatctgttcgggattaagttccatgtgcaaatgagctgcaggtgtgggaagtgttttggtgagaaagaacatactacgattttctgtagacttgatgccagttcacctcaaacaacaaaggtgtgtcacatcagatttcctgtgtagctaaaattttatattatatgcaagagtagcaaatagttattgataactttttgcagatcgaatcctttgcagagcttccggttctctatgatgaacagttgtgctttggggacaattgcaagcattgtggaagtccgaagaacgttgatgtttctccttcaaacacaccacatatctttacaataggtaaaggtccttgtctacaatagtaaactgcaatttaatatttgctctctttttcctgcctaaacagaattacagaacatgatattggttgttcctaaaaaaacatgttattggagatatacatgacaaccacttgttgtaactcaaacatatcctgaaactttaaggttgacttctattaagtttgatacggtttgttattatgctggttaggaaggaggctttttgctatgttcttttatccttttggtttcctaaagttaacatcaaaatgtttgtttggtgttccctttttgccattatgctgcaggtttatactggtttggtgattgtgaaaaccaggttcagctatctgaagttctagttggcattgcacatcccattgatatcaaacttctctgcaagggtgttcactcctcggcaaaatattctctggcctcaatggtatgtgcaaagaaaacctttgactttttcatgaattaaattgttgatataa

SEQ ID NO: 58296 - DNA, 10286 bp, Oryza sativa
attggcctttaccagattgaaatcggttaggctacagtggataatgggttcaagctatgattcataatattcatatctgagttggtcgtatagtattttggggaatatttgcaagttaccaatggtcctgtcagtgaaattatttgtcctcaaaccatactgatctcgaagactgaaagtttcaagacaagtattggagcaataatttgagtacctagtctgtgtaagcaatactggtgaataatagagaggatcctgagtatctctgtgaactttttatcaccatgtttcatcgattgagcattaaaatgaagcaccatggccgggtaatctttattggacttcttttgatctctgttactctccagttgtcttgatatatttttcatttgctttattctaaaatatcaccactagaaatcttatgcagtggtgcaaaacttacatcagactacccttaaaatttattcccttgctctattgagttttacttcagttttttttttcgcatggtttgttcgatgctccttaacctgcctgctaacttcaacataaccgtgcctagcaaatatattaccttttcatacgccgaggttatttattccatattatccaaaactctgcagatctcctatgccaatgggcggtacttctgctttgctcgcgaccaggataagtggctcatctctgatgctgagactattgaggtagataacttgctcatggcctctgcagcagccatgtaggcttcttgattctgatctgctctctgattctgagctgttaattgtgtacaggcagaagattcatgggagcagttgcttgaacgcttcagagactgcaggctccaacctgaagttctttttttcgagatcatcaattagatagatggactgcctggaagaaccctgtcataatattgtattcatagcttcaagttaattttgacatttttgcaagcaacttgcttgtcattatcttgatgctaacagttttgatatatctccttgtaaaactaccatttcttaccagttttggaatgttcttgatcattgaacagcctgtatttgttccattccttctctttccagtttccagtggtgtcaaggaaagttacctctttgtgattgaaaaaataaagaggaaaaatatactctttttggttaagcagcaaggctgcaaataacgagcaaaaacaaacttgtcaatttgttccagctgcagtagctgtgtgcatgcatgtttataatctgtcaacattgaggggttcttgattatggaacttaatgaactcaaatttcagtcagaaaacattcacaaaaaggacatttaagagtacgacttgtttctttctggtgccagattatgactgttccggctcgagttaatactgatgacacaattaacagattacaaccacttgtttttttcaccaatagactatgacacaattaactgtgctacttaagatttgccaaatgcagaggatcagttcatgtctaactacaactagttttgtactccgtatttttgtttgcacgtctaatcagtgtacacaatgctagatacccagaaaatatttagtaaatgaagttttcttcattaaggattgcttatataactagtactccctccgtcccaaaaaaagacaaactctgggtttccgtatccaacgtttgaccattcgtcttatttaaaaaaattatgaaaaaaattaaaaagacaagtcacgcataaagtattaatcatgttttatcatctaacaacaataaaaatactaattattaaaaattttcatataagacggacagtaaaacgttggacacgaaaatcagagtttgtctttttttttttttaacggagggagtagactagtagcagttctttcatgttgtttgacagagtcttgggagatgctcgatttagctctgtttggcgcatgcttaaacgctcgctcttcgctgcaggtgggccccatctgtcattgtaaggttggactggtaattccaagcccaactcgttatgggccgaaaatgttgggccttattgggcatctgaggcggcaccgaacaaaaaaagttgggccggattttctcccctcggcctcttcgtctacccgtcgcttccgcttggactccgaccagtggagggcaaccagccgccgccgccggccgccgtctcgtcttgggatcgcacgcggcgcggaagaggtagggtggttgctaggtgagtcagcctcctccgatctctccctcggacgcgtcgcgatgatctggggtttcatgggaatgcctcttgctttgcgaatttgagccatttcgatcttctttgcagtgaggagggaggtggttggaggaggatgagcgaggggaggccggtgccgaggagggagagcccatggggcttgccggagggggacaagcgggagcccaaggcgcaccgctgcaacgaccgcgccgaggacgtcgtccaggttccaccccctctcaaccctaatccaaccacagctcacgacctgattgatctcttattatcttcctaccgatgaatgagtggtgatgaatgtgtaatggaaattgcggagctcagagctacccggatgatagttttgtggagaacctcttgtcgctatgcctgtttgctagtactaaatttggatcttgaaggcgcttgatagtgaaattggctgtaattgcatcgttaaacatagttgttttggcattactagcctttcttacttacaattatttcagtgtttacctaactgaatgtcttctcttcgtgttacataacaagattgcatgatgttctctgcccaccagccaccatgatcctgcatgtgcattgcgccattgctgcgattgttgttgctttcaggctgcaggtggtatttccatgtttgatcccaaaaccatgtttaggaacggcctagatggcaatcagattcttatgcttacccaggatgaaataagcctcagtaattaacccaaaaaccaatggcggagcttcatcgaaatagtgagggggccaaatgtctgaacattagatcctcagtattgatcaagtacagaaataaactcaaattggttcatttgcacttattggccatattactggtctatactcctaggtgaataagaaaagtgggaactaataggcaaattataacaacatacactactaggtgaataagaaaagtgggaactaataggcaaattataacaacatacactgctaggtgaataagaaacctcggggaggccatgaacccatttaatcacaagtagaaatggacgaattttcagtatggaattgcccctaatttcaactagcatgctggttccactcacactgaacctgccagggtccaaaattttcatcctgtctgggattttcagtaaagagttttcatcagttatcagcgtctgctatgtaatgaatgtttcccaagaatgctgaagaattttgctctgtgcctcaatgtgttgattatattatagcaaatgatgatattgttaattctgaaattcttggccatctttatgttgaactcatcctgtctaggatattcagtaaagagttttcattggttatctgcgtctgctacgtaatgaatgtttcccaagaatgctgaagaattttgctctatgcctcattatgttgatcatattagggaaaatgatgcaattgttaattctgaaaattttgtccatttctatgttgaactggttttctaatttctgttgcaggcttgctttgaggggaatcctttcaagacagttccaggtccattcaagctcttttggcaatgcatgcgttcgaaacctgggtatgtacaacttcttacaatttgtatgtttcatgcttttgttcacacatatattcccagtaatatgaggcaacatacgtttcaataggtctagcacattaagaactaatatgattgataaaggacattggaatcatctgattgaggggttttaaggagtggtcacaggatgctcatgataaggtggaccattatattgtgcctattgtttgatatgttcttctctttatgctccttcttgccggtggctcttccaccataggtccttcagcagcctaaagaaatatgtgccatgtgaatatacctagtggctgcagaaaatgctcatgatgactaatctttgcagtgtaaaaggctctagtgttgtgattcctttcaccacatggattagcatgagctttgttttctgaccaactgaacttgtaatctctgagagttgtgtgaattagattgtaaggcaactttgtatttgagaagttatatagggctattctcaattaaatacaaatccaataaaattttatgtatgcttcttggcctgttttgccatgtagttattcgttgcttggttacatgtgtcatgtatcaccttctaggatggtggtttggttgctttcttcacttccaatggcgggtagggtttcttttcaaatgaaatttgttgttgtcaaacctgggaaagggaaaggaaaatatggtctatctcaatttggctggttcagtttggtcaagttaggagcactgacactgtctggctgggagcaactgcttcaaacaggctaatgctagaaccactgaactgaccaatagccactcaagtgagaaaaagaagtattgttgctagttgctaccataccttggggtagaaatcgaggcaaccctttcgatagacattctttccccaagaagcttctgtacttcagaaaactgttgtagacaaaacgctatttacttgagtccactaaaatgtgaagctgtgagaaatgttgttatgacaaatgtacttgtgtgtgactagtagtagttagattgtaatgagcatcgtaaccctgaatatttctcttacgtttgtatctgaagttttcatgtaacaacctgttatttacagggaggagccaacggagccgtatacttacctgcagctggatcctcccaagagagcggaagtcaagctagagtaaacagcacctaagtcgtccacaagagtgtttagtttatttcatagtggtttgccttcaaaacaacgcctttatctcctagggaccatgttgtgcacaatgccttatgtttgcatattcaagaataaaaatttgacaatcctgatccagagtaatgccttatgtttgcatgtttgaaattgctgttgctgatgtaagaattccctcccgatagaatgatacctgcactttcaagatgagttactcagggccaaaagagtaaaaggccctgctcaacttactatttttttgaccccacgaaaaagagtgaaatggcttctgaaacaggttcacttattatggtgtctgagctctgtactgtacgtataagagtagcaatgtagcattatgaatgcgctactgtgtgtagatcagttgtgggattgtttactgtatttgtcagtgcatgagtcttaatgaatgagacggtactttggtacaggtccataatgataatctgcttcactacacaaaatctgacactccctaatcagcctctgattatttccttttgttctttcttgcttgcatgagtatttacacaaggctgtactgtacatgttggttgctctacagatattcttcaagagccagcacttggttgatctacagatattgttactgctactgctactactgctgcacatggtgatgggccagggaggcatcaaagctagagaccgtgccgtccacggtgagtcagtcttctctgttattattctatcgcctcaatgcacaataacaccagtgccttcatatgcacccaacctctgcattgcaaaattttgcaactgttgcaagtgactgatccaactcctaggttggttgcagatccaaagctgcaattatctgacacggatgcagatatgatcctgaactcgaaaaccgtttgtgttgcagatcccaatcacgcatcgatcgacctgggactgagctactgagctaagcttaccatggtgatcttgattcttgtaacgtagagactacaccatcttctgctacatatagcccggaatgcaccaatgcatgagtggatcagctcacctgaaagcctgaaactgaactgacctgatcacctgaccatcaatggcgtccaagaacagctgcgcctgccacggcgtcgtcgtcaccctggcctcgtgcctcctcctcgtcgccgccgccgtctccgtctctgtcctcgccgcgcacgtcgccgtcggccgcgtctggtctcctgccggcgccgccgccgccgccggccatcaccattcactctcaccggcttgggtgccatcaccgtcatcacgccatgctcatcatgccagggaactcgtgaaccgccgagtacgtacgccatgctcatgccacactcagactcaacggtgtttgtgcagtgatgatgtgatccgtaatgggcaatggatgcagaattgcagcagtgcagtttcagatgcaggaagtgtcaatgcaaaaaaaaaaaagtcagcgatgttgctgtgacatgtttttgataaatatttttgacatgtatatttgacaaatatttttgtttgtgcatgcgtgtgtgtcaggttcaggtcgggaggatggaggccgggctggtccaggcgcgggtgtccatccggcgagccagccgcacgcgcagctgcacgccggacgacggcggcgggttcatccccaggggcgccgtgtaccgcgacgcctacgccttccaccagtaagtaaattcaccactccgtattttcgttcccaaaaacacacaaatacacataagggctcaagagacggaggcaaaacgataaatcggtaacctcactaaattcttattgaaaaacatcacattcacacagttgtctcctttgccaatccgtaacctcactaaattcttattgaaaatgtcatatttatacggttgtctcctttgccactccacatctggccacgcatacccaattactcactccgttttatgttttatattattagacgctttaattttttaattaatttttttaaagtttgataaagtttataggaaaatataataacatttttaatgtataacaaacatgttatcaaaatatattaatgttacatctaattaaactaatttgatgttgtagatgtaggcaattttttttatgaatttaattaaacctaaaaaaatttgaaaaaaaatcaaaaggaattataatatattataaaacaatggggctagtaaccaagagctatatatgtgtaattaagttggccgcggctagctgctgccggctaagctaggataagcattcgtgattcgtcgacacccgatcgagggcattaacacgccttcctcgccgatttggacggcaaacggcctgaccaaatgcagccatcactaaactctacactacacggatatatgaattcttcgtacgggctcgtgcgatgactcgatgatcgatcggttgttggttgatgggtgcatcgctttggctctgctctttgtttggtgagacatgcatgctttgtgacggcaacgcctagctaatcttacaggcagagaccacactgctccattattagaggtcatcacaattcatcatcatcatcagccggcttctagatgattttgtaattagagtactcttaattatttgtgctcaatttatagatataacgtgtggacctacctaattataacctacctagtacacgtagtacttcactactttgacaaaatgcacctgtagtatactagaggtactatatacggagtatatgtaagttgtcatgtaatggtagacgatttttataaattgcatgcaattgaatttcactctacttgcgtacccagtacagtaaaattttgctactagagcattgtactgtactacatttatttttaataaacgatgccgctgattttttaatacacgtttgatcatttgttttatttaaaaaatgtaattatcatttattttattatgagttgtttgatcataaaaaatttgatattcatcaaagtttttaaataaaatgaattatcaacatcaaaggacgccgtacggaggaagcaatactatcgtaaaacaaggggaggttaattttaattgtggtcatgattaattaacagccaataattaactgttactgcatcatttgatcattgattatactatcatcaggagttacattgagatggagaagaggttcaaggtgtggacgtacagagagggcgagccgccggtcgtgcaaaagggcggcgccgccttcgccggcaacgacggcatagagggccacctcatcgccgagctggacagcagcggcggcggcggccggcaccgggcacgccaccccggcgaggcgcacgccttcttcctccccatcagcgtcgccagcatcgccggctacgtctaccgccgcgacatgatcgacttctgggacccccagctccggctcgtcgccggctacgtcgacggcctcgccgccatgtaccccttctggaatcgcagccgcggcgccgatcacttcctcgtctcctgccaccaatgggtaaattacactccacactctcctgcgctacttttcgcgggaattgagaaatactccctccgttcaaaaatataaatatttttagcatggtgtcaaagtcaacatttttaattttgactattagtagtaaaaaaaataaaaagcttaattatgtaaaattgatattactagatttatcattaaaaaaactatcataaaatacaaaatttttaaaacatattacttttatagatattattagtcaaagtaatatctcgaaaactgtatcgaagtttaaaaatacttatattttaggagagatagtatatgtaatttcagtaaaggcgttgaaattaattaattctacgaaattatggataaattaatgaatgaattaattaattccgcgtctcaaatggggtcacttgtatcgtacccgtcaagctctgcattcaaatacaaacagtctagcactctagcagtctagcttgttagttcgttaaccaggcagtttggtgatcagttgctttcacgagtttaaatgcataataattaataaaccggcaacattttagtactagctgtgatgccacaataggtaacgaaacgtatcatgtttagctatgcagagagaccatagttatagggagacatgatgacacatgaacagcatcatgtatccatttgatcgtgacacgaatcaaatatatgctgcttaattgattattgcatctttttttttaagggaacaaaagaaattcaaacttaattgactcgatcgctgcgacatgtgtgcgtgcgtgtaggccccgatcctgtccgctgccaaggcggagctacgcggcaacgccatccgcgtcatgtgcgacgccgacatgtcggacggcttcgaccccgccacggacgtcgcgctgccgccggtggtcgccagcgcccgcgcgacgccgccgcagggccgcgtggcttcggaacgcacggtgctcgcgttcttcgccgccggcggtggcggcggcggcgccgtgagggaggcgctgctggcgcggtgggaggggcgggatgaccgggtggtggtgtacggtcgcctcccggcgggtgtggaccacggcgagctcatgcgcagggcgcggttctgcctgtgcccgtgcggcggcggcgagggcgcggccgcggcgagccgccgcgtcgtggaggcgatcaccgccgggtgcgtgccggtgctcgtcgacgacggcggctactcgccgccgttcagcgacgtgctggactgggcacggttctccgtcgccgtccccgcggaacgcgtcggcgagatcaaggacatcctcggcggcgtctcggaccgccgctacggcgtgctccgccgccgcgtgctgcgcgtccggcgccacttccggctgaaccggccgccggccaagcggttcgacgtggtcaacatggtcatccactccatctggctccgccgcctcaacctcagcctcccctactgaattacagaatgaacaacaaaaaagaaagttaattaggtccctgcagtttggaacgcgagaaaatttcacgttcctacaaaatttgaactgttctatgttcgaaacgagaccggccagtgtgatggatctgaccaagctagctaagctaaccaaagtgtgcagtagaacactgtacactgcatttctgcatttatagacaataggttgtgttcgaatgagttattcctaatttctcgcccctcgttttctacacgcagg

SEQ ID NO: 58297 - DNA, 10246 bp, Oryza sativa
tcaagattagctgcagacgtacgtacttttgcagatctatagatcacggccggccggcggggtggagcaccggagtttaactccggtggtccaggccgagtttcaatactccatctgccccattttttcttccgtgttctactgctacatgcaaacaaacaagcagcaatggcaatggcagtagaagaaagaaaaggggagcgatttcaattgaatgctgcctctatcttgaaactgaaaagatacacgcacagagatcaaaatcagatcagatcgatcagaccagatcgatgggtcgatggatggactgaatttattggtggtttcatggcagttatttctgcaccaagggttattgaatgtgggcatgtgaactcaccggcaagcctcgccggcgccagcttggccggccggcatccaaaccgatccttcttcaacgctaatgctctcctaaaatatataagaatttttagtctctagaatttatcctaaaatataataccttctacaaaaattttttgctcaaccaatcataactcaccacctttcaaattttccacctacctctacttcccatccaattataaccctagctttattatttttttaaaaaaagttttgttatttaattctatctactttttttaataattatgtccagctttaaatatacttatattctgaatggagggagtagtactcagcttgtcctcatctctgcacttctgcagtaaaaattaatatggttggttatagttgccatggctagccgtccagcgaaatgcaacctgattattagctgaggtagtagtagctagatgttcttttgttttagtacacctcagtgcgattgcggtccagctagctgatgatccgtatggcacggtgtctgaactgtagactgtagagtacacttttgtatgctgctctgtgcgtggcacgataatatgggtgcactcgagctgtcaacacagtcgatcgcccatgtacgtgcctgcccgtccagctctgtgtacgctacactaataatttcgtgtgtacaggttgattcaaaaagtaataatgtcaaacatggattgattcttagggatgtttagttcacaaaaataaaatttttgggtgtcacatcagacatttgaccacacgtcggaaggggttttcggacacgaatgaaaaaactaatttcataacttgcctggaaaccacgagacgaatcttttgagcctaattaatccgtcattagcaaatgtacgctactgtagtatttatggctaatcatggactaattaagctcaaaagatttccctcctaactgtgcaattagttttttaatttatctatatttaatactccatgcatatgtccaaagatttaatgtgatgtttttgggaaaaagtttctgggaactaaataggaccttagtctgttggttacagtgacctgaggcctggtttagttcccaactttttctttaaacttctaacttttctatcacattaaaactttcctacacacaaacttctaacgtttccgtcacatcgtatcaatttcaattaaacttttaattttggtgtgacctaaacacaccctgagtaacttctaaagattttgagttcaaatattcgtacaagcgaattttagattgggttatttgatggactaagttcccaatttaaaatttcagattaggttgtttgataagataagttcctaatttaaaaggttgcatacaactgattgaatgtagagaaaaaaaataccattctctaaaaaaaaaaaaagaagatggatacagttacgtactacgataggatattatcttttttgcgggaaaattatctgtcactaaaaaaattattaatgttatttcacaaaaaaatcttaatagttttttgtttaataattaatgagttaagggtttgatgatccgtatagcacggcatttgtactgttagagtaaaatttactttgtagcatgatatcatgctgctttatgtgtggcatgatatgggtgcgctcgagtacattcctagctagtacgctacactaatgatccgtatgtacatgttgatttaaaagtaataatgtcaaacaggagatggtacttgctactaatataagctttgtgttaaagttttgaccctcttcgtcaggttatagacaccgacgtatcagcggcgtagtaaggcccacaagatggataccatttcttattggctgctgtgatgattttcggttaatggcatattcaatggtagagataaatacgatctcctagacgacttaagattatttaaagaacatatttttataaaagttaagacgatgaaggctctaaccattaacttaaaaaatattacttttattattgtctctcatgcaaaacatgtttccatattataaatactagagttattgctgagctgtctttactcatagcaatgacgtctctctcttacatgtgaacaaatattcttaataattagcaacgctaagagatcagtattaacaaccattatacatgtccttagctgtagctagaatgtaatttttgaaacataagtttaaattagtttaaatgtttcttcatcgtattttctattttaccttttaagtactgctaagagtatataatgtaaagatcttattctaaaatcattttcggttgggataagtcgatctatttctctcccccctcaactatcatgccattaatctcgactttaatgtttttaattagatcgagtacatggtaacatgaaatggtacaatcatcatatatgtcatgttgctctgtatatggcgcgacatgagtgtgctcgagctatcaacacggtcgcccatgtacgttcatccaactctgtacgttcttagtacactacactaattatccatatgtgccaagttgatcaaaagtaattatatcaaacaaaaattggtactcgcttctgtgcttgtgaaattaattaaagttttgatcgttctcgagtttaggtacatgagtttacaaacagtgacgcatgcagctagcggcgtcgtaaaacctagaagagagaatagcaacatttcttgttggctgcgaccttcagcatagaagctacaacaggaatgtaaattttggaatttaaagtttagattaaatctaaattctttttttcatcgttttctgtttccgtacatactttcaaaatgctaaaattaagtagagagatgtaaagatcttatcctaaaatcttggtttgtttgttattttttttgtctttcaatcatagctcaatccattagagcgagtgcaataaaatgatgtaagagaattatacaagttagtacatcacatttatacttacgtgaataaaagagaagagaagaaagaaaaaaaaactatagatttatagccaactgcaaaataatctctactaatgaactatacaaaatagacgggagaattaggtataatgaaatatatattttaatgaactatacaaaatagacgggagaattaggtataatgaaatatatatttatagctaactaatatgtgagtgaactatatattaggttgattataaatgatgttttaatttttacatctaatagttaactattggtaacgttggaattgcagaatagcgggatgattaccatgatctggtaccatgatctggtattttgaatgaaaaaaaatatttatatttttaatttaaattctatgggctttaatttccataccaaccgattcaaacgttgtggctccgtcaaagctctaatcaattggaatccaaaaccttaattgctacacccattatttaagtcgtactttttttaatcactgttgctgcttcccaaccgtttagggaagtcgagcttctagaacgtgtggtgcgtcttttaatttttttttgacatagtaacaacttttagtctcagaatttgttccaaaatataacaacttcttccattcacttttctcacatatctccactactcatccaattacaacctccactattcacttttacatactttcttaattatcgtgtccaaccctaaaacttcttatattattatgggacggagggattacaaggacgcatcgatgaatccttgcatgttgtttaagaaagaaaaacaattggaatagtttaaggtctttttttttctctctctctcaaccatgcaaaagggtcgtgcttcaatatagtattaaaattgttggttttatgctgaaatttagtgttcttttcaatcgcagatggaagggttttcaaatgagaaaaaaaaaatcacagatggaaatcagaaatcacaccaaccatgggtaattcatcattttgaggggggaaaacaatggaagcgatctcatacttggctagcaccaagggtcataaaaaactattggaaactgtttgatttttttaaaaaatagaaggttttatgctagctggagatcatcgcttttttttttttaaaaaaagaaggttttgtgctagctggagatcatcgcatactactcgatacatctgccaaaattaaattaagtttttttttaataaaatttggtccaatttcaccagtagtgaatggtttcgaaactattcgggagcggttcttttgatagttcagttttataaaccttggctatcccacatcatcctttaattaaactgtatattccttccaaaacaaagatgcaaattaatcatataaggcagggtaaaggctatgggcgttcatatgaatgaacacatgtttacgagtatgtgtttgcaccgtgttttgcaaaaaaaactaattaacataggtatttctcgacttggaaaccaatatatatatgagcagatcaagcagcagtaggtacacttaatcctggataaaaacaagagagaaaagaaaaaagagatccactaataaaacaaaaaaaaatcaaagaagaagaagatatcaagagaacactctatttaagtaaaaatttaagacatcatctgcatatccatccatccgtccgtccatccgccatccaacggacagcagctaccgaagtatttatatcgtagtacttaattaggcggacgcggcggcgccgcctccgccgccggtggcgagctcgccgccgacgcggcgctcgacgagggcggcgcggagcgggttcttcatgacgacggtgaaggcgaaggtctcggtggggtcgggggggccctcgccggcgggcgggacccagcggaactcgcggaccatgttggcgagcatgagctggatgtggaggacgccgagggtggcggcggggcagatgcggcggccggcgccgaacggcatcatgcggagggcgcgggtggcggtgatgtcggtgtcgaagccctcgccgccctcgaggaaccgctcggggcgccacgcctccgggtccggccacgtcgccgggttctccgtcacccacgccgtgtagaactccacgctggcgtccgccggcacgcggtacccgccgagctccgtgtccctcgtcgccgcgtgcgacagcacgaagtggctcggcgggtgtcgccggaatgtctccttcaccaccgcctgcacatgcgcacgccggcgatcgagcgccgcgaatccatccatttcggttagcaattcagcatatccccaattccccatcacccgtatcttcttttttttttcatttttttttcattttattatacaatgaaatgaagcgaactgcttctctgtctcacaagaaaaacaaattataggtatgagtttggacaggcgtataaccagattcaaaactacgatacaacttttttttttaagaatggttttactcccgttgtttcataaaaaaacaaaactaatatatgatgtgatacattatagttaatacttatatagataccaagagattagttctcaacaattaatactacacgttattggtggatagggagttttttttactgtctcaatccaatctcggtgagctcctcaatccgcatcacccatgtcatttttttttaaaaaaatgttttttattcttcggattatactatgaaatgttaattactataacaattaatactagtacatgttaatggtagatggggaattttttatgttgtttaactcatggggatgcttgtttgcacgaacaatatgatggggacttatcagggttttttgcaaaaattcatggtgtaaattaaaagggcaacctcaatagctgatgaaattaatacagtgcagtgcttatcattttcagctaaacagaggagcaaatgaaagctcgttttctcagaacacaagtaacatgtccttttcatgacatttgcttgtagaaaatgccatttggactgcgccggctttgttagtgccagatcagtgccttaatttctgtggtgaacttaattagtagccgcaatcttggtttgcagctcgggatccagctcaagaacaaaagaaattaaacatggtacttaattactactgatcgattgacagtgacactccttttagttgtgacaaaagtttggttggtagctgattggtctgccaatgattgacaacaagaacaattgtccatttgactcctagtgtgagtcccactaacctttttaccataaaatttctataaacctcaactcattcaaatttttaagaaaacatgtttcattttgtccttgaacagtgcattctaatacatggccacaaaatttgagtttttttaggaaaaaaacagtcaaaattgtcagatcaagtttgatactaatatatgcagctacaattaggtagtggattaagtagtaattaaaccagaagagtagaagtaataataatttggttggttaataaataaataaatattacctgcaagtagggcatggcctcgacgtcggcctcggtgatgcgcgcggtggtgccgaccttggagacgacctcgccgtagagcttgtcctggacgccggcgtcgaggacgaggtgcatcatggcccactccagcgcggtggcgctggtgtccgtgccggcgctcatcacctcggagcagagcgtcaccagctcgtcctcgccgagcctcttcccccgccccggcggctccaggtcgaacagcgagtccacgtacgcctcgccgggcgcgctcaccatctccacgccgccgaccaccgtgttcccgtcggcgttcctctcgccgccgcccctgatgaactcccggcgcgcgcgcaccagcggcgccaggcagccgagctggcgccgccggagttcgcgcgccgcggcgagctgcttggtgaagagcggcgtgaggagcgggaggaagtccgggagcttgggcatggtcatcatcatcacgtccttgagcacctcctcgatctcgcggatgagctcgtcggggatcttggcgccgaagcagatgcagatgaggatgctgcagatggagaggcggcagttggccatcatcctgacggcgccggtggcggcgaactcggcgcggagccgccggaggtggctcccgacggcccactcgcggatccacgagaatcccttcacccgcggcggcgacacgatctcggcgacgaagttgcggcggagcgcgcgccagagcgggccgtacggcgccgagttgacggtgcacttgccgacgctgaagagcagccgcgtcgggctgtcctcggggcggctggcgaacgccgcgccctgcttgacgagcgcgtcgtggatgaggtcggcgtcggtgacgacgatgagcgtgcgctgccccatccgcatggtgaagatgggcccgtacttctcgcggaggtcgcgcaccacgtacatgaagggccgccgctggaggatcacctggaacaggttgccgaccaccggccaccccggcggccccggcgggaggccgtcggcgccgccggtcctggaacaccgccgccaccacatcgccgccagcaccgccgccgacaccaccagcagcacgtcgttcatgtccaccatcttcgacctcgccgccgccgtcgaacactcgatcgatcgatcactctcagcttcttcacctcgtagcttggtatagctcgccggagtggaggaagagtgggtgggtgggagagatatatagcggcggaggcatgtacacagtggggtggggggagtaaatgcggagccatctaccatctgaaagggagacatgaatgctcgctccagtgtgacattaatggcgagctcgtgaaagctcagctctctgccctaaccctaaccctagccgtggtagtggaaaatgggaagaaaaaccagcggcttggcccgtgatgagctaacctggctgtccaccatggccatggccgctgctgttttttttttttcttcagccgttagccatttgcttcccgcgctttaattcccgcgttcggttgggaagacgacccacacactcatcactcggagtagtactctactgacgcgtttgcaaagtagcaaactggcggctgcacacggtttttcgtttatgcacagtaaaagcatctccaacaatcacttcaaatttgactctccaaatatcgggcctgttcattttaatgttattttcaaccttaccaaattttggtaagttgccaaaaaaatggctacatttagtttgctgccaaattttggtaactatataagaaacgtaccaaaattttggcaactatatcaaaatttggtaatgtttttttttatcaatgtgaacaggcccatctatttggtcaactctccatttaatttagcaagttaaactctcttttactccaacagcctctccattcgtcctctctattctgagtctatatgataattgggcccacacgtcagtctctacacctccttctccctcatctttctccccttctctccaaaccccccttcccactcccatccgtcgccgccgccccatccccatccccaccgccgctcgagctgtgtccccatgcaccgccggtgccgctctgacggcaaattcgtgcggcaggcagggagggagctctcttcgccggcggtggtgtggcgatgcgaggaggtgggcggtcgcgtgcggtggtgcggcgacgcggggaggcgggaggcgagacgccggcgactcgcgacgacgaccttgacgccgctcggggcggagctcggcggcggcggctcgcgacgacctcaacggcggatctagaagggggcggcggcggagctcgaggcggagctcggcggtggcggtggcggtggccggccgcatgacgacggggcggcgggggctggccgcgcgacgacggggcggtggcgccctcatcattggtgcgtgccgcgtggagagagagggggaaacaggcgtgggtcccacatatggttagccggttttggctggccaactttggctagtctggtggggaatttagccagccagatggcttggagaggtatttagctagtctgttggagtagattttttgtgcaagttagccaaattttaacttggaaagccatttggctaggctcttggagatgctctaatgtattttactcatttgagtaaagtgtacgagcggtccttaaacttgtagaggtgtgtcatcttggtccctaaactctcaaaatgcatatccaaatcccagaacttgtcatagtgtgtcatctaggtcccaaatcgccacaacccctttagaatcctacgtggtattgatgtggcatgccacacggacatgacgtggcatcattttaactgacaaatgcgacccatttaaaatatttcctttttttccttctcttttttccctttcttctcctttctataagaagaaaggaaaaaaaagaagaatgagaagaaaacgaaaaagaaaataagaaaaaaaaagacacgtcacgtcaatgtggcatgccacatcagcgtcacataggatcttagaggggatgtgtcaatttaggacctagatgatacactttgacaagttctgggatttggatatacattttgagagtttagggatttatatgacacaaccctataagtttaagaaccgccaatacattttactcatttgacccgcttgtttagttccaaagtttttcttcaaacttccaacttttccatcacatcaaaactttcctacacacataatcttccaacttttctatcacatcattccaatttcaaccaaacttccaattttggtgtgaactaaacacagcctaagagtcatttgaatagtagaaactgaaaaccataggaatggaaaaaacacatgttctaacaaggggctgcaggaat

SEQ ID NO: 58298 - DNA, 2332 bp, Oryza sativa
atcctaaattaagttgtttcgggctcgtcagctggaacgcaaaaatttcacacgacaatgttttatttcgatgacatttgaaatcgagaaattttcatgcgttccaaaatggatgcaggatcttggaagcaaagagttccaaaatataggtggaacatgagaagataactggaagctttagcttggtgtcttaaatgtgtgctatcttatggttgtaagataccctttttaatgtttctcgagtctaagcgctttgtggtgaacgatttttgtgttgatgtgagtctaaatattctgtatcgttttgacggtgtacgtctggttggatgcagatgctggcttttagaaatcaatcatatataaaaaaaaggcatcgtgaaatcaattatatattaaaaaaaaaggcattgtgaggatattgctagtgtgttcggatcactgtgttttatcactcactgtctctttaaaagttgacacaaaggcggaaccacttcccaacatttcggcgttagaggcagcgagcgaaatcggttactgaacacatacacacatacacgccgtcttctcgccgtcgctgtccatggcgataaaggcgatcgactgatccatcggctgaatgaatcaagagctttctgttgcgatttgatggagatgtgggtacttgaattccaaagacaattcaggaaagaactctaattcgtttcgttagtggtaataacagcaatggagatatcagaacatgaaacagctttagtagacaaggcacggtacgagtactagcaggttgccactgtaactgtccggctgctggtagttgagtcacttgagtgcaaggggaaccggagtaacttgcctgtccttggatccagcaggcttgacgaccgagctgcagaaatgcacaaagtgctagtggtgatccttgccttgttcatgatcactggtagctggtgtgactagtgcattacttaattcaatcagttgggagtaggatttatcaacccgttttgatggggttaccgccacaccatgatttggtggttaccgtgaaaactacacggttatcgcgaggtatatcgtggtttaaaaactgagaaggttaccgcacgtggtaaccgtgcagttttataaaccatggttgggagagatgaagttttttgtctccaatccaacattgatcccaggaagcgcttctatagggttctattccctttgttccatattaaagtcatttttagttctatcctaagttaaacttcagtaagttttttaccgagtatatggaaaaattcaccaatgtttaaacatcaaactaattttgttaaattcaccataatatatgtcttgatggtacatttatatattattgtagatattggtgtatttgctttttataaaattggttaaagttagagaaatttgacttaggataaaattaaaatgacttgcaatatgaaacaaagggtagtacttgtttgtttaggagtaggggtgttagttatgctaacaagtactagtagtactagactactagtatgccgtgttatctgattcaggaccagaaaggtagtgagaatcattatggttcttgtgcccacgcaagactggccagatctgggttaagtgatgactactcagctagcctgtttcccttcctgaaaactcagttcataattcaggttattttgcaggtaataaagattcagaagaaaaaatacagttggatgtctatttcttttctggtcttctaagtaatgtttcacatgatagtatggagcttgtagttcttacttttgatcacaaatatccaatgccagcgaggcaattcagtaatccacaaattcatggtgtcaaagataaaaaaaataaagcaaaagagaagtcatacatgtgcttcagagaagcacctaaacagatacacttttcacagttcatggcattcccaaatgggaaaaaaatgggaaaattgctgaacatattaagagtatatatcagacataattcgagtaatcctgagaaaaaatggatttctagattctacaagtatactgctgttatctactttagtatgtttttcatttttgtgatgtgcagaacgaaggaaggactgaacctgaaagaatcttctacggttaagccactgactgcgcatctgaagaaccaacaccctgattatctttctcacttggtctccgcttcatcgatttcctgacttcttcttcctttttatcaacaaactgcatgagttctttgaagctaccaagacgctttggcctcctccgctgcatttcagcaacggcttcagctgcaatctcggcggtgccagcactatcgt

SEQ ID NO: 58299 - DNA, 2360 bp, Oryza sativa
aagctgttggactgtgagaatcgacgtcagactagcagtataacttgaattgatgatcagcacgacaaacagccatatgatcagcacaaaccgcccaagcgcacttacagtgttctgtcctgaagagagttggatgatatataagtccattgaaatgggaaaacatggaatagtttaacacgatgtcataaaatgcatcaaatggacttactgtgtgcaaaaaacattgttgagaaactaaacctgaaaaggaagaaaaaaaataatctgttactttcttactattaatatttacacaaattaacaagataaaaatattaaactatttgttgctcacgaataaaaaaaaagtaataaaggtgtttttttttttgcctccattgaataaggtttcacaaatgctcccagtctgagttctggttccagaaagatatgctgacctatgatataaccaaattcttttctttttaacaaaaaatagacatatccttaagaggagcaacggaaacgtaccaaaatattgttatcatctgccgtcttggagagcctcgaaactcctcattggtccgatgttcaagaatccaaacaactattccgacaaaaataaaaagaacacctgttacacaccacatttctaatgtgaagggtttaaggaaagcccaggcacttgaacttgcttctttcaccggcactactatcacaagccctgactcaatataaggctgtgagaattctgcaatctttgtcctgtttctcacaatagcaaagtcgcctacagcagcatcaagggactacaagaaaataaatacaaatcagaggaataaaatcaaacttttagaagaagaaagagcaaagaccaaggacatacattggcagcaaccatgttaataatgtcatcatagttaggattctttaaaccatccccaattactatgaattggcaaggaactggatacgggagaagtttaattgctgcgttgaatatctcaatgcagtacccagtcacattatcagggccagtatcacgtgacattaactccttaaagcttggtttatttggaacaccaactctcagaggctgcccattgtttggaaaaacccagcccttaggcttagaagcagagtgacccggccataccacatttttaagccgctgcgcactcgtagatgtatttggttgcttctcatatagaatttcaggagcagcaacagaaagtccagaataattagaccaatagccaatcaaatggggcacagaaccaccgatattaaggatatcatatgctgggcgtaccaaattgcggtctgaatcaaactggagctggcctgttaggcctgtaaagtttgtgaggagaagttgctgtagcaactgctcaccactatcaaataacttgagggctgagagacgcagtgtgctgttcattgaatcatgcaaccttggatctgcagagaaatttatctcctccccattatcgagaagttgatcgatagcacgggcaacaatccaaaccgagtcataagcataaaaaccatatgagttcaagccagaagcaatgctcctattacgagctacattgttccatttagatatgaactccctcttggtttcagaatcagggaagtgctgacgaagaacaattaatccttgcatatagctcatggttttaagatctccagacatggaggagtccatgacagcagctagccaatcggttactatccagacatagccactgtccatcatccggagcttgttagctatagaaaatattctcatccctgcgtcaggattgacgtgcacaacaaacactcttgattccatcatgtttgctctaaacagtacatcattgattgtagctgcatttgaatttggaggaaccgctgctttgtatgaaattcttgcccgacttaatgcaagcgcatcactaagggctgccaccgcacctctcccataatcatcatcaacaaaaatagcagtgacctctttccattgatagtagtcaacgatgctagcaacggcatgcatttggaagtagtcactcatggtactccttaaaaagtacggatactctgatgcagaaagtgttggatcagttgctgcgaacgataaaagaggaacatgtagctcattaacaacatgtgaaataacatggcctattccagaggattgtggaccaatgacagcaaccacgtttttctccattaactgcaatgctgtaacaaaataatgctttatgaatcagttcatggacaattcaagtgattaccggctataataattgacaaattgaagctgaatttgtatgtaaagaaagaaccggcaacagtttcattctgctcagatagtataagatactact

SEQ ID NO: 58300 - DNA, 16346 bp, Oryza sativa
  unsure (1)..(16346): unsure at all n locations
attcctgcagccccagacagcaggcgccaaataaattactatgttcacattgacaaataaatcagaggtacaactagtaattgaaagaggtttaaccgttttcagggatgattagaccatctgataattaccttttggatagggaatgttaaagttgtcctgaaaacaaagcaactatgtaatgttaatactaccaaacaactggaatggttttcttaataaaaattttaatgtgatgattcgttgcagattattagaaagagttaaaatgtgacattcgcacaaacgtagatactgcatttctcacattatgaaattaaactgaagtaactattgggtttctttatttgaataaaagtcatgtgggttgctttttggggggtagctataaggtttctgccaatatataatttgagagatgcatgaacataacaagatatgtatcaaagcaagacaggttgcattgaaagaggatccgaaattctgaataacctgatgttgatgtatcagcatcattgccgtcaggggcatcatcaacgttaggaaatattgcatcaatatcaggacagacatcaacaaaaggaaatactgcattaatagcagcaacatcaatactattactggcagcctctttatcttcagtcatgcatgttagtaactggtcctgttaagattatagtatagactcagtactcagtaaagggagatcagatgtataactatacataaacaagaatctctagacttaacataccgatatgaaacacattgcgagcggtgagatggctacacgataatccataagagagatttcaagaaaataacgccacaggtctcggatttcagcacaagcctcattgaactgcaacataacaaagatggctgtcagtatgagtgaatttaacaaaacaatgttgaaacaaggccatgcaaaacagaagattctcaaacctcagagcttgaaatatctgtggggacattattcagctttagcttaatcttctcaaggataaaaactccatttctgcatttttcctctcgtatttgagaaaatggcttttcttcaatattatcagctgctcgaagaaacaagtacttgaaaatatcatccatccttttgaaatgtaagacataattctcctctgaatcttgacagattgttgcattgtccgagaaatgatcaccctgatatgtatcagagatcgattctggatcaaaaacttgccgcaggttcgtccagaaacccccttcgggatgcttgctgcgcatgtgttgcaagagcgaatcaatgtctgggatcttcttgccaacacaatagggacaaatccagaacctccatgacttgtttttcttgacaaagttgagtgcatcagatatggtctttgcagcttcatggtcatcttgatagaaagtaacaaagtgtaggtgcaaatacttgagtcccaccaatcgaaagctgtcctgcttctcgcttgccagtgagcaccagtaatctctacacaccaagacaagcttctgaagcaaacgtttgagctctgtgcggatataagatttcctatcctcaggcttctctccggggatagatccaggaggcacgtcctcctccctgggatcagtaggctcctccatacggattgcccggtcacactccacttccacagaacaatacttccccatgacaaaccagagcttcgcgcggaacatggcaatctcaagcgaattgctgaactcttcaaccaaattgttcaatgcgtcgaggatgctattcagaaacggcttcttgtcaatgtttgggtcgaggccgcgcgcgaaatccaagctgatctttgcgtgggtcaagtgcgcgcgcgccgagtagccgaatcgctcgacgagcgccttcttcgcttgcttcttcgccgtggccgcgccctcgcgcttggagatgtcgagcatgtcgacgacgacggcgggaatgatcttggcggacatgtgggacatgatatggtgagagtggaagagcgcggnnctcctcgctttcgccaacctgtccatggtggtgctcagggtgcggtcgaggtcgaacgcgacgttgttctccgccgggtcggtgggggaggagatggctagggcacgcatgatctcgcgatccggctcgtagtccttggcgctggcgaccttcgccatggcgaagccggtggcgatctggacgcagttgggggcgagacgcttggcctgcgcgtagaggtcgcgcgcgtagacgaggtgcatcaccgaagcctggccgtcggagccgtcgcgggcggagcgggtggaggcgttctggtggaggccggcggcgaggtggagcacgacggcggactccgggtgcttggccgcgagctcgtccgcgcgcgcgatcgcctcgtcgtggcggccctcgcgatccagccgcatcgcctccacggcctccttgcgcagggggctcgcctcgaggaggcaccgccgctcctcctcctcgcgcgccgcctcggcctccttccgctgtttccctctgcccctgcccatctcccccccggtgcgagatcaagcgacgcgacgcgacgcgagcgagcgaggtgttggtgtgagacgccgcggcgacgcaggagatggaggcggcgacgcgcgcgcgcgcgaggtgttcgtcggaatgccgcaactgcgacggggactcgaagggtttggtggtggaaaaggcggcgcgggtgaaagctgaggggtgaggggctcttccgatttaaagagttcgaatgctgcgggagcgaatagctagggccagtttgttgaggtttctatctggactggacgaggtgataagcacggagaagttgttatacagtagcctcttttatctttatctctactacttaaattccatcgtccgtaaaaaaaacggacgaaaaaaactaaatttatccaataaaaaaaccgggcgaaaaaaagtacgaaaaaaaaccaaatatgtccgatccagaaaaaaaaggcgaaaaaaaccagcgaaaaaaaaaccaaaattatccgatccaaaaaaaatagggcgttgctcccctcaaaatgcttccttgctctgtgtactttgttcaacaggatcaagggaaacaactctccacttatttttccagtgtccttttagcactcaatgttgggcgtaatttagtgtggtttggaatctttctttaagctttggtgaaatgttggtcacggccagaaattcatataactctacccattttgttgagaaggtgctttatgctgcttggaacatttggaagcagaggaatagtttaatttttgaaaacattgttccctcttggagagttctctttaggaatgatctctcccttttagttcatagagtcaaaaattctgagagaaatacattgttacagtggttaaatttattgtaattttttcccctttattaatataaaatcttaacggtggaggcttcccctaccgtggttctttcaaaaaaaacagggcgaaagagaacgtgcgaaaaaaaagaaaaaccaaatctgcaaatctgtcctatctagaaaaaaggggcgaaaaaagaccgggccaaaaaaccaaaatagtccgatccaaaaaaaacgggcagaagaaaacgtgcgaaaaaagaaaagaaaaaccaaatctgatgcggtaaaagaaaaatcaggggaaaaatgaatttgtctgattccccaacaataattgtctggtcaaaaaaaccgggcgaaagaaaaaaaaagcgaaaaaaattaaaaaaaaagtccgacttctatccgattccctctcttatacgaaaaaaaagttcaactatagatccgattcccccttaaaaacgaaaaataaaaggcaccactccttttgagtccgatataccagccaccactcctctcagtttcaatctataccatgatatctcacacatcttagtgaaacaaaatgatgtgctggattaaagatctgtttaaaaccacttcaattgaagacaggggggtaatttgaatggttttgaaagttaagggggatagatatctgattttgaagtgaaggggtgtattttagacgaacgcaatagttcaggggggtcaaatagacttatccctttagaatttatatatatgagtttaaaaaacaaatcttcattattagaaaacacgaaggagaaatacaaggtgtaatgagggccccgaatttaatccttttcattttattattttcatatcgacattttagtgatagatcacacttcagctccaagcgaactacagttcttataattcaacgacaggaactttgctttctttttgtttcttttttcttttcttttctttttgccggattagccaaagaaagattgaccaaattttattaagagtggaggtatgtacaaaactttgctttcttataacttaccaagaatatatgaggacaacttataaagtaaggatcaataaccaatcaagcaaatagtcaaagaagcaatagcattttattataattcttcaacaatccaaaaagttagtaaaataatacttcaaagcaatagttggctagttgcaagaattctaacctatttacatttcattacattggtagctaaactcttcataacttaccaagaatatatgaggacaacttataaagtaaggatcaataaccaatcaagcaaatagtcaaagaagcaatagcattttattataattcttcaacaatccaaaaagttagtaaaataatacttcaaagcaatagttggctagttgcaagaattctaacctatttacatttcattacgttggtagctaaactcttctatgctttaaaaatgtgggatgataaaaaaagaacttagcagctgttattgatagagagggaaaatggtgagagaacccacgcacgagacatgcctcgaacaaaggctggtctaaaccctggtagcgttcttaccactaagctagcctacgttcgagtcatgtctcatacgtgagttttttttagacttacaccattttcctctgctaagttcctttgtatcatcccacaatttttcatttgaaagaaaaaaaactcttcaatgcttccaacgcaaacatgcagactcaatgactcaagtactcaaccacatttttatttcactatcattattccaccaatgcaaaaacaaatccagagataatcctctctagtctctacggtatctgtaacaatataccactcgatttcatttaactttacactgcacaaataaaagaacacgtcactgcagaagcagaaagcttcagatagctagcatggcgtagccgatgtatgctcccagcgacgtgacgacgacgccggccaccaccggagcagcggcggcggcgccactccggtcgttggctgcgggcgccgccggcgtcgtcgcgttcgccccatcggtccccggcggcggcggcggctgggccacgcctccaggggtagttgacggcgacggtgccatggccgctggcgccggtggcgagctcggtgttgacgtcgtcggagcaggcgccggcgccataggtgaaaccgacggcgatgggctcggcgtcgtagctaccggagacggcgccaagctcggggtggcggcggctggcgcatgcgacggtggcgacgacgccgggctcggcatcggcaccggcgcgacgggaggaggcacagccggcggcgacggcggaggcgcgtggcgccgccgcggtctgccatgacgacgacgacgagcttctcgccggcgcggcagttggcctcgttgccgctgatgaagaagaagggccccgacctgtcgaacgtgaacaccgtgttgccgtcgtcgtaccttccgccgccgccgccggccaccgacgacgacgtgttgcacgcgtcgtacgccccctgatccaccaccaccaccgcgtccatctccttcgggtacacgaacactgcaccaaccaaaaaaaaaaaagaaagaaaccgtgagatcatcaccacgcttgcacggccggcgaaatcctcgccggcgatcatctcggcggcggcgcggcgacttacgcagctggtcgccgatctggaacctcatcctgccggcccacgagttgtacggctcggcgttggcgtcggggacgctccagcctctgcctcctccgactctgaactgcgtcgcgctcgccgctgcggccatgagacccaaccacgcgagccccacactgacagttgccactgctcccgccattttttcttgcacacttgatagttgataccaccacgactagtgatcgatttcactgcagtgctgtgcctgatctgatcgatcagacaaagctgggttgctgggtatttgtagtggtgatacagaaattcagaattaatgaattggagacttggtaataataagcctagtcagaggctttgtctgaatgcaatggacgtgtcactttacaaggagttagcacttgccacaggttgtcactttgattattactaattgggtatttcattggcataatatgtgttgtacaggtgatggtctgacagagtgacaagtgctcatgaaaattcacagtttaatgcttcgatttggatacgtatccaacgtcattttcagatgagggatgactcgagaagtcgagatgttaacccacacacatggcgaggcttgaggcgacgacaccatgcgttggtcggcagtagtagaaggattcagaaaagaattctctgcataggcggcgagcagctaatcttatctatgcacagagagagattcagagaagaatttgagttcatcttgtagttcagaaaggacaatcattcatgtcatagaaaaatttcagaagcctcctggatcgaatatagtaggtgtgttggaacattgtgagaggaatctctgaacaaacagcagtagtaacattcagtaaaaaaaaaaattctgagaatttgatttggtaggggctcttgcgtcctcctagaatgctcaaagatgctgtaaaaagtttcaggattggtcaagaaggcagggagcatggagccaccaaatatgacaatttttttcaggaatagacaaaagacttgcgcatccacaaaatctgacaatgtcttcagagaataattgttcagactaggtggaacatttttgtttattcaccattttcaggtccggtcaacttttcaaacttcagaaatagccaaaactcaaaaaaagcagtacaatgcatagtttgttcagtcatggacacattacacatgtccctaatctagacgcttagcatccatcacaacgctcatacgattatttcaggcgattttattctcctcctgatcgaacagcacgaagaaaacacacaccagaaaactatatgaactgtcattcaaactaggcgactcggaggccgccacgcaactcgctgaaatcaccgcacgctgtcacaaacgaggaggaccttgacctcgacaagaaggagctcgcggatgatgctcttgctgccttcttcctcctcgggttcttggggcctctcgggatgtcatggcagcaggaggcggcctcctggccggatttgtctgtgcagacttctgttgggagcgtggctcttggtggtttgtcaaaatctgcagcaattcaaagacaaaacataatgaaatgagaggaggtagggtgacatgatttgttaaagaatggtatgattcaccagaaagactgttaggccttctcggggatatgggaattctacatgaattttatgaaaatcagttcaattctctcgagaatcgcaaagagaactcctgaggacttaacctttctcatgacttctgaaattctgtttgctaaacgggttgggcaaaagcagattgtgcagggtttacatgataacccactaaaatcatgatgaaactctttcaagagaagaaaaaaagcatgaattcagtcatccaactcagtcaagagatcggagctgcatcagtggacgaactgtagagaggcacgccacctcactcaccgacgtttggtcccctgacaacacaagatttcccacgaaagatccgacatatcactcctccagagttagtcagcaaggggcgacgctgcaagtctgaacatcgcattccaccaggatggggacagacaatggcaaaaaagggtgcaagtgctgatatgacaatcaagtctaccttgacaccaaactaggctgaagtttccaaaaccagaattaatggagaagagcagacagagcaatggtatggtatgccactactgtagaacagaaggttcaagcttgtactggagtatgtagattctgaatcaactagctagacacaagtacatgactagttatgctttcttgcatgagcaaaggtttcagacatcattagcgtcccgtcccgactgaaaacttcatgaagagcaaacactgaaaaaggagcgcataagtggacagaaggaagagatcgagggagatacttgccttgagatgcccaggatgtcttccttgactgtgcaaaggagcccatggagcctgctgacaactcttccaatcctctgaattcactcatctagtaaaattgccataaaaaatcacaaccagagaataggaaaatgtatagatcattgcaaagaagattacttggagaaaccttccagctatgagatatgagatccttacccagcttgggcatgaatcactagtgcccacgcctatgtgagacacatgcctgacgtctgtagggcacccgatttccatctcttgttgcttctgcagtgctggataaccgaaagggagcaatggtcatactggtatataaccaatggtatagaaactgtgcattgctattgtggttcagctaattcatcaaaaactgaaaatagaggtagatgcagcaaagataaacaatctgcttcgcttaccgaatatttgagagattatcttcaaacctttgaatatccccttcatctttatctccattggtgaggtgcctcagtactccaaacaaagaaagaacataagtgtcctgaaggaaatactcacgaactagtgtattactttgccatgcacatatctaagcatcagttaatcttcagaatgtggggtagcagagttcatgcatggagaccaagatcatacactgcatgaatttgtgtatgactgctgatcagaatagggagtcacttccaaggtgaatggctttattgactgtgaactagaacttgtcagcaggcagccatttttgcccctacactggtttgcagttttctcctatcgcagaagcaaccagccctgcttcctaattattggacacactacacaccagaaagagggatgagaaggaacagaatgggctgagagagtgtgagaataagagtaagctcaagactacttaaataaaggtgacaactaacaagttagctggcttttcctattccaaaagtctgctgtcatctcatttgggccatttcataagacaggtgtatatttgataacatgtgatgttttagctgttcttgatcttaatgttcaaggattactttatcgtgagcttaaatatgccatttctccctaaacattttcttgctagcgcttaatttctgcatgatctgctccagatagttgcatattaccaatgcaaaagatttgttgcatagtcactctcacatgctgctgtctttgacaagttaccataagtattctgggccagtctccaccaaatagaatggaacgaaatgttggatctatgtgatacacattttacatgcacaatagcttgatctacctgaattcctttgtgccctccagtaacatcctaaatttactcaaaatcatccaagcaagctacttgcatgagtatggactgaagaagaaaatgaagtgccggagcaagtgcacctgcctagttttcacttggcatgaaaagagaatacagccttgcttgaggtagattagatccttaaaagctgagttttgctcaaatctgtcctctattaatgcatggggtctgatggtcctatttccttttaatcatcaaacaaccaaatgtttggttataaagtatggtcttgaccttgaactgtaaaaattaaggtaataacctctatgtacttggccgtgcctaattattttgggtagaatacattggaatagagaatgttatagactcataatattgaagataaagcttgtagaaaaatgaatggcaatcattaacagttagatgaaaaataccactacctcgtcccaaaacggaccacattaaatttggaccaaagatattatctgaagcgtacacttagatataggaaaaccatataagcatttttcttaactaaaaatatttccatgctgctatcatactttatctttttatcaacttaaattaaattcagtggtcccgtagcaacctatgtttgacacctaagtgtagttgtgagcagacttaattcttttttctgtggatcataggttttgcttacctagtctggttcttactttcagttcaacatcagcaacaaattttttgggtgctagtacttctctgggctttgcctattaaatctgtactctttgagatattaaaggcgtaacagataggaaacctgcaaacactaagagttaagctggaatcgtccccagtgacaccatgcctgtactcttgttgcttactaaaaaagcagggtgtaaagccttttctctaaacaagatactaactaagaaaatagaacataaaacaatatagaacttcactgttgttatataaggacttcatggaactgcttgtcttcattagtaccttgccaggatttcaggcttcataagctgcaggtaccttgcaaatatagaagttgcatatccaaaacagatttcagaacatcattgttcctcatttgcatagtgatttggtctacgtcccttaatataatttcaaatcgaccaaaagggacacctgttatcataaaacaaaatggtccgttttatcatgaatatggaatagtcagtatataacatattgtattgatgaaagatacttttttttctcaaaaacgcaagagccatgcgtttcatttcattaaggagaagaaaaggtatgtacagcagagtgcttcacaaaggaacactctgaaaaaagaagagaaaaacacaaaaacatcgccgaggcgatgcgcaacaactcccgcaggagctaagctcctaggtggagagcgaccgggccaagagttcatgaagagctcttgccccagcagtacacaataataaactctcccttgccaaagcatccaatacggcagcagtactaggtgtggcattgttgaagatgcagtcattccggtgtttccaaatttcccaggccactaagataatcacagagttcagctctttcttagcttccttagagacacctctgaccacatgggaccaccaactagagaagattagtcatcacagcaaagctcttattctgcaatatatttttatattttcaaagtttcagaagagatatgcagtctcttgcaggctacatcagggtcgttgggatatggaagatgctccatttttatttgtgctgaaagatacacattgttaatacaggatattaacttgtaggctagtcaacagctatgctctttttgtggaactttatgcaaacaattgaaagatgcagtttcttgcaggctacaaacaaacaaacatagctaccaagttgaagatgatggcatccaaaagcaaaacaaacatctcatcttttgttttctttttttttcctgaagacgagatctaatctgaacgatcatgccttgcacctactatacccaaccactggcattgtttgcaatttaggatgtgggcaacatacttagacctatgatggattcctggaccaaatacttgcagatatggtccatgacagtcacaccacatctagctatctacatacatagtaacaaccactttactgatgtagaaactagaaagttaaaatacttgtcattaatcaccacactgtgattgacaacttgtcaagtgtactcgtagtggttggtatattaagatgctgcttaggtgagcactataatgaaggctgaagcaacagagtaaatgagtaatctcgcattagaatatgatactcttcaccaacttctcttcgctgtctttctgataccgtataactgaatattggtaagaaaaccgaagtgtggtaagcttggaggattcagaatgtacctgaagctcggctgtctctcaattcctcgcatagtatctgaactctgaagaggggaaataaattgtaaattaaccaaaaaaaactgcaattcaagacaatagaattggtgaattgtgactaatatgacatagttagtagtactcctaccaactaatagagtatcgctgacactgggttaaatcggttgccaagggcatgttcagacttcagagaattagcgcacacttggagcactgtatcactatctgcaggtggtgggataagggatatcgaggcctcttcggctgattacagcttgagcccgccgcaccgccgcgccccggaggtggccggcagcacgcggggacacggcggcgaccgtgggggcgggacggctagccggagcacggaggccatgcatggaaggaatacctaggtagacgtaggccatacgccggcgatccgatacggcgaggccgcgggaggggaaaccccgacgtgctccaggctcaccggagctccgccgcctcgccgccgaggggaggtataggagggggaggaaggcaacaagggtaataataaaattagaaatagtgcgagggttttcgcagaaaatgcagattttttccgcgactcaatccggaccgtgcatgattaatccaacgtccggatctattgtactccgtatttaatgttgataaggcgatgaagcgatcctaaagttttacaaataagtggtctcatcttctcgcctatacttatacttaagcttatcagccaaaatttaaatttttaactttaaatttagagttgattttgaagttttctcatcgaagtttatttttcagcctttgcttttagatcgctaagaacacgtatataaaagttttattcacaaattatttttcgtttgcaaatatgttgtaaactcgggaccacatatttggatctaacatttcctaaaattttaggattcttttacataattgatagaaatcccgtctttatatttacagttggatattaatagccaaattttacaaaagcttcgaaacagctaaataaataagagaactagaagattataaaaagaaaagtttatagatactaagcttcaaacttctttgaagtcctatagctttatactcctacatgctctttcttatgtagcaacaaccctttatatcacaatttacacaaaaacttttgatattgaaatcaaactatggtcaatagtcatatgctgcttgttcactcctatcgcactaaatcggtagcgaaaattgtggcgctactattcctagtgaccttatgattttgcaggaaagttttgatttgtctcgctaccattggcggtaatcataattatttttagaaaaaaaatcatatttcagtcgctactaattatatcgattataataataatgtacaaattgatccatttttaattgcttcacaaccatctacatcggtgtccaacaaattcgtagaaccaccctcatctgcatctgcctctctcctccctcgccgtggctactttagtttcctatctgtcgaggtctaacattgttgctgacgagtgacgacaagcttaccattactacagccctctcaccttgagacaacgatccaagggtaacctcaagaaaccagctatctataggtggcaaaacggattaccccgcctgagcacgacgcgtgccccgatggcggcatggttaataggccgtgtcgtactgggccacgtggccttggtcgagaaggctacgggtcattatgtgcaaaccgctagaggtgcatgggttgttgccagcccatccatatatttaaccctataatttgaaatattaggctaggaaaaaagataaaagcagaaaaaagttaggaaaaacatagcgaaattaggagaaatgaggggaaataggagaaaatatggacgagattcgctaaaaacgaaaaagaaaggggccatgccatgccggcccaagcacggcacggctagatgggccgctccgtacctgggcctgcacgggaaggctcggcccatatggccatctatacagcggtccaaagtgtcttcatccgatcggcctctcttccctcgctgtgcctgcttcggtgcttcctctccccgtccaccggctgccggagccaatgcagacggccggctcgccgtcgccatggccctcacacctgacatagctgctaggaggcaaaccaagaggattaattttctaaccaatggaccagcgcaactgagagtctgaaacaaaaacaagatgcctgtccaatctcttgtttttgagcaatttttctatgcaaaagtaaatgatttgagaatgagtttatgtaaatatcgcacttatctgaatgatctacaatagtagagtacagggtcaggaagcagtacacttccaaagaattaagagatgttgagctagatttcaatagctatcttccaaagcaatagcacaagacatcctgtattcagatgtagcacgacaatcagacaagcagctgtgttcgagaaaccaaattcagaaaattactgaagcattgttcttccttttcctctgagtcacttgctcgctatctgaagactgaagaggaggcaaaagaagtgaagtgggataagcgcataactctgatgaaacaaaaagacctgtgactttgtgacattgttagtaggacattatgtcattaccttactgaagttacagggaagcttgttgcagtatagtaagactggagagttcattgcgttatatatatatatccttgaattcattatgctttttgtctgaacaagagaaatggccgtgaataagagcaaatatgaatgggattgttagttttcggctgaaagctcagagtgtgtaattcgttcaaaaaaaaaaagaagctcagagtgtgtctctagactgtagttctctacttatttccacaaccaaaagagctggctacaagaagcaatattgtcgaagaaatttttcatgtcatgtataaacattgtgtcaaagaatctgaatggacagacttctaaatatatactctctgatcatgactactagatcttggtattgaaacaaaataggtctactagatcaagatattgtttccgacaataatgatttgtggcaaagatcaaaagaattttgtccaaaaaaatatgtcaaaagaagaacgatctgtgcggtgtgccatttcaatactcacagtaatattccaatcgctggagactcttgccattgtctctgaacccaaataagttatgagagtaacatattctcaaaatacaaataatttgcgcaatgagattaagaaaaaaaaagacattggaggaactcgatggatacgcataggtacgggaactgaattcaatgttaggaaggaactaattctagaattttcatggaacgctcgttctagtcttctagattatcctagaacattcaattcataagaaagacttctgaaatcgaaagcagaaacatccacataattccagcttggaggctcataatagtcttgttcaatatgtatgcaccccgcaactaatggttcaattcaaccgagcctaacgaatgctgccacctgcctagtcatccaatgcacatattgttcttatcttgctcatcgttaagcatagttttaatcgccatttggccaaacattaactactattagtcctggaattagcttcaacttgcagtacaaagaagagattagttccaactaaaacacgtcacgagtggtttggcattagttgcagggtcgttttcaattgtatggccctattaaattacgacggagtcgtcggttgatcctacaagtcaatgatgaattgcgtgtttgtttacctgcaagtgtcatttaagcaattggttgctgacttaagagccaccgtaaaacatgctgtcctgatcagcttgggaaacaaaaaaataattctcagcaaacagctcctttcaccttacgcacgtagcacaattttactaacaaaatctagtagcattagcaggattagatgacaaacgacagcaacctgcaacctcatcagttacccacattccctaataaaccataatactccctccgtcccataatataagggattttgtgtttttgcttgcactctttgatcactcgtcttattcaaaaaattttgaaattattat

SEQ ID NO: 58301 - DNA, 3374 bp, Oryza sativa
aatcccttatattatgggacggagggagtataatacaaattgatttacaggtaaaacttttgtatatgtgtttttaatgagctattactccgtcccaagaaaaagacaaaccctagctatgaacctatgtccaggtttgtagctgggattaggtttttttgggacggaggaggtaaaagacaatgtttaaaaaaactacattgaaaatattttaaaattaagtttgaaaattcaaattttagctttgactttggtttattaaatcaaccgatggagcccttgagcaaatccaggttgtcaggttgacattctgattaaaatcatgtattgtttctctattttcgttcatgccattgattaaaatcatgtagtgttcagttactagttttttgttcatgctattcatctgattatctgaagataccttgcctagacactactgaactgaactgaacgcggcacgccaagtttcagactttcagtaccagtacatgagtacagaactagaaatcctttacttacaacgagaaaaactaacactacaagaaaccatctgattaaaaattttgatgcagttcagctgcaaatactgcaaagaatctctacaaacaaacagtcatctgaagatgagagataggaatctctctcaatctctctcttctctgcaatgcctgtctattgcaaagtcactgtgattctcaaacgaggaagacgacgacgagggaaaaccaaaaaccagcggataagaaggaaaaccgcctttgcgaaaaccacagcctctctccctcaggctcagcctcagcctctcgatttttctttgatttttttattaaagcaagaatggtccttggctcttgctggtactaccagcgtgtggccaaatcatgcagctttgatgatggaaaaaaggaaagaaaattcaggagagagagaaagagacgtggggtgtggttggaccgcaaggcacggcgccgtagccgttggcagatgcgcgtctccctccgtctccgttatcacgtcggcacgccgacgtcgctgcgcctgcgcgtgggaggccagggcagatgctacgtgccatcaggaatgtcgacctgatgattattttgttgatcatgattttcttttggctatttgattttttgaaagatatttttttccctgggaagacacctatgggacgaagatattatgtttcttatatagcaccaaacaaatttaatatatatatatatatatatatatatatatatatatatatatatcacatcagtctctgcacaaagtgcatcctgggctgcttcaattataaagccccattcaccacatttgctagatagtcgaaaagcaccatcaatattgagcttcaggtatttttggttgtgttgtggttggattgattctaatatataccaaatcaatataattcactaccaaaatataccatagccatcacaactttattaattttggtagcttaagatggtatatataataaccaattaacaactgattctaattttactacggcccagtatgtaccaatacaaaacaacgagtatgttttcttccatcgtaatcgtacacagtacaaaaaaacctggccagcctttcttgggctggggctctctttcgaaaggtcacaaaacgtacacggcagtaacgccgcttcgctgcgtgttaacggccaccaaccccgccgtgagcaaacggcatcagctttccacctcctcgatatctccgcggcgccgtctggacccgccccctttccgttcctttctttccttctcgcgtttgcgtggtggggacggactccccaaaccgcctctccctctctcctttctttatttgtctatattctcactgggccccacccaccgcacccctgggcccactcacgagtccccccctccccacctataaataccccaccccctcctcgcctcttcctccgtcaatcgaaccccaaaatcgcagagaaaaaaaaatctcccctcgaagcgaagcgtcgaatcgccttctcaaggtatgcgattttctgatcctctccgttcctcgcgtttgatttgatttcccggcctgttcgtgattgtgagatgttgtggttagtctccgttttgcgatctgtggtagatttgaacaggtttagatggggttcgcgtggtatgctggatctgtgattatgagcgatgctgttcgtggtccaagtattgattggttcggatctagaagtagaactgtgctagggttgtgatttgttccgatctgttcaattagtaggatttagtctctgtttttctcgttgatccaagtagcagcttcaggtatattttgcttaggttgtttttgattcagtccctctagttgcatagattctactctgttcatgtttaatctaagggctgcgtcttgttgattagtgattacatagcatagctttcaggatattttacttgcttatgcctatcttatcaactgttgcacctgtaaattctagcctatgttaattaacctgccttatgtgctctcgggatagtgctagtagttattgaatcagtttgccgatggaattctagtagttcatagacctgcagattatttttgtgaactcgagcacggtgcgtctctctattttgttaggtcactgttggtgttgataggtacactgatgttattgtggtttaggtcgtgtatctaacatattggaataatttgattgactgatttctgctgtacttgcttggtattgttataatttcatgttcatagttgctgaccatgcttcggtaattgtgtgtgcagatgcagatctttgtgaagaccctcaccggcaagaccatcaccctcgaggttgagtcctcggacaccattgacaatgtcaaggccaagatccaggacaaggagggcatccccccggaccagcagcgtctcatctttgctggcaagcagcttgaggatggccgcaccctggccgactacaacatccagaaggagtccaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccggaccagcagcgtctcatcttcgctggcaagcagcttgaggatggccgcaccctggccgactacaacatccagaaggagtctaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagacca

SEQ ID NO: 58302 - DNA, 1041 bp, Oryza sativa
atccaggacaaggagggcatccccccggaccagcagcgtctcatcttcgctggcaagcagctggaggacggccgcacccttgccgactacaacatccagaaggagtccaccctccaccttgtgctcaggctcaggggtggtatgcagatcttcgtcaagaccctgaccggcaagaccatcacgcttgaggtcgagtcctcggacacgatcgacaacgtgaaggccaagatccaggacaaggagggtatccccccggaccagcagcgcctcatcttcgccggcaagcagctggaggatggccgcaccttggctgactacaacatccagaaggagtccacccttcacctggttctcaggctcaggggtgggatgcagatcttcgtgaagaccctgactggcaagaccattacccttgaggttgagtcgtccgacactattgacaacgtgaaggcgaagatccaggacaaggagggcatccccccggaccagcagcgtctgatctttgctggtaagcagcttgaggatggccgcacccttgcggattacaacatccagaaggagtccacactccacctggtgctccgcctccgtggtggccagtaagtcctcagccatggagctgctgctgttctagggttcacaagtctgcctatttgtcttccccaatggagctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctgggctgcaggaat

SEQ ID NO: 58303 - DNA, 5137 bp, Oryza sativa
gccagccggtattatggctgtatcatcattcatcaatgtaatcagcttaaagctttcactacattgagcatgcacattgctttatcatggtccatatggactaatatactgataaagatgtcttgctgattctgttctctcttgagaagaaagatgaacatgtagattctagagtggtcctgaactggatcgaaataactgaaactaactgaacctactagtttgttcatcagagaaaagtaggagcacaccatacatattggcattgcgtgtaatacatagttatctcggcactgtaatttttgctggtgacaagttattccaaaagttgtttcaattctctgaacttggaagagattcgtagctaggctgcagtataggtagccaacaaaagatgtgaaggctataggaagttgcttttgatgtgttcactttcttttccctctgtaaagccttgtttaccaaccttatctctcacaggagatagatatcatgcccgtgaagacaataatgtgatgccaaaatgtcggctaaaaaaagcgaaatctcggttgcttttaatcttagcatttattcattcaattatcagcaataacatacatgaaaactttaaaaatgtgatgctaacccaacccctctggttacagtaggaatctgaattgtcaggactcaggacaaccggtagcaatcagacttggctgtcggtgctcgacaagaatcatcaaccaagagcccaagaacatagcaatgtggtaagcaatgacatggcctttaacctaacctgaattttttcatgggcacactgatagattaggtacagacactgccattgtaacagaagagaccggagcaggaaacttcttgagctgggacagtttcaccaattagagctggagttgagtttcgtccatccttgcaacccaatcagatagatagatattcagattccaactaggcctcgcatgcatgccctacccattatgaattgtgatagatacaatgtgagccatgcatcgtctactgttatactagctttgtgtccttgttgctactgctattcagttttaaattgtaacaggtagaatatcctactgatcaccaaatctgctgcgatttgctgcttcttctccaatactgaatgtttggagtggtatactgaatgtgagacaatttgttcagtacaaaatgtacagctgtacatgatgctgcaatctgaacttctgaagtactggagggtgtagcaactactaagtactagtactagcaagtgccaaaggaaagtgcagagatggacatgttcatcacagttgttcatgcattgcacattgggtggccatttaatctgcgttcatgtggaccatccattcttctccccttttcttcacattggagtactgaatacggattatggatggagctggatcatatgctagatacagacagagaggagagctaggaagtgttgtaaagaagcttgcaggttgtgataaggcctatcttggcatgtattgccatcttgaccaatgttacaggcttacagcaccagattgttgtgaatatgaaattctgaatgtactgtcattttttcagataatatctgaaactgagtaccccatcgtttagcctcgagcttataagtataagcgcaaatttgaattttaaaacttaattttagagtagtttattttccatcattcgtatttaaatcgctaagaacatacatgatgcatataaaagttttattcataaattattttttaatcattaataagacgtttcgcttataattaataatatgtataagagggacaatggatacacaatacattcatcgtttcgcttataaaagttagaacatactagttcagagtgtaattttttttcagatgaatcagtacatggtctatttttcagagtgtaattctttgattggcagtatcgtctcagatgccattggtgacttgatcacctactagatgctaacgaagctgtccattaccaaacttgtgtgtgtatatagtattagtacgttctcctctacctaccaaactcgtctgattattttcagttgcgtaactcccctaattataatggcgcctaaaccaaaccccaagtaaatacaaatacaaacaccaaaactgaacaacacactgaacatcactgtatttctcactgtctctctctatatatagccgagtgcactgccactcagagattgtcagagaaagcagctttgagcttagctatggcaatggccgcgccgctgacgttggtggtggtggcggcggcggtggccgtcgtcttcgtcggcggcggcgtggaggggtgggtgctcaaggaggggttctacgagcagagctgcccgcgcgcggaggcgctggtgaagcactacgtggagcagcacgtccccctcgccccctccgtcgccgccaccctcatccgcacccacttccacgactgcttcgtcagggtaagcgcgtatagctcgtcgatcgatcggcgtggcgcggcggcggaattctgacggcggcgacggcggccatggcgtggtggttttgaattgtaggggtgcgacgcgtcggtgttgctgaacgggacggacggggcggaggcggagaaggacgcggcgccgaacctgacgctgcgggggttcgccttcatcgaccgcatcaagagcgtggtcgagagcgagtgccccggcgtcgtctcctgcgccgacatcctcgcgctcgccacccgcgacgccatctccgtcatcgtaagctagcacctcgctcctcctcctcctcctctcccgcatttgcgatggccggcgagctggctgacggcgagcgagcagggcgggccgttctggcgggtggcgactgggcggcgcgacgggagggtgtcgatcaagcaggaggcgctggaccagatcccggcgccgaccatgaacttcaccgacctcctctcctccttccagagcaagggcctcgacctcgccgacctcatctggttgtcaggtaaactaactattcactcttccatatattaatttcagtattaatttcaccatccatttcagagttcagacttcaccatcaatagtatttccttcgttccaaaacaactataagtttccgcgcccaactttaatcgtccatcttatttaaaatttttttataattagtatttttgttattataagatgataaaacatgaataatattttactcgtaacttatgtttttaatttttttcaaaaaaaaattcaaataagacggacggtcaaagttgaacgcggaaaaccatggctgtacttaaaatgggacggagggagtaaacatttttagactttgacatagtctttgagatggtattttgatcaacaatatctataaaagtgagatgttttaaataaaaaaaagttgtaatagtttgttaatgataagtctagtaacatcaattttacatgattgatttttttttatttttttactattaatagttaaaattaaaaatgtttgacttgacactattctaaaattgcttatattttgaaaattagttgcggtcgatcaaaaccccagtttcagcttatgacagcatcgtttctgaaaagaaaagtaaaaccattcacctaagctaatgattggttaacttgacacaaacggcagccaaagatcgattttcacgttatatcctaattaagtcgattgattactagtcttcaggatacacaactcgatcaggtttggtgttttatctagcttgatgtagctagctatgtggtgtttgcaaatgcgtagtacaagccaccgacaaatagtgaattggtgatgtgatatcgtgctgcaaaatctgcaatatgcagagaacgatagttaacttttgcaaattctttgtgtgttgagtcggcaactaggacacgctctcactctcactcacatcacaccccagtaatgctgtccccaaagattcagaagatgaaagatatatagcctcaatcacaccgatttccatgtagtaacaatactaacaaacaacgatcctaataggaacactacagatgccgaatttctatccattatctaaaaaactctcgtgccacgacaatccagaattgaacagacagctacgtccaacagggagggttggatctacttaattcatagaaggccaaaacttagctgaatcttgttcacgggtatcgcatcaaatcaaagttaaaaacagtttagtaggtatagcgatctaaccaacagataacgaggcttttagttgacggctggcaagtctgttccgtgcaataaaatgcaattcataacactgcactataacaaatatatcttatagagatattttcatttttctaatactatagaggcatttttaaaatgcctttacaatgttatagagacattttgaagagtgtctcataagtgccttttggtgaattgtcgcatttttaaaatgcctttacagtgttatagagacattttgaagagtgtctcataaataccttttggtgaattgtctctacaaactaagaggtgaattgtctctacgaactaagaggacattttgaagagtatctcataagtgccttttggtgaattgtttctacgaactaagaggcattttataagatgtctctatgcaaatagaggcacgcactaaccatctcaacctcatataattatatgtaagtatgtgatttgtgttacttatatctagttacttgatatatattaatatttgaaaaaatgcctttacatcgttttaaatgccttaagaaaatgcatttacatatgagacaaattttaaagtgccgaaaatgtgtctctacgagataaacttaacaaagtatactaaaaatgtctctagagtaaaaatattttagacgattttgaaagtgcctctaaaaagtgtctctagactatagagcttcaaaacttagaggcattttaaaaattgtctctacaaaagattctttatataaggtttttgatgtagtgctgttttatttagagagtgtagcacagatattgacacactaactgaccaagatttttattaacgttagtggttaaaggtgtgcaaaaaatgccaagacaaacattcagctcttgtactgtcctgtatctgtacttgtgag

SEQ ID NO: 58304 - DNA, 17727 bp, Oryza sativa
aaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccccctgccctgccctgccggaggcgaggcgagcgagcgcgcgtgtgtttcccctcttctctccaccacacatgcttcaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatggactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttagagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcgacaagctaggatcataaggtgttggagaaggcttactatcaatgtagccaaagcgattcaagatcttctccacataatgagactgcaagagtgtaatcccattctcacctctaattagcttaatgtttaaaataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaagtacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaactttagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccataactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcatcggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccccctgccctgccctgccaggccaggcgaggcgaggcgagcgagcgcgcgtgtgtttcccctcttctctccaccacacatgcttcaagtggctaggagggcatcctcccttttaaggaggtccccctctcctagaataagcaaggtggtactaaactccacatgcatgccatcctatgaggtgggcttttgtgattttccaaagaattaatcttcgagtgggctaaggcccattcattaattccaacactagctagtagtttgcgtcattgattctcaaaattttcatacaaatataccccctcctcctcacatcgatctcttcaaaatccttatattatgggatggatggagtagatagatactatgtagtaccagtgagcaatgatagttgtgatgtagacatgcatctgcatgccacagctaattacaccctcgtgttgatgtagtcacgtagatgtcagcgttaaatggatgttttgatgttttctgaagttgtagtatagtactccgtagtaggtctaacgttgcattcttaattaacactgcatacatatcacttaagatattcctagcttagctaccgtccacatacttgaggttcctagctagatgacaatactacgtgcaagccattgcaggagctgaatatcttgtagtacttgcgcatagttgcatggtccagaaaaacagatatccagtacatctctcgttttctcccattaattgcagagtactgggtatctgatcagttaatgaaatccgcaaactgctgaacaaccatctacctgtagatttcaattgaggatttggactaagataatatacaaatggtttttaggtacaaacttcagagaaactgcacttgcactggttttctatgaaattcaaccactcagttttgtcaccgaaccatttgaaatgggttatttggattattttcatataaggataaactaaatacttttagaaataaacttacttaacaaaataacaaatactatgctgagtgaagaagtatagtgctgtagaataagtagtttagaagcaatatcatagaaaaaaaagtttttcgagaaaacatttctttttagacgtggagtaaataatctaatatagtaattgaaaagcactctcttcgtttttttaatgaataacactgttcacttttaaacatatattttatcattcatctattaaaaaaattttatgtaaatgtataagatataaatcatgcttaaaatactttaagtgataaaacaactaacaacaaaataaattataattacgtaaatttttaaaaagatgaatggttaaacatgtgataaaaagttaacggtgtcatttattaaaaaacgaacgaaggtagtagatgcttttaatttacttctgaactcactaattgagttgatgggtgcaggggcgcacacgatcggcatcgcgcactgcaactcgttcagcaagcggctgtacaacttcaccgggaaaggcggccccggcgacgcggacccgtcgctggacgcggagtacgcggcgaacctgcggcggagcaagtgcgcggcgccgtcggacaacacgacgatcgtggagatggacccgggcagcttcctcaccttcgacctgggctactaccgcggcctcctcaggcgccgcggtctcttccagtccgacgccgccctcgtcaccgacgccgccgcggaggccaacatcgccagcgtggtgtccagcccgccggaggtgttcttccaggtgttcgcgaggtccatggcgaagctgggcatggtcggcgtcaagaccggctccgagggcgagatcaggaagcactgcgccctcgtcaacgacatccactactagtattatcactagctcatcgatcttcagctcctcggtgcttgataaaatttcagtagaaatatatatacatgtaacttaattcgatcgtcatcctgtttattctctctctctatgtaattttgtttccaaattgtaactgttttattttggagcaactgtaactatttctgtatgtgcccatgaatatatttcaattatagaaaataattcactttttagtcatagatatttaatgtttaggataatattcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagcattatgccataacttaaattattcattgtcttgtcagttatgaatgtatagctcattatgtgtgggattagggaagaagagggtgacatgggcaaatggctacatctaacgcctaaaaaagaagtaatggtccagatttgcgtaggtggatttggaaccaactctaggggatctgcacctgtagattggagatccatccggactttgctggagaaaattttagagttgagcaccctttaggtctgcacctgtttctagatgttcaattcattggaaattgatgacccaactgatgggcaaacacatttgtgaattgaaaaaaagattgcatgagtactgattaggagctatgttaaaactcagcaatacagtctgaattaaggttgtttgtgtgatcattcggacacaaatgatgtgcatgatgccatgacaacctgttccttctgcaatctaatttccttctaggactagataactaaagccatagtttccatgtgaaactgttatttattgtataatgctaaatggtaagattttcgtattgataggaagcatgaaggttgatgatggtcctggcgtcaatggcagtaggtgggccaaaatgatgagcacagattcgtggaggtggtgtttaggattgatttacattgttgctgttgcgagtatatggattgctgcaagctacattgttcagtctgttgtggatgagggtgtttctccattcttgattacctacatatgcaattctctatttgttatttacatcccaatagttgaggctgcacgatactttgaggattctatcaacaacttttggacaaagttgaaaggcaaggatgttgcggacctggagcagtctgctgatctggagagcataaatcttctccatggaagtgaacaagagggcaatacagcctcaccaacaaggttgcctgaagacatattggcttcagaagcagtcttccctgtccaggccgagctgaatgtagcagatggcagcaaagggttggatgcaaaagggcgctggacacgtgctcgtgtggctagagtcagcatggtagtctgccctttctggtttctcgctcagcttacattcaacctgtctctaagatacaccactgttacagtaagtgttactaaggcctgcatttccatgccattatttaacctcgctcctgtccattggtaacatgtccttgtttctttgtacctgcagtcaaatacgatattgagcagcacgtctagcctcttcactttcttggttgcactagtatttcttggagaaacattcacgtggttgaaactaatcagtgtacttctctgcatgggaggaacgataattgttagcctagctgattcaggtagtacagcgaataccattgccacaaatcctctacttggagatgtcctttctattgtttcagctggattgtatgctgtgtatatcaccttgatacggaaaaagctgcctgatgagaaagaaggtcaaggcgaagtgagcatggctcagtttcttggattccttggactgtttaacatgttatttttctttccttttgcattgttcttgaatttcaccaagctggagccattccacaggctgacatgggagcaagttggtcttattgttggaaaaggtaggtttgcagtttacgcatgaccataatgtgagctataataatgcattgtgtttgtgtgtgtaaacctttgcgttgttttaaatataacattgtaggaagtcataacggaataacttcgtaaaagatcataaaagctcaaactatccatggactagcactaacatcaagctgttgtgttctttacaggtttgttagataatgttttgagtgactacttgtgggcaaaagcaatccttctcacaacaacaacagtagccacggctggtctcacgatccaagttccaattgctgccattgtggatacactaacaggtcatgctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgatgatccagtctatttaccaagtgatagaaatgctactggtgctgttcaataaggaccggcttggctttggagtttgtcacaatgtatatttttttcgaggaaaattttcataatgtatattatcaagtaatgtataaggatgcgagatcagtacagttactgtaattgttcccccttgccatgaaaatcatagagaaggggatagacagggattgaaattagattaacatgctttccttgctcataattttgagcaactagccagttgtgttcgtttttgagttaagcatgattatgaaaacattcaagagattgaatagaacatgtgtgtactaaacattcaaaccactcgtgttcttttttcttttttttgtcgggagcttagatcacactcactttcaagagattgaataaaacatgtaccttttgagtcgggttctatctattattttgagtcgttccgcccatagggtggtgtcgtagatgcaccttggtaaatgcgatcatcttctagcaatgagccaatgagaagttgagaacgctaaccaagaagccacttgaattaggaggcaatgctaataatcctgatggtgaggagtgatgctttaggaaaacaagggaaacaaagcaacaagcattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtctccccccccccccccccccatctcgtgcagccgtccgccgccttgaagccaccggcgtcgcctcgtcggcgcgctacatgatcgagcacgcctcggcgtcggaggctgcgccgaagctttcgttgccgccgccgccgtagaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcattgccgccgccgccgccgccagtgcatgcagggaagccagcatagcaggggagcgcgggtggagagaagtacgaaacgtctggtggagagtagaaaatgggtggaggtggcggcggcggtgagagaggtggtgggcagaagatcgcagggggagggggagcaccggagatgatataatccatctgagctacgcggtggagaggatgaagctagggcgacagagtcgcggagagagagagacagagcgcacgccggcgaagaagaagatgggagggttttgtagtcttcctccctctgctcacggtgggccaaaaaaaacccagcaaaacagggtttccttcccagaatgtgtaggttcctccctctgctcatgatgggtcaaaaaaaaccaggttttcctcttctcatagtgggtcaaaaacctagcaaaacaggttttccttcccagaatgagtaggttcctccctctgctcatggtgtcttggtgtgtccaaaacccagcagaacaggttttccttcccagattagaatgggtaggttgggctaaaattgacccacctagctctgctgcctctgcatccccaggccagcctctccaggctccactattctcttgttttgggcctgttctttcttttcttttctttttttttcaaatgcagcattaggccactggcttccatactagtgctatatatggaggggggagggaggtatatatggatggttgaatgtgacacctcttggagcatctcaactgtttattccgatcatcgagccaaaaggccagtacaggccaaggtttagatcagctgaaagagacgcttcagatcagttgaaagagacagggtctttctgatagaaaaatatatgatgacgtgccatgagcctcttaatatcttgtactagtggctaatcaaatatggttagatttggaagtggcctgcatggtagtggcacaccgggctctcctagtacttctctcggcaagagtgacattgacgctggcactacaaactcatccgctgactgctggatcatcatatgttgaccatcatcattatttctatatagcaaatcttttcgcaataccattatataattttttttcgacatgaaactatattacatcttcacatgatgaatgctgtatagtaatacatacgttattcgttataaaatgttttcttattattatctaaaaaaaggttttcttattgaaacataagcttattgctaacaatacagtaatagtattagaagtactactaccgcgtttgaacaaaatatcaaattactcctctaaactattgtgacaatttaccaactgaacggttacaccaggctacccaaactcgttaatccaaataaattatcctttgaacactcttttaggcggttttggcatgagatgacacacatggtgcaaccggcactcttatcagtataataataataataataataataataataataataataataataataataataataataataataataataataataataataataataataataataataataataataataataataataataataataataataataataataataataataataataataataataataataataataataatagaacccacatgtcagatctctccgccttctctatttctctatttctactcaacaacaggatagacgagggaactcagcaacggttgaaggtagattggagctcaggcaatgcgatcaacggtgacaacggtctttgaagcaaatcccttctaaagcactcacctcaatgctgaccaagtgaccgtcccccgctggctgacgaatctcgcgtagagcctcctctccaccccgttgtcaccttctccctcgcagcaaaactagatgccaggaccgacgaggaggcccgcatcctactacctcccatctctggcttggcctcctcctctgctaaggtcacagcagtgctcgacgccatctttgggggatggcaccatgagggagagagaatagtaacggtattatttataaaagcgatccaataacaacgaaacaatatagttttcactatgttaggattcaacatgctttaatgtatgatatgacttgattgcttataaagtcttctggatcagcagcgaagaacaaccaatcttccgaaacaatgacgtctacacagcaaacgcaaaattaaaatagacaaaatttgctacaggacactcaaaaaacgtataattggtccgcaaaaacgagacacggctgatggacactacaaaaaatgtgtaattggctatagcataccgaaaacaatattttataatatccaggtcaaaagaggtgagaaattttcgaaatagcaagattgcccctagctccatcttcctccacctgaaatcacacacaaaaaattagcagggagcagccgccggcgaggttgtccacggcaagagagcaagtagcggcgaccgcgcaccaggagcggccgacggcgtggaggcggacgcggtcggggagggagcgcgagggcggcggcgacggcggcgcggagcgcgagcaggaggtggccgtgcgcgaggaggctgttgaacgctggccgatatgaggcttgctatggccgccggtcgctgggtctcgccggtacacctacacatccatgatcttgggtctcgcaatgcacggccacggtgaggacgccctgtctctatttgccggcatgcaacgagccggcgtgacgccgaacgaggtgaccctcctcggcgtcctcacggcgtgctgtcatgccggacttgtcgaggaggggctccagcaactcgacgccatgccggaacctcgcatcgagcactacggctgcgtcgtcgacatgctcgaccgcgccgggagactagacgaggcagaggagctcgtcgcggcaatgccagcacaccccgacgcgctcatctggggctcgctgctcgccgcatgccgcgcacatgacgacgtcgagcgcgccgagcgggtgatgtggcggcgcaccaccgacgccgacgcggacgccggcgactacgtgctgatgtcgaacacatacgcgtcgaatggccgccacggcgaggtggtgaaggtgaggaggcagatgaggaggaacgagatcgacaaggtccccgactgcagcctcatcgagatcgacggcgtcgtgcacgaattcaaagcaatcccagcaaattccatccgataaaaacacaacaagattcatcaaagaacaggttatccgattgatcgattgatcactgtagataacaagattcatagaaccaaggatgcaagatttccactggaaattttctacttctagctgtacatgagatttcagaaggcattatttggctttattggttattgctgcaagaagttgatgctcatttgggcttgtgattggcagcggccatgtcgacggccggcctctcgacgtcctccatgtcctcctcgcggacgaacacagcctggtcaagcaccgacggcgagccgccggccgccgccgctccgcagtggtcatggtttttggtgccggagacggcggcctcatccgccagactcgtggtcgggcacccacgcgtcctccgggccgccctccaccgtctcgtcctccgggagcgcctccacgttcttgcggttcagcgccgcctccacctgcgctccggcgacgccgcctgccgccgtggacgccctcctactcctcctccggctgagcctgggtgttaatcgaatgtacgcgtcaaatggttttcggtgctgatgtcgaacacgtacgcatcgaatggccgtcgccggcctcacgcgtagccgcctcctgctagcgctccacgccaccgccctcgcgctccctccccgg

SEQ ID NO: 58305 - DNA, 7239 bp, Oryza sativa
agtgtcctgtagtaaattttgccattaaaatatattccctccgtttcaggttataagtcgttttgatgctctaagtttaatcaaatttgtagaaaaaatagtaatatttttaatccaagacaaatatttttaatgaaactaatttgatgttgtaaatattactaattttttttataaatttagtcaaattttaagcgttgtaacatgaaacggagggtgtcggtgacatggggccgggggtatcgtgactagaggcttgggtagccgcggtcacccacgtggcctgaccccctcgggggggtcgggcccgaaggagacgtggccacccctccctctgtctccccgaggggtcgggccgctcccgtttcggccccgagggctggggcgccccgaccccctgtggttttggcgccacgtgtgtgggttaggtgagcacagcggcgctcacctaaccgcatttatagcgggctagacgagcgcgccacgccgcattcaatgcggcgcagcgcatgcttatccggtctgtgaccagtcgcggtatatgaccggtcacagacctgtcagatcgcgggttaggtggcaacaggcggcctgtcacacgcctcgccccgtcccgtcggaatgatgagagcttcctggctctcgtccctagccggagccggcgtgccaactccaggagtgggtatgtcagtcccggtcagattcattccaggcttcagcgcaagtatggcaaggaagtcgctggccagtaaatgaaggttgaagtgggcatccccggaaaaagcgggcgggcggagaaggaggcgtgcgtactgcttgtcagaggtcatttccggctgtagattagccctcattgtaaaaagcatgtttcttttctgaggtagcgagaggcccgtgtggtgacccctaaccagataaaaaaagaaggcccaggcctaaagagggagagaggaggtcgaactctggggaggggattggagagtctgaactctctctcgctctcgagctctctggctccagagctctctgtattccttcacacacagatccaccagaacacaggagtagggtattacgcttctcagcggcccgaacctgtctacgtcgcccgtgtcttgtgcatttcctctctcgctgacattcctcagatcgagggcgaagaacctcacttagcgcccccggccgaaccggcaaaggggggcctgcgcggtctcccggtgaggagccccacgctccgtcagaggggtactaggttaagaaaaactatacaagcagcaaagctcataataggttattttcattgttaggaaaaatcagacacttaaatgggttaattcggaattcaaacggcaaagatattaccaattgaatttttatggttgttaaaatggatgttccaaatttcttaaattattttttatatattacaaaacaatgtttattgcgtcatgtcggccccacgcggtgccaagcaggtaaggctggagaccggcaccggcgtccggcggcatgggagccagggctcgccggcgttttgtgccacaacggatgatggagagctcatagggaaggagaggagaggatggcgggctcactaatgaggactctacggcgaggagaagacggaggtggccggcgacggcaaacccgatggcaaactgcaacctgagaagcttcggcgccggtacggttcgccgccgatttaatgcgattaagggcccgatcgggtgggattattatggttcaaatgatgagatgggagtggggaatcgattttcgcattcaaatgggagaggaaacgatcagggaggccgatggatgcatgcggtggcggcttttagggctcgtcggccgccggggagaagaacgagactcggctggaggaggaagacgccttcgacaggtgggccccacctgtcggtgcgggaggggctgccctgggctagctgggcgaggcggcccaaggcggaggtgggccggagagagaggaaggaagatgggctagtgcaggaggcgtggcccacgagggggaaagaaagagagccgtgggacagcgaggagggagagagagagagactttaagccgaacgggaaagggatattattttttcgattttgctatatctcacccaaaacattttttctaggatctcatggtggagagcatgcaaccattaccaaatgagacatgtatcaattttgttttgatatgcacccaaacatgtaattacaatgtaaatatgtaaatatgatgtaactattataattgaccgtaattatattcatatgatttttataaaaacatcttttgagtgatttatagctagtcccttattttttattttttatttatctttatctttactagcaaaagtgtccgtgcgttgcaccgggtgattacggagtgtgtgtattgatcaaaagtgttgtttggtttagcaaaagtgcccatgcgttggaacggaaagaaaagaaaagagaattaaattaaaacatattaaattctaatttaatgaaatttaaattttctacaatattaattatacactttgaaattttagcaaaagtgcccgtgcgttgcaacggaatgaaaaaaaagattaaattaaattaaaacatattaaattctaattaaatgaaatacacattttctggaatattagggtatttttatgttggtaggtatataattaaattaatgttcaagtaaagtaagtgtgagaaataaaatattatgtttggatttaatttttattaaattttctatattaattacactctttgaaattttcttggaatttacatagcttaattggtaattttggtaattttgataatacaaatatcatttcagcatttatttaaataaaagtcaaaataaaaatcatttttctctatgggcccttttcagcccattttcttctttagcctgcaagcgcaaaagtctacttaatacccccatactcctcctctcacttgctagtccaccggccggcgtgcggcccaaaccctcgatcgatctgagccgttcattttgatggacggctcagatcaattccaaattgatgaccctaaccctccccctcccccttcccccagctgagccggccaccaccctgcgcccaacgcctcctctccccctccctctctccccaccggcgccgcttcccctcccctcccctccggcggtgccgctccctctccccatctcccgcttctccccctcccccaagctggccgcctcccccaccaccggcgccgtctctcccaccaccgatgctgcttcccttcccttctccctcccttctcgccggcatggcgcggcgacgacagggtgcggcggagacggcgccctcccaacggcggcgacgacggcgttggcgttcgcgctccgtctcccgctctccttcccgtctcaccggcacggcgcagcgacggcggggtgcgacggagacggcagcgacggccgtccctccccctctccctctcctcgttggccttgacggtgatgacgccctctcaacgacggcattgacggcgatgacggcgtcggcttcatccgcgggtggatccgtcggcggtggcggccaccgcgggtggatccggcagcggcggctccctttgctgcctctcttttccctccggtggcggtgatggcgtcggcggccaccgatttttttttttttttgcaatttttttccatggctattgctaaccgaatcggattgcatacgaacatgatgaaaattagatgtgatgaaaggaaaaatacgaatatttatattagttatagattcataaaaaaatatattgtcaaatatataatactacagtatctgcttatttccaattcacaattataaatgatgtggtggcaccatggcagattggcagcagtgatgcgtgcctgctgcaagagacgaatcgtgccggcagcagtgatgagtacaagaaaaatcaactatacgaagctcggaaaagaaaaaaccggaggccatctagtggcccacggtctttattctttaatccctaatccccgtccgctccccagtccccactccccaccgacccaagccgccaccaaacccacttctcctcatcccaatctcgaatcctctgactccgagcaaggaggcaagcagtagcgtccggttcgctacctctacctctcctttcctccacctctcatcctccgcctcgagcattccctctcatcctcccgccccgagcgtccggttcgcaacgaccacggcgaaggggacaagaaggcggcagcagaccagcagtggccatggtgatggtggatctagcaaggcggaggctggcgttggggtggaccggtggagggcagcgtgaaggctggcaacgacctcaacttctccggatctggtggttgtaagtggcaatggaggaaggtgcaagcgcaggcggcaacggtgtgaccacaacatcaagtggtccagcgctgttcatcttctatccaggctagtcgccatcgatctagtgccggacctgaagaagctgaagaaagaggtcaagatggatatgtaagaagggatttgtcaattgctttaggttgcaatgctaattttgttggggtggattggagttctcccatggatccctttgttgattttatttgggtgaatctttggttattgtgtttgccttatggtgttgtgcatccgatttggatttggttgtgtcgaactatgaaagtctgattttgggaagtggttctatgagattagattattgttaggattatcggtcggtgtagttgtaatacttacaatgattgttcgattggtttgttaatcgatctttgatttttttttatctgtccggcgtacacgagtaggctttggccgtcgtacggatgtaattgcgcgtgtatatggagggtgccgcttttctgattgacggacccaaaattactatgacgaaaggaaaaatatgaatctttatattagttatagattatagatatagatatataccttgttaaacattagtagtgtttctactatccatcattcgcttacgtaagcatgatgttgcccccgctttaggttggagtccgattttgctttactaagggttatgaatgattttttgtccattatcgctctatataccagccgcgtacgatggaaaaatcataaaattaaatatcgataataagaaattcaatcgggcaaaactcaatacaaaatccagtcatgcaggactaaacggaccgagaacaccaccataaaattcaatcagctctgctcgtagcccacgccctcacctcgtgccactggacattggcccgcttcgcgggacagcggggaggcggaggcgaccattggcggctcagacacaacctagtgccccgcaacacccaccgtgtaccgccaggttttgaccggcacgacggggcaacgtggaggagaggttgctgatttttttttcataaacttggtcaaatttaaagaagcttgactaagaaaaaaaatcatatgactataatataaaacagaggaaatatttaaatatacatagtgattttttttcaataggcataatctaaattatttttcaacctatgccaaaggtagctatgagaaaagataataaaaaaacaacactagtagaagagggtaaacgacattagcgcgcaacatggttcccgagcttgtgagctggaaggggcccccgtagaaaaactgatcgccaacaataggagtaaaggtgtagtcatccttcttggtggagaagccaactaaaccatttcctgctgaccaggctcgcccttgctcatcgatgagttgaatgttcttcatggacgctgccatgttaccgttgtcagctggcatgtaaccgctgcccatcggaagcggaggagtcggttgaaatgtagcatttgtagccaccatgcctccaaaccagatgttagttgctgagttagatagtgtactgtagtacgacatgggaatgcgaccaatgagatcaggatccctgttaaacccataatgcaccatccaattcgcttaagttatatcctgtacatcattatcaaaaagagaaaaatagattaaaccttttttgttctcacataggagtattatccattgatatacgatattgattttttgggattggtgaaaaaacaaaaccttggttattttgagtgtgatgtattccttggttccatttggttgggaaataccagggatagaatcgttaggacgtatgtatgcgccgatcctgggttgaaaaccagggcaggttttgtccacgtgagagggatctgttaacggaaagctaggacccgatgtcttttttgaagagataaatgatattttttagtggctgcaagagtattagtaaacagaatatgaaatgctggatgtgtagaaaaatcactcacattgcaatagaggtcgaaaacaggcgtttatcacctggctcgacctgtgaggatattaagacgattaactagaaactaatgctttcctagttaagaaaaaaatataggacataaaccaaaaaatctaccctccaaccgatctgaatgacttctaaattcgatactggatcatcaacattatcagttatgatccaagctgaaccataactgacaatttggcccgggctaagagggaagccgtaaacgtccattgttgctataaatccatagtgtgcctcatatgtttttgttatatacccagctgactgaaagaaaaaacaacagattaggtacataaatacaagtaaaaatgatgagaacaatctttttcgcctatgaataataaagcctatctttttttgttgttgacttttatcatctcccttatatacccttgagtttttggtgttagattttctgaaatgactatattactctctctttctatatgggaacgcttgttataaaaatagtaaagtccatcaccggtccctaaacttgtaccgctgtgtcatcccggtccctaaactcgcaaatcgatcattcaggtccttaaacttgttcgactgtatcatcccggtccctaaacttgcagatcactcgtttaggtcctccaacttgttcagttgtgtcaccccggtccctaaacaggacggtctaaaaactttataccaaaaaataattcataactttttcatgtgaactctaataaagacaaactttatatcaaaattgtagccctcgacgcgacctacaactttgtagttgaaaattttttgaattaa

SEQ ID NO: 58306 - DNA, 2352 bp, Oryza sativa
aattgacggaagtgctaaaaatgggaacagggtgaactttgggtgctattaaagtgaaccggtatctttaggtgctataaaaccaaaaacgtgaactttcgatgctatataaccaatttttcctttaaattatgaactcatggctaagaaacctccaataattaggctttccttttcttctgtcaattcttggggtacaattcaatcctgccctcttgtactcatgttggtgctatatgaaatgagataatttgaaatgttgggtgaagaacagtagactggcttccttactcacatgaagatcatttcctaactcacatgaagacatcatacttcatttaatacattcagtacatcctccttgcatagtctacactcatagtacagtgtatttggtggggtgcacaccaagagttcaatcatatccctctggtccagatgcagaattcaatcagggaggtcaagtggaagtttagtttggatctgcttgacacggcattttaaatgtaaaagaatattagttttatggcattgtattttgaaaatacacaggaaaaatgcatatttctccattggaagagaggaaaaagaaaaggactgaattacatcaaatcataaaaagaaaacaccatcttccaaccactaaactcaagaagggaatggcactggctaagtttgaatctgtatgttcctaactcgtgtctttttttttaagataatggaatgaaacataaaaggagggtaactcatgtctcatgcacggaaaaggagggtaactagacttactagcatatggttaattaattattactttaacaaaatttaaaaacagattaatataatttttaaagcaactcttttacaattatttaaaaaaacacattgttttgttattcaggatacgtgtacatagaaaacgatggagtaaaatttgagaggagaagttgccgaacactggataagaccttgttggagagcttctattaagcccagcttctctcagaatttccaacacttccaaagtctaaacagttcagattagtacaaagattctaagactaattagttacaaaatctagaaaataaactagaaatcagaagatgagtaaaccagttttttttaaaaaaaaatctaacaaaatgattactcatcagctgattctcggaatttttggctcgtagagtaactaagccctaaacaaactcccaccaaaactgcacctatgctttgatcttgttcacaccagtagcttcagcacagttgttttatttctgaaaattcaccatttcacaaacaccaaatggatcgtaacacgaagatcacaatggagaggaactgaggaaggtcttgttggctgtggaggacaacagctcttgaacggcgaaccagtaaccaccaaatgcggaggtattgcttttcaagaccagccatcaaaaaactggaaaccagtctgcctcggaaaccacacattgtacagattgtacactgtacaagttcactcgtcttcacgtatgaaattatggatacggcctggcgaatacgaaatgtaaatgtgtcttattcacctaagaccaagtctaatagtatagcccactattaactccaatttatctatagccaatctaatagacaattcatacaatagttgtttatcatactattaatatatggtcccacctgtcatacacacattgcgtcttagagtccgtgctgcagctggctacatatctgtagctcgctcatcttctctctcatcttttatctcattaaaatatgtttatagctggctaatagcctgctattatacctgctctaattcagctcgtgttcatcacaacttcccagctcatagacgtgacaactgatggactgagatggcctataacctgcccgggtcaaatattttgcttagaggtaaagatcattgcaaattgcagctgtgctcagaactaaattaactatgagtctgaacggaggatgtacacttgagtaattaacaagatccaattaacaattaacaagctgtagacaggctaatttctgaacctggtccttctgcttatctgctcccatcattgaaggctcacttaggtagatttttggaacaatatcactccatatcatattcagatatcatattcagtagagtgtagaccatgtcccttttctgactagtacaagatacctgcggggatcacttgcaaggccgggcaagcaagcaagagaaaagatgcagggacaagcacagcttcagattgacatttcctgcaaaaaaatcagcaatttgtgttactttgcatggcaacggcaagcccttttgtgtgcatgggggaatccttggaaacgacctt

SEQ ID NO: 58307 - DNA, 2108 bp, Oryza sativa
gctttatattggatcccctaaaatatagtttgatagatgataacagttaacaaaaatatattccactgtcagagatttgtgctaatcatttagtagctgtaatttaagtagtgaacctaacgattctttacaccacttatagccattccaatcttttaccatttgtttttttgatggatacaactgtaaaggggggaaaaatctcaagaatgcaaggtcacgcttacgagtaggagagcacaacaaagtggaaaagacgttcaaaagggttaagatgaatgctgaagagaccccatccaagcatgatccacccaacagttaaaagaacagcactaacaaagacacacacttttctgatcaagaaacgaacaaaaagggagatgtataaataaaaaaaaacaagtgataatccattaattgttcaaggtgtcaatgataccatctcacgagctgatgagcttagtagttggtatacacccgtgagtgtgtggctgacagctaggagtagagtatatatatgttgggctgaatgatgctgtttgttgaactgtgacagtactagtacaaatatactccctccgtttaagaaaaaactcaatttaaaagataatgtgaccctcttaaaataataaatttgaactactctttatctagattatattaggagggatcatatcttctcctatattaagtttttttttatacggagggagtatacaggagagtaccaatgtaagtggatttggttatgcactagacgtagtacacataagtaggtgtaggagaaagaagataccatttggaatttgttctagaaggttaatttggttttattattggttgcgacgttgccgtccgaggagatcgttttctattgtttagaggtgaagtctacctttttcatgtattcgacacgcgtaatttctttttctacgagatggcatgcaatttttactttaactccctttatcgtgaatatgtggatttaatttaaaatttggtggagtggtacatgatattatactcaggttgtagaccttttcccgtattttctgtattatactccctccgttttaaatatttgacgccgttgactattttaaatatgtttgatcatttgtcttattaaaaaaatttaagtaattattttttttctatcatttgattcattgttaaatatacttatatgtatatatatagttttatatatttcacaaaagtttttgaataagacgaacgatcaaacatgtgctaaaaaatctacggtgttaaatatttagaaacggaaggagtatttgagagccacgaggaggatatgggccaagcatgaaaaaaggccaacttagtcttggctctcagttcagtttgcattccagcttgtagcctgtaggcccaaatatagcccaatgaattattttcgaggtagaataactggctagatgagaccattgcagtgcagtaatattgtcaaatcaactaatcacaaggacaaaattcactaaattattatttattccatggacaaaaaattacatagactctgcacaaatatctatcatgacttaatcacatctcaaaaccctaaactctgagtactatatttatcgaaaactccttagactaaacttaagacgacgacaaccggcacatgcggtgagtggtgacggactaaggtgacacacctgccaagaataaaatcaaaaggacattttagtataacatctcaaatttttaacagatcgcacaaaattcagagagtttcaaattcaaatatgaatttacctgaagatctatgaagatgggggactagcaggcgctggagcagcggaaggcatcaatggcggcactgatggcgctgtcaaatcaaacacgtcaccagattaatcagattaatctcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaacttgctcaagtcgccattgatgccgtggcacag

SEQ ID NO: 58308 - DNA, 10804 bp, Oryza sativa
taacatgtaccagtagaagagttacatggttattaactactagtataattttcttctcttctctctatctctcacttccttcggttccattattcttaatgttgtggacaaagttaatgtcaaacttcgtaactttgattatcaataactataaaaatatttaatttaaagtaattaaaacaacacatatagatttatctttcaaagtacaataagaaaagtaaacatgcatttgtttattatatatattataatagaaaaataaagtcaaagttatattttggagaccgtgtcattatccaaaacgtcaaaaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccgtcgcctgtttcctccgtaatctcttcccgttttgatctcgttttcgtctgattgctctcgaatttggtttgatttctattgtattttcgtttcgctggtagacaaatagatgttggagcggtgatgagcaattttttgtggactagagtttctgatactacttttgtagtatttgaagaccaaacccttggctgtctgagctcctcattctatccatcgctacgaccattctgaattagatttagattgttttatatttctgtttgcggcagctgatttgagatcttggtagcggtgatgagcaatttttatttggactagagtttctgatactgctactttgtggtagttgaagaccaaacccttggctgtctgagcttccagatctcacaaaacatactgttgcttttagattattaggctgttgtttatccttcgattaggttttagatctcttgattagatgcgtccattaccaattccggaggattattcagttcttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcaaaagttttttttctgagtatgttttattgcttgcttgctttgatattgtttctgagtatattttgccgtcccaactgtgcatggtcagaagtgaagaatcggcagggatttcatattggagcattctgcaatcagagcaaatggaccacggagaatggaatgtgtttgtcaataagtaaaattgtactaaagtaaattgtggcaaatctgtatgttgatttgtactatgtactggtatcttgctctaaaacattgttaagttttaccagcatctttgcccaaattgaattcgtcaattcttctctggcgtcttagacggaatttggactataaacaacaatttgctctgctggttaaatttcgtacttcgtagcctaagaaggatgcttagttcgtgggcctgcttaacgatataggtggtgttattaagagttccacgcattatcacaaatttgaaaaatagattaatcttatatttataacaactaactttaatatagaaggtttctacacgaaactttacggtttgccacttttatcctaaaaaatatgttcaatactcctccgatccaaatatataagcacgaagtaatattatgaatactgtactgtattggttccactaagacagaagcgaaggaatttcttttaaattgcaaatgtcataccggtattattcattgaactaaaaatgtggatttgtacatgttccaattaaaatcatgtgcagggcccagtatgaaaatggaccgatgggaggctgggagcccacctggctagtcgccaaatacagcccaatgattttttttttcgaagaataatcatactcgcgagatggatcatcagttaattagcgtacgatgagagtttgacacgcaaatgacaaatccgtattgcatcatggagggacaacttcaaataaacagtaaactttatttatttcacggacaaaaaaaatacatgtacgctacttaatagcgctaaatatctactagtatgacttaatcacatcctaataccctaaaccttgtgtatatcttaaaactcctgagactaaagaagactacggctgaagcagacgacaggctacggtgacacacctgccagaaacaaatagacaaaatcagaagatgttagatgagaaaaagaatcataaattttaacagattaaatttcagagggtttcaaatacgaatttacctgaatatttacgacgatgggggactaccaggcgctggagcagcagcagatgggctctgaggcatcaatggaggcaccgagggcgctgtcaaatcaaacaaaacaccagattagattaattaatctcttcatcaaacaagcaatgcatgaaaaaataaacatgtttcatgatggtttatactaatctcttcaatcaaagaaacaatgcataaaaacaaaacatgtttttacgatggattatgttatcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaacttgctcaggtcgccattgatgccgtggcacaggcagatgggcgccgtgctcaccagcgacttgaacccctcgcagcaggtgcccggcggcgtctgcgcgctgctgttcgtcaggtagtccgcgcacgacatcatcgacaacagcggcgtcaagcactcctttggctgcggcggcgatggcggcgccggtgccgccggcgaggcgggtgatgcttgagacggtggcgagaccggcgagctggggaacgggaacgggaacgccgggaagccggacccagacgacggcggagcgccgcccggcgaggcgggcgcagggaacggcagcgggagcgggaacgggaaccggaagccagagccagccgaaggcggagcggcgccgccgccgccagaagagccgccgatggggatcagcgggaacgggagcgtgaggaacgggaagagcgggaacggcaagccgggtaatcccggcaatgtcggcgctcctcctccggtggcagctttggactccccggctgcggcaatggcaggctcggacgccgcttcatggttgaacccttggaccctcgcttctgcggccggtgccagcgccgccgccgccacgacggcgaaggcgaagaagagggcggcgagcttggacgacggcgccattctgtctcgtcggcgagagatcggtggtgggtggtgagattggtgttgcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaaggaccagaccagacaaccatagcgttagaatgtagagatttggagtttgaaatgttcgtgtaataagattggactcaggatgaatttctcgtacgtaaagcagattttagtttgaattttcatgtaaccagattgaactttggaccgattttcgtacgtgattaagcaggtaagcatatgtcaaacgaacttattactcttctactaattaggcaggtagcatatatccaactttggataattggattgatgttttcttatctctgttttcatttggcgattgtaaatacagtctgcaatcctgacgatctcaaattacatacgtggaaagagagccatcgttacggcacatgaagtctgaagcttcaaccagtatgaagtcttatctctgttttaatacttctgttcgtaataataatttgaattcaggattaggctgaacaattttagcgagtccaaccagtatgaagctctatctctggttttgcttgcttgttgcctcaaacagataatataactcgagtagtaattatgaatttctgagaacaaggtgatcctttttttcagataaaccgcagagttcacctaaaaaaggagaagtatgtcgttgtccagaggtaataattcagcctgtaattatcataactgtactgaagatatgggactctgcagtcctgaacaataaattcaaatgggttctcatttgaatatatgcgttgctacgacacaggcatggtgaagtctggagctgatacatctgttcgcaatagatcagaattctgaaaatctgaactacgctgaagagtttcgcttatctccaagagataataatacagctcctgatattcgcatgagcatacacctgtacgtgcaatgtctgaacatgggtgccacaaaaaaaaagtacagattgacttgggatgttcagctttgacaactgatatgtatttgaatgtgcgcgtggaaattaataagtacggtatgaaaatatcttttggtgaaaaatctaatgatgttaatttcacatgactaaactcacaaggatacaagttttgtacatgagaaaacatatttttactgagcagcaatcctgtcccagtgactgaagccacattttaggactggaagcttggaaagaatatcaactccaaatctgaactaaaaacgccaacaaaatcagctcgatcaaaacccctcttacaagaagatactggaagaaacatcatttgctactggtgacaatacatagttgcatcgtacaatcatttgataagccaattctgttcatttaagtacagtcctacacagatgaggaaagggttcatatgatgcttctgccgttcactttggtgctaatgagcgagcactgatggaagagtggtatgtactgctcctctgtttgcgatatgaagagtagacatcatcatactggccgatctcatttggatcggcagacgctccaaggcccaatcggccagttgaccccggtttactatcaaccgaaccatctgcacgcatccctgtctcaaggtttacaagcaagttgggtgggggaggaatacatgcaccacccttgcgagcaggaatgtccctctcatagttatcgtaatcatcgggctcgctttgcttcattggcccttctgatgggtttacctctccaatctccttaaagaacttcgatacacgctcaaggatctcggactccggaatagtggatggtggaatgattgtggggatgtcaagtggactcaggggagagtatggcactccactcccgatctgcatctttcgcaccattcctggaatcagaccaggggggaatagtggataaggaggtggatttggatcatttgtgatagctggtgtagcagcagtttgaggcagcacagtgggggtttgcactggcaaagatcctggaaaagcagtttgacctacaggagggtaaacaccagctggaagttgatttaatggaaattgtgcagaaggcacaggttggggtggaacagaaagaggatgggttgccatttcctcttgtggatctgaggaccattttgagggctgatgcactgatcctgaaataacatccaaccgcgtatttaggtttacctccaaaaagcaaaaggtccattgtatacatataaaagttagtagtattgcaaagaaatgatgccacaacaaatctatttctacaataattaaattaagaaaataaaaggactcaatctgtacaatggtttaattaggaaataacaaacagacaagaagctaatagttgatttttctagttatatgaacatattaataagagtgaacttcaaaggtatttaagtagagataactgttgcatggtgaaatttagcgaactgccgacatacttcaaacataccaacttacaaagttattttttaggcattaacatataaacataacaatcatgagagtaatctgatcagtattcgagaaaaaaaaagttatccaatcaaaagaagtaaggacaatagcacaaaactacaaacaaaatccttatgccaaaactaacaccttaaaactttatgaactcacatgagaaaaatgtgctggtcaatgtagacaacatgtacagacataaaataataggaaagatggaaaaagagagaggacacacctgaaaatgttgagggatccggtgagacatgccgtggtggcaaaggatatgctaccccacctttcatgtctctttcaaggttagcaatggtttcctggtcataaacttcctttgaaccccagaactgcaggattttctcgaggcgaatctggttatcatctttgctctgtggattgttatatatccttgcaagcattgatcccagcacaaatttaaaagccaaagcctcattgtcaaggtcccgagaattagttcgtctttgtaagctgcagcagatcgaacatggtcagcaaaggaccaggaatatgtaaaaacaaacgattaaaggtcatgtagtcgtgacatattaatttaattaataaagatttcatgccacaatcagcttctccagatcaaatgcacaaaaggtatcaataaaacagtacaatgagtgatacaaaccaaagcgatctactgatccatatgacctatcatcaaacattgacaacatatagcagaaatatcatcatcaagcattcatgctattattgataaaacatgcattgcatttgaattttatcctcagatgctagcttcaacattgttgtctgcaatgagctgattttgctattgctaacatcttgatgaatcaaattattctaatgttaatttacattatgtagaagctaagatctgattatggaccctcctgacaaatggatataagcacaagctaaaacagaattgactttcaggaaaagaacatatgacataacagatctactaggaataaacctcagttcatcgcaaagtttttgaaggaccaacaaacacctaaagacattcatctccatgttggacaaaggattaaacaagtagtcctaagtcctaactagtaccatgaaaggagttgctaaatattaggcaaatagatatctttgcagcaggaatgttttcttgctttcttcatcgtatcatgtgatttattcagtcaatcagatcagacagcgtgccttcatttcacatcagcagaggatagcaattctataccaaaagcagatgccgatcgaagctatacctttcgaaaagaatatcgttaaccaggaagataatgtggagctgcctctccgaatcctctaaagcaaacactctatccttcagagcttcagccaaagccggcgcgaacggcgacctttgcatgaaccatgtcttggcacccttgatcgactccttggtgccattgagattggtaagcacgtcgtgcagctcagctgcgacatccaccggaagcggcccggagaggcccttgaaggattgctgcggcgcggcatcatactccccatggccgtgagcaccgaaatgctggtgctggtcgtagaacggtgggtaacccggctggtgcatcggcggcccacgcatcatcggacccagcggcggcggcatcatgtgcatcgacccgggagggtacggcgccaccggcggccgcggcgagacccagagcttgtacctgtagtaggcgtggccctcgccgccgaagatgaaggcgtagtccgggttgtcgtgctgcttgtcgcggatcacgacctcgaactcgggcccgttcttcgcgatgtactcgacgaccttgtcgatgcgcttctggagctccgggtcggaggggggcggggccgcggcggggggtggcgcggaatcaaacggcggcgggtgcatgtaagcggggtggggcggccgcggggagggcgacggcatggcgtgcgcggcgaaatggggaggcttctggtgcggcggga

SEQ ID NO: 58309 - DNA, 2331 bp, Oryza sativa
cgacgtaggcgacggcgcctgagggtggaagccgtactgcggttgctgctgctgcgcctgcgcgtacgccatggccgcggccgcgtagtcctgggcttgccggtccatgagacagccgggttgggaggggaggggaggggagggaggtagggctcggagcgccggtgatggcggcggcggcggcggtggaggggagaggattcccgagactccgagagagagcgagagcttgtaccctcttctttgtgtgaaattacagaaacatccctcgtaaatagctgattttcgaaaagaggccctgttcttttcttgaacaaaagttggatgaaaatttgaatatttgcgctttttaaactactaaacggtgtgtttcgtgcgaaaattttctatataaaagttgctctaaaatatcaaataaatatatttttcaagtttgtaataattaaaactcaattaatcatacgtaataccatctcattttacgtaaaaacacttaatctttatattcatctttcaaacaccacattgacttgatagcaactgttggtttgtagccgaactcaaccaaatcagaatttagaaatatcttaatattagccatatgtctggtcaataacaaaaaaaaaaatggcattaccaaattacaaccgatgcgaagaacaacattattaaggggttgaagaaatagaattcctacaaaaagcctctaaaatactgtatgcacaaaggctcacgcgggattgaaacattctaatttaagcgcctatcgtttcctctatacaacatctgctgtcatatggtgcatttagccaaactagggatgaaaacggtcagaaacgatcggaaaacagcctcaaccatttccgtaatcatattcttctcagaaacaaaatcgaaaacggtaaaatcggaaatgaaaatggtatcggaaatattggaaaaccggaaacagaataatacggacgaaaacatgtcggtacagatcggaaaccggtaacaaatacggaaacattaaactataaaaacatatatttaactttacataaattagggttgtactatataactatattttagccatgcactcaagttagggatttgattgaagagtcaatcaatctttaacctgtgggtcaagtagatacatgccctataaatatcgacatatttagaaatacggtaattaccatattataagaaacggtaattttcgcaagaatacggtaaatacgaaaatgatcggtacaacagcaaaaccatttccgtttctgtttccatattttttaccatttccatatttttttggtcgattaccatttccatatagttcggccggttaaaagtcaaaaacgaacgccagtcggccgggaattaccgttaccattttcacctctaagccaaacgatggtggccttagcatccacagttcaacttccatctcaaagaaaaaagaaaaaggattgaagcttcatgccgagtgaaaccatgggatgctgtagtaacacagacgctaaagatcgcagcattacaaatttacaacacaatgatgaatccatgaataccaaacctaactcgaataggctgccagatacattatccatacaggctacttggaatccatggtaataacgacgcacagtttgcccaaatgtgagaataacctgtttgagaacaatgcaactcgtcttcgccacagaagttatcgagatgcttaattcctaatgcccggtgtattaaatgatacattaagataaataacaggctggcagccttagtttcaggttagtctgtgaaaacgcaactggcatggcaatgaacgcatgttccatacttcaccctactccttactgctgaaatctttgtcaatctccatctgcatgaatttactagtccacaagaacatcatcatcatcaccgccctcatactgtaagcaaaatagggcacaaattgtcaggatgatgctctgagaaaaataccaaggcaatgtttggaaacggaagcataatactagtgggagggaattatgtggaggacgtatattagaaaaaaaattaaaacatggaaagagatcaagaaataaaagaaaatcatgcaattaccaaatgctgtcagagttgttttagatatcaaatttggatcataaagaacacatatgatacatataaatcatgcaattaccatatggtgtcacgaagttattctagttatcaaacttggatcacagaacacaaatgattcatttagaaccaatcagcaaaaccttgaaactgatggattatagtattctggttattagctgctaatgaacaaacattagattatcggatttg

SEQ ID NO: 58310 - DNA, 1860 bp, Oryza sativa
gaagttaggtcaaatgtttgccaacctttgcttcaacaatttctagtaatttatgaaaactaattgcttgcgcacttttgtatctccaagcatcaatgtctgacgtattatattgttaggaaattatcccagtgcaagttttgtctgggccatttacagtttaaatgtgtagagactgtaggcatgctaaactgctaatttacgaattactagtatactaattgtgcaaatccacttctctagcatgctgcttccaaaactaagataacaggaagaccatttctgatgtttttccaaatacaagatgccattttggagcatcaagaaggctttctggatagagcatgtcttatttgttcagtcgattctatttctttgattgagcttgtaatgaaataaggacatcaactaaatggataaactggcaggaagatgtggagttaatgaatgacatcggcatggatgcataccgcttctctatctcatggtcacggatctttccaagtatgaattatgtaaattatgtgcaaaatctatctttttttttttgttattgttcactaataccaccatgcatcttgccagatggaacaggtgaacctaatgaagaaggattgagttactataacagcctcatagatgccctgttagataaaggtctagtgtattctattgtttggtgtctgcataatgcaaactgtttccaacagccattaatatgaactttttttctttggtgttctctatatttgtggatcaggcatagaaccatatgtaactctcttccactgggaccttccccaagcactcgaagacagatacggaggctggttgaactcagaaatcatgtatggaagactatcacatcatcttcctttagctgagataatcagttaaacggttaggtagcatcaaaatttctctttctattcttttttgtagtgattatgacatcttaattgtgcagcgaggattttgttcagtacgcgtttacttgcttcaaggaatttggagatagagtgaagcactggatcacttttaatgagccttacaactttgcgattgacggctatgaccttggcatccaagcacctgggagatgttctattctgtcacatgtgttctgtagagagggtaaatcatcaactgaaccatatattgtagctcacaacatacttttagctcatgctggtgcttttcgtgcttatgaacaacatttcaaggtgatccatgtgactaaattttctagtaatgttttttttcttaaaaatagaagcaattaagacaatagtatgcatgcattttttgtatgaattgcagaatgaacaaggaggcctcattgggattgcgcttaattctagatggtatgaaccgttctcaaatgccgatgaagacacagaagcagcagcgcgagcaatggactttgagcttggatggtgatacatcaattaatttaaattcctatataattacactaaatagcaactggacgtatattaattatgacatttttctagtgtgaatacaggttcttggatcccttaatgttcggccactatcctccttctatgcagaaacttgcaggtgataggctgcctcagttttcaactcacgcatcaaagttggtatctggatcactagattttgttggcataaaccactacactacactatatgctagaaacgatagattgcggatcaggaaacttgtaatggatgatgcttcaaccgattctgctgtcataccaactggtcagtcttgataaataaagagattctaaatttcctggtctgttttcagtattactgacttctctgcatgcactatggcagcttatagacatgggaagaaaataggag

SEQ ID NO: 58311 - DNA, 17302 bp, Oryza sativa
  unsure (1)..(17302): unsure at all n locations
ttcctgcagccctttatgacttctgtaagctcctaaatatccaacaacctacatgatcgtctgtcattcctgtatcgtttgctaggctctcaatatattgaagaaaattcctgaagaaacgaagaggaaactagctgctcgtggttacattgctcaatctggatatgtgatgaaatacctccccgtgccaccaaattgtttatacattccagaatttacagatgggcagagcatcatgtcctatgtgagttcttcctcacgtttgttcttcataattttcctgactggttcaattctatgtcatggcttattatacttgcttctcatatcaggacatatcaatatctctgctgaagaaggtgcttcagaaaatagagcagataaaaaagtcaagagctggatccccaaactttgaatcacatgaagttgaatcatgtgatctacagctctctattgcccagtacatacatctaaggggcactacaagggtatgttgcatgatcttaatgtgatagtttatttaccatatttacatgagagcatgttcaggagagtcctgtctcagctagagaattgctccagagagtagctcatctgctcacacacaaattggtcacttgttttgtaatcgtaattgtcaccaagccatgaattaggatcgactagttgtcaactgcatttgcacaggctgtcgacttaagctcatttttacaacaatttcaatactccttatagtaaccaaactaaaaatatgaatttacatttgacttcatattaatataattataatgactgagcacatgcatacaagggattttgattcataaatctctcagaagatagcaacaaatgaccaagcatatccatatgggttgggttgatcttgtgtcgggttgatcctgtgcatgagtatacactgtggatggttatcattgaggatgaacggtctgctattgtgcgtctatgtgcaccctttattagagaaaacagccatgcaaaccatgcatgcattgtcagtgaattcataatttcatattgcataggacgtccgtcatgatcatagacacactaagcaaaactgctcatttccctacattaactatattatcgaactcccttatagctattaaacccgaaactacaacatttctatagtagttggacctgaaaaggttcatgaaattcatcaactattagttcatgttaaagctttcttccataggtttatgttttacaaccgttctctcccagtagttgtgtgcaatcacttatttagtcttgtttcttttgtcccacggtaatgttgtcttgcagggtcctcaagacaacaccaagagatttgcaatcagtactgatccttctgcgttatcaacaaaacaatggctggagaagatgagaacattatttatcagcaaagggtcagggttttcatcacgcagtgtacttactggagatccatatattggagtagatgtgattggactgccttctgaagtggcaaaaagaatcactttcgaagagcaggtaacagacatcaaccttaacaggttgcaagagattgtggataagggattgtgtttgacctacagagatggccaggcaacctatgccatcaccgttggatccaaaggtcacactaccctgaaagtcggacagactatcagtaggagaattgttgatggggatgttgttttccttaaccgtccacccagtacccacaagcattccctccaggcatttcgcgtgtatgtccatgaagaccatacggtcaagatcaatccgctcatatgcgcaccttttgcagcggactttgacggtgattgtgtgcacatctattatccacagtcccttgctgcaaaagctgaagcactggagcttttcagtgtggagaagcagcttaccagttcgcacagtggcaaggtcaatctccagctagttagtgacagtttgcttgctctgaagcatatgtcttccagaacaatgttgagcaaagaagcagctaaccagctggcaatgcttgttacatgttctcttccagatcctgctgtgatcaagtcaaagccgtactggacaatctcgcaaatagtgcaaggtgctctgccaaaagccttaacttctcaaggggacaaacacgtagtcagggacagcactattataaaactggatcttgacaaagaatctgttcagacatcattctcagatttagtgtattccactctttctgttaagggtccaggagaagcactacaatttttgaatgtgctgcagccattattgatggaattgattcttttggatggctttagtgtaagcctccaggacttcaatgttcccaaggttctattggaagaagcacagaagaacattgaaaaacagtctcttatccttgaacaatcaagatttgcagaaaatcaggttgttgaaatgcgtgttgataataatttgaaggacatcaaacagcaaatttcagattttgttgtgaaacgctctcatcttggacttctgattgatccaaagagtgactcttcagtgtctaaagttgtccagcagcttggttttgtgggtttacaactttaccgtgaggggaagttctactcacgtcgtctggtggaggattgctactacacttttgtgaacaagcacccagctgtcagagaagaacattctccagaggcatatggtcttgtacggagttcatattttcatggccttaatccgtatgaggagctggtgcatgctatttcgacaagagaagctattgttcgctcctctagggggttgacggagcctggaacactatttaagaatctaatggcgttactgcgggatgtcgtcatatgctatgatgggacagtaagaaatgtctgcagcaagtctatcatacaacttaactacacggaggatgatgccttggacttccctagtgcaataggtcctggcgaaccagttggtgtcttggctgcgactgctatctccaaccctgcatacaaggctgtcttggatgcatctcagagtaacaatacttcatgggagcggatgaaggtaataacattaaattattttatgcattggtaaaaggtaatattgtatgcatgcatgataagtttggtatattcctttaacctaacaggaaatacttcagacaacaagtcgctacaaaaacgatatgaaagaccgaaaagttatcctatttctgaatgatgctcttgtgccaagaagttttgcaaggaaaaggctgctattgcagttcagggctgcctaaggagaattacgttagaagattgtgctactgacatctgcattgagtaagtatccataattaatgctgtcaattatattggtatataaattaatgctgtcaattactggggtatgtagttatattcgcttgctttgcttttagtgaaatcaatgaaggactttatttcttttgtggttgttttattgtagttccctggatttcttataccaaagtctaaaactcaagtttccttttcctttttggtccttcagaatactttccatttttgaaatgtgaaagttttgcggatatagaatgtagatagttggcaaatgttcaatatctgtccaatgaactgaaaattatgtggatctagaaagtaacttagtgttaacttatctgtttgcacaaacagtgtgtttgactgggttaggtcttatcatatttagggatggaaactgggctgcacccgctgggtttcagcaccccgtaccacccccgcaatgcaagatattgcccgtccccatccccatccccgcacacgggtcagtcaagtttccccctgtccccatccctgcaccaggtatgggtcacccggtgggtccccacactcggtaacaggaacaagagagtagcaagctacaagccagcaacatgacagcacaacagcaacaaagccaggaacgaaccaacaaaactagttagccaaacacaaatgcctgaacaaccaaacatcaaacagatcatatccaactatccatacttaaacaccaacagcgtcaaagtatgaggtcatagattggcagtggcagcggcgcgttagtcgcgacagtgacgtggtgtgtccttgaagcttcacagtggcgcagcctagaggttgcccttctggttgcccaggtggcttcgtgcagtcgctctcgctccttctggttgccctgccgattggatctgagagagtggaggggaggagtggaaggaagagtggatgtggactgtgctaaggtttcagtactttatatatgcacctctgatttgggccttctaaatgcttttttttttttactttttgggctgtggtcttaaagggatttgcaccttcctgattgacttggggccccatggggattcgggggccgggggcctgcagaacgtccccgctcccagcccacccgatgggtgaacaatttggcctaaaacagccccatggagggtgatttcctcccatttacagcccataatagagttattccccgccggttatcatgtccgggtccccattgccatccctaatagattcatattttatctgtttaatgctgagaacccggtatctcttttccatggatctgcacatcagtgttcattgtccactaactagtcatggacttggttcattgatgttaaacttcaatcatttatatactcttgaaattgtccatcattatgcaactggaactgccataaaacaacttagaaattggtcacgacagtacccagataaatgcaagttttgatcattctcaaaaatggaaattgagataaaagtctccttgtcgcatattgttggcttttagtattcattatcatttgagcagaacaccttaaatataacattcacgttgtcaggtaccagaagcaaataggtttagatggaacttcagaagcagccccagcacttgttggccatattcatcttgacagggtattatgatatattcttatgttggtgaatacttgcatgcaaacagttgtttttattatgccctgataatatatgtacatctttctttcaggcacatttagaaaggatcaacattagcactgaagatattcttcagaaatgccaagaagtttctgggaaatatgggaagaagaaaggacatctcagtaacctgtttaaaaatattacattctctacttggtaactatctattctctactatattgcttgagatctcacgtttgaagaataaattgcacgcactgctgttttgtttatgtggttgtgtcctgccattagttgctatggttgttggcggttttatagttttggtagaagagggttgtcatcttgtagattgctagggttattcaagtgctgcattgctctttaatcagatgttcaatatctaatatttcaacatcatgatgatgtgaaatcctacttatgatatgtgattgtcgctcgctgtatcaaatgataagttagttaacctcaactacaaccatatgctgtacctggcttgcaagtttcatctccattgaagtagtagaaatgagccataagaaagaggtaaggggatctttatttgcttcctagttccaagattgttcagttttgattttctttttcatgttgtttatagcaaagtattggtagcttggcatagcaatggagccatcgtctaggcagagaatattgatgcattgtttatttcaaatcacaattcctggcaatattctacttaagttcattttcagttaatcatttttagcattaattattatctgtttactgtgagacgatattatattatttaatcgtactcaagttttcacccttactcttggcagcgattgtttattcacacagaagctggttgatggaaagctacctaagcttccgtgtttgcaattctttgtttctgataacatgatagtatctgaatcagtggagagagcagtcagtgtgttagctgattctctatgtggagtgcttttgaatacaatcataaaaggtactgtaagttgtacataatatgcttctgttggaatttcattttcaatacaatttattatttaggttcagttgaaaatcctttattcacatcttgccatgttttttaaggggtggggggggggggtccaaaaagccaaagaattatgattgatccatttttagcccttaaaaaacaattatcttccttcacgctcatgtctttcataatacttttctttttttcccccaaaaaagttaccactattttcagaaccataactgttattgtgttgcaaacctagttcatgatggggtaaaccattcattggaggggttcaaacaatgatggcttgtggttgaatggcactaggtggagtgcactgactgagggatggatttagagtagctggttaagggaaagatcatctgattgtatagagagatgtggctctgtttgaggcaataggatgtcatggcctggcataactaaaggataacctgctaacaaaggatgggactataatgaacaaattggtaccctttagtgctaaagctgctgcctgctggctccacagctgtaacagattaagacattctctgttaatgtttggtagttaactgattctattggttaaattattgttataaaattaatgttctcctgtcctgtcacaaaaaaaaaagtgttgatgtgttaaccaaataagggtagtacttttagctcaacaatttccttgaattgagaatgttgctctgcaggtgatcctcgaattcaagaggctaaaattgtttgggttggatcggatgcaacatcttgggttaaaaacacacagaaggcatcaaagggtgagccagcagtagaaattattgttgaagaagaggaagctttacatattggtgatgcctggagaacaacaatggatgcctgcataccggttctgaacctcattgatatacggagatcaatcccttatggtattcaacaagtgcgagaacttcttggcatctcatgtgcttttgatcaagttgtgcaggtttgtcaccttaccctttttgtttgtaagtttgggaggtatttcatttcaaatctgctgtttgcaggtcacgctgcagatctttccaatctttttaatggattatttgaccacttgcatttacaagaacttactaaggaaaatttataaatatatgaacttagtatttcatgatagctctatggctacctctgcttcacaaactactgtgtttccgtggaaatagctgtttgacaatgttgatctaagtgtgttggggaactatctatggtttacgcgtgaatgcgataattgcatttttttttccatgtctgaccaagatattaatgttaatagagaatgttgactgggggaacattcgttttgtttttaatgggcaagtttggtccatttcaattgagttgtatttgatttctacgatgaactcttttgtacatcatgtgtgtgcttatggatttgtccaatgcattttataaatttttatcttgcatctcatttcaatagattattttatatgtgctgaattgtgcagcggctttcaacaactgtaaggatggtcgctaaagatgttctcaaagatcatctggtacttgtggcaaatagcatgacatttactggaaacctgaatggatttaacaatgctggttacaaggccaccttccgttccttaaaagttcaagtacctttcacagagtccacattgattgtaagcttatctctgagatcaattggtttgttttttatcatcacatacattttattgatttggcccttttattttgtagacccctatgaaatgctttgagaaggctgcagagaaatgtcattcggattcattgggatgtgttgtttcatcatgttcttggggcaagcatgctgcaagtggtactggatcatcttttcagattctgtggaatgaaagtcaggtaagctggttttttctgcccactggagcttattgattatataagaagtggggcttcactctatttaattggggctaatctgcttaaagatctttgcacggtgtgaccaatcaaatgaattagcgttttagtgaaaaagtagctctgcttattgttgtaattgatttttttcagctgaaaagcaataaggagtatggtgatggcctgtatgattacttggcattggtgcgtactgacgaggaaaaggcaagatacacattctttgatgatgtggactaccttgcagaagagaacgaggcagatgtgtgcttatctcctgaattggatgggaccattggtcaaccgatcttcgatgataatttggaagagcaagatgttcagaataacagctcgtgggataatggcacaacaacaaatgcaagctgggaacagaatggtagtgctggaaatgattctgataaatggggaggttggaatgatgcagctgcaggagctgacacgggagtcacaaaaccagcaaaccaagggaattcgtgttgggatgtgcctgcgacagtggaaaagagttcctctgattggggaggctggggcactgaaaaggcgaaggagaaggagaaaatatctgaagagccagctcaacatgatgcttggtctgtccagggccctaaaagggcaacagatggaggagccagctggaagaagcagtctagcactcagaatgatgggaactcctggaaagagaacaagggaagaggatcaaatggaggttcctgggagaaagataatgcgcaaaagggatcatggggcaggggcaatgatgaagctgaaaataataatgatgtgcaaaacaaatcttgggagactgtggctgcagatgctcatgcttctacagagaagtcctggggcaatgttactgcatctccatcggataatgcatggagtgctgctccggtttcccaagggaatggaagttcagatacaaagcaatctgattcttgggatggctggaagtctgctggagttgacaaagcaattaacaaagacaaggaatccttgggcaatgtgcctgcatctccatcatttagtgcgtggaatgcttctccagtttcccaagggaatgaacgttcagatgcaaagcaatctgattcttgggatggctggaagtctgctggagttgacaaagcaattaacaaagacaaggaatccttgggcaatgtgcctgcatctccatcatttagtgcgtggaatgctgctccagtttcccaagggaatgaacgtttagatgcaaagcaatctgattcttgggatggctggaagtctgctggagttgatgattcagttaaagacaaggaatcctggggtaatgtgcctgcatccccatcagatagtgcgtggaatgctgctccagtttcccaagggaatgaaagttcagatgcaaagcaatctgattcttgggatggttggaagtctgctggagttgatgcttcaactaacaaagacaaggaatcctggggcaatgtgcctgcatctccatcagatagtgcatggaatgctgctccagtttcccaaggggatgatgtctggaattctgctgaagccaatgagtcacgtaataaggactggaaatcagatggatggggtgccagaggtggcaattggaggggccaaagaaacaatcctggtaggcccccaaggaaacctgatggcaggggtctgcctaggagacctgatgagagggggccaccaaggcgacactttgacctaacagctgaggaggaaaagattctaggagaaattgaacccactgtgctgagcatcagaaagattttccgtgaatcaatgtaagttacttcatgattatttgttaattttgtgtgattcatgatttacagttatatgcttttaagtttctgaatagaggaggcttggcttttatatgaaagtatgctaggtccgacatttaattgatttgtactgtcttaagctttttaactttattgttgacttaaaattttgcagtgatagcataaaactttctccggaagacgaaaaattcatcaaagagaatgttcttgaacaccaccctgagaaacaatcaaaggtgtctgnnnnnnnnnnnnnnnnnnnnnnnnnnnnctcttgttacttttgggttgacctgttgtgcaattgcccgatacgctataatgaaatatagcattcgtttggcttatggtgtgcaatggcctcatttaatttgacaggttgacaagcaccaagtgttccaggatagtcggtgcttgtttgtggtgtcttcagatggaactcggtcagatttctcctatttaaaatgcatggagaattttgtgaggaagacctaccctgagcatggggactcattctgcaagaagtatttcaagaggcgccgtgaccaaccaccagcagctgatggaggcacagcaccaggcactccagctggggctacacagtctactgcagttgatacccaggagggcacttcacagcagacccaaccagatatcgcaaccgctccagctgcaactcaacaagagactcttcaagacactccagctcctccagcagacgatggattgctcgggaagggacctagcccgtctgactgatgctcagggtgcgcttagagctgccaacatcctgcttgtgctctaatcctgccactctttttttcctacttggcctgacattgcctagtgactagacagatggtgactttgtgtagtagagaagggttagcagtctttaggtctcactcttccagacgaactctgtaaattctggatgttagtgagctgcatcccgtagcttaaactcgtttttaccctctcttttttttttatcttttttgtctttccagtatggttatttggttagtccaatgcaagccgattctgcgaggccgtgccgaatctgatgattttgttgttctgcaaggcacagagctctcgctggtgctgtttcattttggatgctgttacagggttttgtaaagacactgaaactaccatgcgaatcagcaaaagatggattccctgctgtgaacaagcaggtggccttgcatgaattcattcatcaaacatgaggtcttgctggtgacgccacaaatttggtttgatgtgtttgcactgagctggaccaatctgttcttgaaatttcttcaggttggtacagaaaataggtaatattgtattctgtcatttcattaccaagaccagtggtgtgaacaagctggaggcattgcttaaatgcatccgtcaaccgtatgattgtttcagcaaaaatcacaaattttgtttgatgtatttgcacagcaatctgttcttgagattacttcaaactggtataaagcaaataggcaatgctgtactgtcattttgggttttttcacttatcattttcgacctttcaaattgtggtaatactaccaaaattttgtaaggtacttcctccgttcaaaaatgtagctacctagtacgggcatcactaggtagctacattttgggacagaggtagcagtgaactacacgtaccttgtcaactcaacccaaccaatttttgggtaattatattacttttcactcgtaaaaatccttccaaaagttagtaaggtattaacccaaacacaaccactcttaccttatcaaaatttggtaacgtcgaaaattgacattagcgaaaaaatgatttttatttatttttcattaccaggatgcatttcatccatcaacattcattaaccatatgattattttcagcaaagaccacaaaaaattgtttgatatattttgcactgaactggagcgcgccctgttcttcggatcacttcaatccggtaataacaaagcaatgctgttttctgtcatttcgttacaaaggatcagtagtatactcctaaataataggcacatccaaccgtcagatccgcatccaacggctgagatccccgccgccgcggcgtgggagtcatcacactagactagtacactaggctagccgcctcgaccgaacccctccactctcttccgcctccgcctccgcctcgccgccgccgccgccgacgacgacctccacctctccacgccgccgtctgcgatgcaggcccgcgtcgtcgtcttccccgtcaagggaagggcctggtgcttcgccagcccgcgcgccaccgcgcccgccgccgcttgcgggggcggcgatgggggcgccctactacccccaccgccgccaaccgtcaaggacctctggcgcggcatcgccggcgggggccgcacggcgtcggagaacgcggaggccgtcgtcgacttcgtcgcggacaaggtgctcgactcgacggggagcgccttctcgtctctcgccttaactgcattctcgcatgccgcccgcatttggggggtttctgatggtggggttttggctgccgcagatgaaccgggcgtggatcgggttcgggagcgcgccggaggggtcgatgaagaaccggatccacaggtcgggagtgtaagggtttggggattgcttagtggcgggtggcgcctgtggagtcggaaatggcgagatgctgagtcgttgggtgtgctcccctttttttttgctttgttgtggtgtagcttcgggctgaagctgctctcgcgggtgcggccgtcggaggtgctgctcaagtcggtgaccaaggacgtctccctactcgagatcgtgcatccggcaaggtgagctctgcttatgagtttggtgtttgtgtttgataaaatgtgcgtgcaatttgtgtcgtttcacctttgttgttattcttagtttgattgtcgaatcgattgggatattcaactatttgggtccttgttgtgatgaatatttcctaaggctctgagcctctgtgcaggaaatcatacagtatctgtcgttagtggcttagcttacttgcaatagcaatttatcattaacggatacacattgtcgccaatgaatggaactattagaatgtctgagcagatactaatttagatatacaagtttcagtatgcttcatgtagcgatacatgggttatatctgatcaagtttgagcattgactctgacatctctatcattccgttccaatacacaattcacaccagctttctctgttcatagctgttattcaagaactttgttgggacaaagtagttgaaagtccttctattctaagggcctgtttggcacagctccagctccacctctcctggagctggagctcagccaaacagtttcagctccacctgaaatgggagcggagctgggtggagcgctctcacaaaatgaactagagaggtggagctgggtccattccagacccaactcctggagctaaatttaagagttggagctctaccaaacagggcctaagaaattgcatgatttgcgtattgtaagtctgctgtaaaaatgtatgtcttaattcttcacagcttgtagctgcttgttttttgaacctctgtgcgtgctccgtaactgtaaaatggtagattctgtgtcagtgcctgttgttgcacagaagaagctctaaaagacttgttcacacgaactattcttttactggcttcgtaagttacttggaaagcctcatgcatatgcttgtttttgtatagaagttagctattgagctttatgaatcgctctggcactatcaagcatcaccagacagagttggtcggcaattttcttactcatgtcttattttatgtctattcaagattatttctgaatcctagctttaattgcagtataaatcctcgtcttgtgcgtcgacggttgcggcatattgctgtcaggtgagtgtttgatggacctgctccaacaatttgttactgtatagctcaatttatatctttcctcacccttctgtttctgcaatgtttctgagaaccaggggtgcatcagttcacaggaaatttctttatggctcagtttgtttgcttccagttacaagtgttttcatggtaagtctatattcatttgctttggaaaaaatggtgttggctagcaatttgcaacagtgatttcagtgggatcagtttgttgtactttgaagggattttttttttcattttgcgatgctatcaattattgaccaaactaaaaagattattagatctttatttttgcttgctgcctttgctagattgcgcacaatattagttgaggcttgtgtttggtctacttttcaacttagtacatcaaattaagaaaaatatgatgagctcatttacacattaaagataagggatttttacatatgtgggaggtataatttacacttctgattcagttaatgagccatacaatataattataattttgtgagattgtgctccagtgatgtctagtttataacctagcacacattacttgaatcctgatgacccggtaggttcttatgttttaatcattaaccagagtatcataatctacttgatcaaaggatgtgattgtatgttgccttcttgtgttgttgtactttaccccataggattcatagcagaaaaaagattgtgaaatagagtatacatgttggtatgaaaacttctaatgcgtgcaatccgtacttaactcactatgctatggtgagatgacattcattcttatacacctacttattcatttgcaggtactgcctttgccaaacataccatttttctgggtgctgtttcgtgcttattctcattggagagctctgcaggtttgttagatggcccagttattatagagttttcagctcttggatttttttttgttcaaactcctctctgtcgtggtgtggcgtttgctaaggtatgtttgatacttactttgacatagggaagtgagaggctccagttgttagtttctgacagctcagatcaatggaaaatccttcttgagaagcagaaagagatgagttccagaaaggatggcaacccttgtgaaaacactcaatatgctccttgggtaagttgtctcaattcaaaatgagttaaaccttcagattgttgtattttgagggaagttttggaccgagacatttatggacctccggagtcatcatcttgattattttctgttaattcaactagagttgtagatcggacatactacatcagttctagatcagatacttgaagagttgaggtagttaatctgtgttactatcacatacctactgcctctagtatgcaaatgtacccgaaggcaatgaacaaccttttctgacatgtggccgcatgggataatgcacaaacaagttaagccaggatatgccaattaaaagaatttatctacttgcacagttgcatatatgctggcttgttttacccgctaggcacagtttgtttgaccttgaggtttatgacatgtcagtgtacccttgcataactgcatgcattgtatgcccaacctgcacatacacatgggtggccacgactatggatggatttatttgtagttattgattatttaatagttactccatttgcatacaactggtgagcactttctggaatgcctgacttcatgttgcaatcattaagcaatcattgaagccagctattataatatatctttatatggtttttatataatataactttttatacatctgatgaatgatgggcacattgaagcttgcctgacttatatacaacaatgattaggctgtctgtgcagccagttatgcatctatgtgtaatctcaattcggaggatctgtacattgtggctcacagaaaaaggttgccagttacttcacaactccaactagtcaccttaacaatttttgccacaacatgttgtaatttgctgttggaatctgaatctgatattgtttttactgcaacataacttgagatcctctacctcacgggatttatatatgtccacaacattttatgaaggagctactatggaggaaatgggggaggggagttccattatttgtatcatataagatgatcttgtttgtaatatgtgttcctctcatacatggtcctttcattagttaggtgaaaatagtggttgttgggggtgttaggcaatagtggcttgtgactctagcctactgataattccttctagattgttaggctttgacagtatatatatcatatcatatttactgtatgtgcagtttgttttttttttgaaaaaagaaatacttattgtgttatttcttcaatagaatttgcagccttcgaagaagcttgatgggttccttgagagcagaaaattgaatgaaggattggattgtgataccatttcgaggatttgtcaggcatatgatttggacaagattgatgttctgaagtacagggatttggagtaaccacatccagtttcttggctgccgtggtgatttttttgccagctaatgtttgtgtggtagaaatgaattccgtcgtggagaactagctgaactgctgaagggtacacgagtgacacgagacttccaaaattagtgactaatgcagattttttttttttgcaagggatttggagtagtagcattacaattcacaagttttgttgttcctcagtctgctgctggtttacaaggcagaaaaacagacaggacctaaaactgtagtgcccatggtgacatctaattctgtacccaccatgtaaatagaggtggaggcatcctttccccactagcattttctttggtttcagcaccactcagtagtcagtactctgtaaggagatttgcttcaatggattttgcagctgctataacttctgaagtcaaaagttgtgactggattttgcagctaactatgaggccaaaagttgtgattggctaatattttttttttgggttgtttagggtgcaatcagaatcaatcattgggtagatctgcatccaattttggttccaaagcagaatctcctctctgcaaagtaccaccggtaaagatttggtctttctgaggtgcttccagtgaaagttcatagtttctggattaggactaacctttgtatgttttgactgatccactcatctacctctttgattgccattggattatcttgatagccggcggtcaaattaacttttagaaaaacttgagaggatggcatgaaagcaccacaaatccatggcattctgcatgattgaaaaccatctcctaattaggtgtggttatgctgctaggattggagcgaaataataaatatcagaactgggtccaataagccgttttccttcaagcttatccatagtagtagtagaagtactagttgtacctctcgatagtgacgttgctgtggcaatgtttaaacaacgcaaaaatgtgaccgattgggcgattgggattgcccacaaagtgacatgccaacttgttgctctcttaactcttttaccggtcg

SEQ ID NO: 58312 - DNA, 4040 bp, Oryza sativa
gaccggtaaaagagttctcacagcaacaagttggcatttttgtgagagggactaaagtttagctccactttagtccctccaaccaaacaccaccttactccccggtcccggatcacgattccaaaccctaacgcacgcttcctcttttgattatgcttgttcggctgttgctgatgctgattctaaattttaaaggtttaattttacatagatttctttgcttgcctccttaacagtaattaaaatagagctatatgtagtgaaagcgatgaacgctgagattataaacttgaagctgaacactgagactactagatgtctagatccccctccccctttgacaagttccatgctggagtattcttttcaacttattgacatgtgtgtaactgtcaacttgattaagatacagatttttttcctcgacttttattagcacatttttcaaactgctaaataaatgtatttagtgcagaaacttcctatgtagaaattgttttaaaatataagataaacctatttagtttataataattacaacttaattaatctcacattaagggctttcttattttacgtattatcacttaatttttatcttcattacattcaaacgggacctctgtgccatggttctcgaattacaattctttaagaacttgaagcactttctatatcaccatttattagacagcttgttcgaaacttttttataacatgctgacggagcttggggctcctcaccgggagaccgcgcaggcccccctttgccggttcggccgggggcgctaagtgaggttcttcgccctcgatctgaggaacgtccgcgagagagggagtgcacaagacacgggcgacgtagacaggttcgggccgctgagaagcgtaacaccctactcctgtgttttggtggatctgtgtgtgaaggaatacagagagccggagagcgagagatagttcaggctctagaatcccctcgccagagtcccaacccccctcttcctaggcctgggcctcctttttatctggtcaggggtcaccacatggggctctagctgcctaagaagggaaacatgctttttacaaagagggctagtctacagccggaagtgacctttgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggtagctctcatcattccgacgggacggggcgaggcgtgtgacaggccgcctgttgccacctaacccgcgatctgaccggtctgtgaccggtcacacaccgcgaccggtcacggaccggataagcgctcgctgcgccgcattaaatgcggcgtggcgcgctcgtccaacctgctataaatgcggttaggtgagcccgctgtgcttacctaacccacacacgtggcgccaaaaccacagggggtcggggcgccccagccctcggggccgaaacgggagcggcccgacccctcggggagacagagggaggggtggccacgtcaccctcaggcccgacccccccgagggggtcaggccacgtgggtgaccgcggctacccaagcctctagtcacgatacccccggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacgataatgagcggcctctttaagaccgctacattactcgagcagcgcgcgaatcgggacgagccggttcgtttcgcctggggacatgatgatggcgcttttcacggttggcgggcgtagttaatgcgcgcacgatctgccccatctcaaccgccacggccgcacatttgccacgtgcgccgcaaacgggcgagtgggtttagtggaggcgtgtgcgcgagaaacgagggggcgaggtagtgggcgcgggaagcgaggagccgggcatagcgttggcaagggtgtaaagacgccgaggaagggatttgtttctttcctctcgccactcttccccttgccttcgccacttgtgccctaactcttcgtttcctgtgccctacccttgccgcactcgctcgctctcaagctcctcctccgccgacgtcatggcacggggctccgcaccgctcgacggtagcgtgctgccgccttcccgcatcgtgagcgagaggcaggccgggctgccgcgccgattcatgccggaatctgccaccggccgggaggtggtcgcgttgggcgagggacgcccggcgccacagtacccggggcggtccgtcttcttcctctttttcgcaatggcggggctggtcccgccattctctatttttttcatggatattctggagttttatgatctccagatggcgcacctcacccccaccgcgataatgacgttggccatcttcgcacacctgtgcgagatgtttattggggtgcgcctatctctccggttgttccggtggttcttcaccgtacagccggtgtcgccgccgacggtagtcggtggctgctacttccagccgcgggggcaggtgctgaaccgctacattccctgcgtcctccacaaaaagtgggacgactggaagagcgattggttctacacccccctcgccgacgaagcgcgcctccgacttccgagccagcccccggcgcaggcctccagctggcgggcggtggtagatctgggagacggctacgacgccattcttgaccgcctggcgggtctgtgatccctggggctcacgggggccatggtgctcggcgactaccttcgtcgccggatcgcgccgctccagcggcgcgcccggggcgcctgggagtacaccgggcccgaggactacatgaggacccaccaggggtgcaaatgggactgggaccctgaggacttcaggatggtggtccaacgggtgctgaatctcagctccgtggaggcatccctcatcccccaaggggtcctccccctctgctgcgatccagagcgcgccaagatcctgaccatcatgcaggtggtcggggcgtcgggggagcgggccccccggggccacgatggcgcgggcgggagccgcaggggggaacaatctaccccgggagggggtcgtgcttttgggccccgcgacgggggcccggggagcagccgccctgccgacgcccgggggaagaggaagcaggagggaacccctcccccatctcctccccgagggggcggggcggtgcgtgctagcagcaggcgcccggagggtgccgtgccgatgccgcagcccgagggggagcgaaagaagaaacggctccccaagatgggggggatcgcgccatgacgggggaacctcatctcgcccccgaggtggtcgtttagccgaccttcccgcaggttcgtccccgcgcccaccgcggccgtattcattctcccatctcccaaggcgagttttcactcacccgcttctttttgtcttctggtttttcttctgcctcagcgagatcccgtcgcccccccccccccccccccgccattccaagtccggccggtctgaggccgaggagacggcgaccgcggaggtccgaaggcgggaagctgaccggcgagaagccgcggaccgcctccgggaagccgaggaggctgcccaggaggccgtccgtgttcgccaggctgaggaggccgctcgggaggaggccagactccgctgggccgtggagtccgtccgggaggcagaggcggcgcgcgcacgccaggcggcctgccaaacccccgacccgactccgcccgaggcgacgccgacttccgaggccacccacgacgagcccgcgggcgcgccactcgggcccgacccctcgggcgacgtttgg

SEQ ID NO: 58313 - DNA, 1039 bp, Oryza sativa
  unsure (1)..(1039): unsure at all n locations
caaggcacaccgccggcacgcctcacagatcgaggcccgtcgtagggacctggcggagatcgccagggaggtggaggaggagcgggagactgccctcatcgccaccgccgtgctcgacgaggcgcgggacgacctccgcctccaatacgggagccaggcggcggagctagaggagaagctcgacgccgccgctgcccgagaacggcgggcggcggagaacgaggcggcgtcccggcagcgcgaagaggcccttgaggctcgcgccacggcgctggaggagcgcgcccgcgccctggacgcgaaggagagagacctggcggaccgcgaggccgccgtcgccacccgggaggcaacactggcggcgcacgaggccgcctgcgccgaaaaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcccacgccgagagggccgcactggatcagcgggccgctgagctcgaggcgcgggcgaaggagctagacgcgagggcgcacagtggcggggcggccgcgggccacggcgacctagccgcccgcctcgcagccgccgaacacaccatcgccgagctgcagggcgcgctggactcgtccgccggggaggtcgaggccctcctcttggcgagcgaagtagggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58314 - DNA, 13891 bp, Oryza sativa
gaagggatttccgagctgactaggatgagtgacaggacagtcatttatagaataagtacgctgcaggacagaaaggtgtgtatcagtcatgttggaaataaaaaacatagtattacagtaggaaatataaatgggaactgtgcaggatatatccttgccatattcatgagaaacaaaaaatacaaaaaaaaagaaggctaaattcatatgaatcaagtagaagaatgcaacatcaagtatttaaatccacaaaatgtaaaacagctccgttagttagcgaaaaagcccatgtatcagcacttccagatgcaaaagaaaatgtcagatttcagtattaactaacaaacaacattcatctttacattgcaaaagtaaaggtcaaaaagaaaagctctcatagcaacactcatcttgataaaattaatcttacaaattcaaattttgcattgcgattgaatagcacagatcatgcatcataggtaaatctaattgaatgatatcaaatataaaacttgacctgacgggggagggagggtaagaccttctcacgcatgtcaagaaaaccccctaaccccccttacacagcggcacaggcaggtcaagaaaacccccgaacccttgccccacccttacacagcagcaccgtaacccgtgaaaataggctggtccttagacctatgctttggcgtgggacaaacgaggggattttttttcaaccccagcctgaaattcgctcccacaaggagtcgaacccaggacctgaggagtgctactagagccacctaaccaactcagctagaggtccattcgcaaatgatatcaaatataaatgatagagaaaaggagggtttctagatctcatcatcaagagtagttacatcaatcatatgctcccttatcagacggtactgtctctaatggatcacaatgaccaagttgtcgcttctgcatgcatctctttctgcaagcattgctggtaaaaagcatcagagaaggagaacttacaatctcatcctcagtggataggctaagcttgatgctcttgatggcaccttcagcaaccggaattgctgactggtcctcctccatctatctgaaatagacaaagggacatggctgtgtccgtaaaaagaattgaaaagaaagaaccggtaataccaacaagctagaacccaccattagctccaattaaacaacaagaaatagcagaaacaaacagaaaacagcaacctcaaattcgcaaacgtaggataaaaaccgctgtaattatttgttggcttctcggaaaataccactccaaatcaaacttgcttttgattttaatcatttgtttccttttcctaatgggtgcactaacaaatatattcccttagagagtgtgcccttgtctccaagcaagttaattagggcaaagtggctaagctaatattaggttactcctaccgctgaagctgcatttccttctgtttcatcttagctctagcatcctactacgacccaccaaaagtacacccaacaacaggggaagatccaaaagtacaaacaaactgttacttgtatcaaggttaaggctctgaaattaagagaaagagcttcttccagatctagaagagaagctagggttaacgaacgaacgcgagcaaattccacacaaaagcactccaggtggtagagtgagagatgaatcatcagaaagaggatgcggatgctcaccaggatcccctcccctcccctaactaaaaaaacatttcgcacaatcatcaggattcgtttagattcccagcacaccacaaacttccccccaaacccacacggattactccggtgaacatttatcatacatgagatagaaccccttagttgggaaacaaaaaggcatatcaaagtgcaccaaaattgaataacccacgcctctccgcacgacccaaatcttcccttccctcggggaaacccaaaccccccacaacaagcgacgatgaacagacaaacaaccaaccacatcccctttccccccatttctgcgagtaacccagcgccccccacattgcggagacgggatcagagccctcctccccctcacctgaacacccgcgcgcgcgcgcgcgcctgcctgcctcctcccaccctcgccctaaaaccctagccaccgcgcggggggtgggggcggagagggttttagcctgcagccaagccctcgcctcggagaagccgagaagggaacccacacgagcgcgagtgcgagtgcgagagcgaggcgacgatggtggtggtgggaggtcaggtctcaggtgcagttcagtgtgcaggtcaggctaggtcacccccgcgcgccggcggctgttcgacgccacgtcactgacatgtgggccataggctggtcgtggcgtaggtgggacccacctcgcagtgagtgtgggggtcaccgggggtcacgtgttgggagctgggaggagagagatggggggattgaccggaaggcattgaatgggatgacgtgtagcaccaactgttgggtgaagccagctgatttttggccattctttgatttgggtggtttttggcagtaaccaatgtcataaatgggcaaattatcaagcgccaaaaatgaacacaggcctttacacaatgccaaaagaaaaggtgacacgcaaaaggagtagcaagcagtatatcatttttgcatggaaaaaatacagagagctagaatgaacgaacgaactcaccaacgtggctgatagaaatacgatgtcgttgatggctagaccaagcaggatgatgttgagtagtcatgagaagcatgtgaccatagtaaatagaagggactcaaaaactgagccaattcgatgaaatagaagtcaaccaatgtatctgcatcaatactcaactagcattaccaagataaatttggacgctaaaaaatgttgagacgagcttgcccgaacaagctttattgtgcactaggctatgctttctcgtgatctctcacttatcaacaatacacaccatgagggcttgacgatgattatcattgaccatgaggatgagttgtgtcatcacctcttcgtcgtaactcaaaaagacgataagccaaccacctctttgtccaagattagggcatctctagtgttgcattgattagttcagtccatgcaaacgaacaaaacttatgtttgatctctgcagcgtataaatcgttttgtgggacccagtgggactcacacacgtgcacagtctcggccttacccacgtcttcctctttctcacgtagcccgatgaaaattgtctgtattcacttgtgtttgacacctatctaaaagacgattttctcgctgacatgcacgattcggctctcgtagtgtgctctgctcgatatttcaatgtaaggtttgatttaatcacatgatgttggagtaaatgggctaggcccaatttattcccaataaattccattggctcacaaataatgttatagaattaataccaccttgaaaatttaagtggagatatctcaacttaaatagagagctattagagagcacatgttgaccggttgaggtgatggtgggattgccatatgcgcacgcgtcacgccgagccgggcacaggtgaggcatcacctgcctgcacgggtgctcgggacgagcaggcctccgaaactccatccacttgtgtatctgcacgagtaggcaggtgatcaagttttgggggagcatcctccggcacgactactttgcatcaactacgtcttctgctacactgcatccactatatcctctgctacgtctacttcctcttcgtcgcgtgcgtcgactacatcctctgctacgtctacttcctcttcatcgcgtcgactacatcctctgctacgtctacttcctcttcgtcgcgatgtcttccactagcaccagcgttgctggagacgaagagaatgcccgcgcaccaggaggaggagggaacggtggtacaggagagagcatcaacggaggcaatactaatgcctgatcatccagtggatcattctatgggtatatatctactctgatattggtgttaaacatgttgctaaatgtttttatacctgttaacatattcatattcatgtttatcactatgctaggatcgctgtatcttgttttttttggattaaagtatgccgatttattaccaaatttccaacaaatgatgtgcaaaattatgcacaaagatgaaaatgtcacctccattatccaccaaaactcaaatgcatcatcgccactacctttacgcctcttagctaggcgacaagccaatcacccctctatccaagctcaggaggatgatgagcaagaagaagatgcgaagctatatagagaagtgagaatgtcaccagaaggctccaatgtgtcatcacctctacctccacgcctcttatctagacaacgaaggagagcacggacaaaggtgaaaagtagatgggagcgtctcaccattgctacacaacaaacaaggccataagaaaggtaggtggtaagggagagcgctgccaccacttggtttgaccaagggaacctagaaccatcgaagggttctcttatataccaacgattggtttggtttgggcttctcggataacgactctttaacgacccaaaaggccagctagtaatttttgtcccttttttaaaaaagaatttgtggtaaaagcccaaatactccaacaaactatatgcatactacgttttgtgcctcgtgcaactgattcatggagacaatgataggttgaacccacatagcagtggcaggtaggtgggtaggtcgttaatgatgttgttttcactctcatcatctcatggtaggaggaaagtacgattgtccgaatttttattaacagcttgaggttttgatacagttggaatatcttgcgatatttatgacttattttccatatcatctcttagtgcaagaacatagaaatatagtgttacgcttccaagcgacccaaacatatataaaccacttgtctactcactcctatgcacaactcaagcacgagctcggaacatgcatgaaccctagctgaactctcaagggaggccatcttgccttcccactagaggagtaccttgctccaacatgactaaagattgaatgagtttatgactatacatctcatagtcataggttgggaccgagggaacgtggactaaaaagccaacgtttatgaggtgaatttcacttgtgtattatgcataaagtagaaaatcagaaagaaaaatcacgagtgagagaaaggggtggcatcacctaatgtaatcccttcatttttaaatacacgacgttgttaacttttagacattacatttgaccatttatcctattaaaaatttagtgcaaataaaaatttaagtcatgcttaaattactctaaaaaatatgtcacaacaaaacaaatgatacatatattgttttagtaggatgaatgattaggcatcatgtccaaaagtcaacattatcatatccaacagtatgttaacgatttttcatgcaaacaaatgtgaaatgtcactgttgtatgcaacatatagttatgcagtattgagcccgcaatagttctattgaaatttccaaacacttctcgcaacatatccaatcaacaatctcaacaaaaaattcacatttttaaacacctggtccattgtcactcatttgcctcatcaaggcccttcaaatatcatgtagctattgtcattggcctttgatacaccagtctcagctttctacatgccattaccatttctttccagaaggctgctacactccattaccatttctcaggcacaattctcacttgacacatttccagaaaaggagtttcagataaggatgcaaatgggccagtggccagccacggatcgacccgcttaaatgatttataagtgggtttacgggtcagcccacttgcatttcggatcgtcgctaaagtgtcctatgaaacaaaccaactattggggagcgagcccattgtcatagtcactgcccctccttgttccattctgcaggttcctctcaaactccctcaggtaatcaagaagcaaaacgatcacgaacaggatgaatccaccggcagagttgctgccgcctccacctccacctcctcctcctccaccgaaccggaatggcgggaagccggtgcctccatcgtcaagctttggactcctcactttctctgaaagcataaggtcatcgaattaagaagtgagaatcccctaaaaaaatgtaagaagtgagaaactgtgagcaaatgcagtgaaaacatagctgttatgtacaatgagattcagttcttggaggaggaaaggactgttatgtacaacgagattcagttcttggaggaagaaaggacgaacatcatggattttgcatttttgctgatgctttgcattacctttaactgaccctgatggcggtgaggtaggtccagagaaagatttgcgtcgtgcagtctgtgtctggtttgcgcaacatgttattctctgcagaaaaaaaaaagcaaattcagaaacagttagtgttaggtggtttcagaccttttgctggttagaacttcgtgtctgcacttctaaatttagaagcatcatgctgcacagcaacttaacatttgaaagttattacaaaccatagctacttaaactcatgctgtggctttcttaaaaacagcacgatagtcgcctaataaaacttaaactcatgctttgtgaagtgatgagtataatcagaattcaagctagcaccagattgaacatgaaaagattaaataattagcagtttggaatttgttttcgcttcacctatcttaggtctcaattctttttctctagctaaagcctgaagctctgaaagtctagttaaaattccctatttttgcaggagtgatttactttttgagactaatgattactccaatatgaatagttgaagaatatatgttccgtgaaatggaccaaagtgtcacacataaataacatttttttaatattaaaagtacagctgggagaaagcactctttcacaacatcacaattttatatgagatatacatctcttgtgttacaaaaatccaatacttttaaatctgtgattttttttagaatatgcaaggagcgcttctttatatataaatctgtgaaatgtccgacctattctaatttcatgaactagttcaagttcaaaactttggatttgcactgaagcctgaagacatgaactttctcagctatcagatttgctgatgcagtcatacctgataaatgtatttctgagaattagtatattataaccaataaattgatctatgaagcttttgaccgtgtaaaactaaaacacaagtatgacgagcaggcatgtcatagcaaaaccaagaaatattctacttaaccacagaacagacaggcaggcacgtcctcaccatggatgcttcgcatgaagaaactgctctggcagaaacgctgagtttagtcttgagagatcgtgaagacgagatagattgtccttcctggctttgtcctacattgaataacaataagtttatgctcatactaaagcatcatcacctaatattaaattacattctgaaatagtactcatctctctttttccttacagcactttatgcgattgacaatatatcagtagcaattcttcttttttttccctttaaaaattcactcttttttagaaaaaaaaaagttcttgcgagacgagtgcagacagcatttcttgggtaagacaaattaagggagaccgattatattaccaacctccacgatttctcccaatcccctggtacacagcgggggtcaacagaagaagcgaacctggcgatgacattgtggcaagtggaggcatgatatgcagcagctgtgtagacaaaaaccactcctcaaaaaccactcctttctttctgagctgagctgtagatacaaccaggcactagcctgagcaagaaaactgcagaaagaaatgggagaagttcagaacgagattgcaggtgcagtacagaagaattggtgcaagaaaatcatgttgcaggagaggaggagattacctggattttttagcttgcagaagtgtgtaatttgcaaatccgcaggagagaagaagatgagagaagagatagatttgggtgggaaattggggttttggatgagagaagagtgcagagtggcagtgacatgcggctgggacgtttggcaacgaatgttatccgtatagactctggggtcaggtcgcggagtcgtcgctgatccgcatcgtccaaaataaatccaagggtcaagaacaaagcagagggccagcgaagcgaagagcaagatagctcggcaagacatctaagatgctacttcgatgatcctcctgagaacgatgtcgatgatcctcttttgaattacagtaaagtgtatgggttgtacttacaacttgtagagatgtgtcatttatatttctaaactcttaaaatacatatccaaatcgcagaacttgtcatagtgtgtcatctaggtctcaaatcaccacagccccttcaaaatcctacgtggtgctgatgtggcatgccacacgaacatttaaaaattttcactttctttttttttctctttttcttctccttcttttatttttttcctttcttctcctttcttcgtgacccgagcaaaagaaagggaaaaaagaagaatgagaagaaaacaaaaaaaaaagaaaagaagaaaaaaaagaaaaggacacgtcacgtccacgtggcatgccacatcagcgtcacgcaggatactagaggggctatgtcaatttgggacctagatgatataatttgacaagttttagaacctgaatctgcattttaagagtttgaagacctagatgatacaaccctataagtttaaaaaccgccaacgcaccttactctgagaattatgtgctacgcgtggctcgtgcacttccctgttagcatgagccaattattctagtacagataatttatactcattcatgttgtttttttaatatattacacaactataagttcgaccattgttcttattcaaaatattagtgtagatattaaaaacataaaatatagtatttaaagtacacaattaaattacaacaacataaaaaataattacataatttttcaaataaaataacttatgtccaaaagtcaaacgaacaaagagagtattttttttacataaaattaatgtaataaattcatttcaaaatgttttttaaactcatcgtaaaattaaagctctcaaaagttagtcataaatatacacaatagtgtaatgtttaggacttaaatccggtgaacaagttataccaaaagaaaattaatcagctgagcgctcactgacttcagcttataattatgcttttgattacatgaacgaagcttttttttttatggagagagtatatcaatttcatttttattttcaaatacactaatacaacctatatatttttcaaatatataaatttctctttttaaaatctgctctgtccatttcgtattataagtcgctttgattttttttactattcgaacttctttagattcaactaagtttatagaaaaaactacccaatatctacaacatcaaattaatttcattgaacgtaatattgaatatattttgataataagtttgttttgcgttgaaaaatttcattattttcttataagtttgactaaacctgaagacttaaacttgtttttggagaaaaaaaatcaaaatgagttataatataaaaaataaaactgtttattacaacaaaaatagaaactaagggtgtgtttatttcacgacaaaattaaaaatttggttgaaattgcaatgatgtgaaggaaaagttagaagtttatgtgtgtaggaagttttgatgtgatggaaaagttggaagtttgaaaaaaaagtttggaactaagaccctatttacatgggactaaaacttttaagtccctatcacatcagatgtttggacgctaattataaatattaaatgtagactattaataaacccatccataatcttggaataattcacgagacgaatctatttagcctaattaatccataattagcctatatgatgctacagtaaatattctctaattatggattaattaggcttgaaaaatttgtctcgtaaattagcttttatttatgtaattagttttgtaagtagtttatactatttaacactctaaattagtgtctaaaaatagataacaaagttaagtcctgatccaaacaccggcctaatgatgaaagtaggtgtacagttacgtagggtaggaacatcatatttgctactgctattgctacccctgtggaacggccgccgtcgtcaccgctccacccacagtcgtcacctcacttcaacgctcgtcgtcctcctccactcctccacctccaacctcctcgcacgccctccctccctccataaacataaaagccctcgcgcacccacacgcccttgtcgtttccattccacccttccaattcaacgcccctacaatggtggcgcccatcgacccacctcgaattcgtagcgcgaatcctcgtctcccaatgagcatttaatcggtcccgttccgttcgccgaggctgcagtgagctgaatcttttgcattcttgccttcttggcttcttgctgctggagaagaaggagaagagcgcgcgctccccatgccgtgcgcgcgcgccgaggacgcgctgccctccgccgccatcgccgccctcgagatgccatcctccgccgccgccgccgcagcagcgtgagtgtgattgttcttgaatctttctttctttccttttttttttgttttgttctcgtgttgatttggtttccatcttgttgctccctctgaatcttgctgaatgctgggagtgatggtttcagaggcggtctgatccagaaggtgggcggcggccggagatcgggcgggtcggggcgggcgttgcatcggtcggcgcatctgtcggcggaggacgacggccacgcgccgccgccggcgagctgcagcaaggttcggttcctgtgggcttctggttgactcgtttctatctccacagcccctgcccagcatccagacatcccagaaattcacattctttgttcggattcggggacaccacggtttgggaacactcggattactggcacagaaaagcgagatttcaacggcaaatgcccccgcaaaagcggtgtccttttgcgaaatgccgtggtgcgcagggcgctgtcggcttcggctggccgtgcctgcaaaaattgtttttcattgggtcccccccaaaccaaggatgaactgtcccctaccccatttgtctccactttccattaatcgccgcagactgtgtggtcaaccaacaatcttgttgtttattgcttcctgggtttatttctgccaatcgaagtaatgtcacagcaatcgtcgttttcattgttgtttttgtaggatgataagatcggtggtggtgggaagagagaagggagccagaggagcaggatgaggaagtacaggtcgcagctcgagcaggaagtaagaacttgctgattctctttattttgtggccttcttctacagactacaggcagatgatgttagtgtgtaaatgtgatgttctttatactatcgaaaattgtgcaggtcaagaaattacagaggcagctcgaagaagagattgatttgcatgttgcgctggcagacgctgttatgcaaaatgctggacctgtactgaactcctctgtgaagattccatacaaggtgaagagctactagctagttttcttgtctttatggaatgccatttctgagccaattcagtaatttttgttttgaccttttcattctccaggcacaagaattactaactaacattgcctccttggaaagtgccgtatcgaagcttgaaaaggacttaaatgaactatattaccagctttgtcatgaaaggaatgaaaggttacttgccgaaagtaaaccagggtgcttgccatctacatccccagatcactcattgtcaacttgcacgtgcacatgggaagaagtaagtttttttttttttttaagtaaatatatctgtcttctttctgatgttggagttattgataccttcttgttatctttcttagcacatatcatcattgagagatttaaagtttggaggatctgagtcaatgaggtcaacacaacaagatttatactctgaacttgaatatgaacaagatgttggagaagatcctgaggagagacaaatggtttctctaaatagactatttgaaaaacaccgggatgtttctttaaatagacttctggaaaaacaccgggatgaagaggtccttctcatgcctatttgtatagttttggaagatagttaattgtgctagacatattcgtgcaaggtttgatttatctctctgcagatgcaagaatcttgctctactgataaagaaggcgaagaagatgagaagattgatactctatcatttgaacaatccatactaaagataactagcatgaaattagggaatctttggaacaatcctaaccagctctcagaggagatggttcgttgcatgagaaacattttcctccgtctatctgaatcctcgaagatgttaccaaaggaatcttctgattgttcatcttcctcagcagaacgtctttctggttctacactggcatccttctcagattcatccatcattccctcaatgctacgaagtccttcagttgactcgaatcgcaatgatgagatgacaactgaagccagcaactttgatccatataaagttaatgggaaggaaagccgaagagatattggaaattatcattcagcagctgaagtatcttggatgtctgttggaaaggagcaacttgaatatgcatctgaagctctaaaaaaattcaggtttgatgctgcaacctaggctaaaactgcctgtcctaatgtcaaacatactgcatgttatgaggttcatatgaagcatgtttttttttgaaacactcgttcatatgtatgatactatcagcatactatgcacatttctaatctcattttactgttgatgcctaagtgaatttacaaacaattgaactgttatgaggtttgtaccgagggaagaatgagatgcttcttgtaatcttttattttcaggaaacacaaaccgtattatattttatattttggaaccccacaacttgttgtcatttttagccctgaaaggaatccctggcagtgtgtaatttatccatatttgaatgtgttaacgagcactcttttccatgccactttgacttatctttgatgtatgataaaactttcaaccccaatgtcttgctgatgagcaaacaaatgttaacacatactcactacatctcataataaatgttttctttgcgacgctttccaagttttttggtctattttctgtcaattacggtgttcctcattgaagaccatctttaattcttactaatacttatgttgaatgtaagtgtaacaaataaccatgcctttgtatttacagatttcttgtggaacagctatcaaaggttaaccctaatagtatgaactgtgatgagcggctagccttttggattaatttgtacaatgcactgattatgcatgtaagtatgttaccaaagagactggctttgcaaacaagtcctgcactgatgatttatgcatatttctgttcctcatatttcattttgcttttactacgtatttctttctcactagactaatactatatactaaattttctgtactgtttctatcaggcatatctagcatatggagttccacgaaatgatatcaagcttttttccctaatgcaaaaggt

SEQ ID NO: 58315 - DNA, 2088 bp, Oryza sativa
ttttatttttttaacaatcttgtgatgatctgccgtcatacaggtgaggatcttctctgcagcaaatgtccgtcaggagcttcaggaatctttgagagactatgtccaagcgtctgttggtataagcgaccgagggaaactgctaatcccaaagttactgcagagctatgccaaggggaatgtcgaagattctttgctcgctgactggatctgccatcaccttacacctgatcaagttgcagtcatccgagattcttcttcacagcggaagcagcggcttcttggagcacgcagttttactgttgttgcattcgactcaaaattccgctatctgttcttgcctgacagcagtggctcccagaagccagaacccaaacggacttcgtgagctgtgttcagaaaacacatgctatgagcgagtatgtttggtcctagaaccatttcttgcatactggacaatggagtagctagttgtatatgatgtaaatttttggaggaagagtatatgatgcaacaaagatgagaagctggagggtgatacaaagagctccagtaaggatacaggatagttcatatgtatgatcagattatctcagctgaattggcgatgaaggttcatctggatctcattttgttctgttactgtctttccataatgaagataaccttttgtaatttttgttttcgacatacctttttttgggggtatagttcttgatcttggtcaattgatttgtaagttgtgctctaaataatgtatagtgcttttacctctttataataatgtgagttactttgtcactgtctggctgttactgctggaataagtaaccgttctatgagatgcaacctttgtcagatagataaagtttatgccttttttattcgaaatgcttggaatttacaaggaaaagaaatggaatcgttttgaatacaaacaatgttggcaataatcactttttttttttgggagcaaaaaccataacccttattatcatcatacattggagattttgccccctttttgtaaggtaatagctcaaactgctcgtcttagggctagtttgtgtatgcagtgctatattgttacaatgatatttaagaacttgttttttttttttcaaaacctatccttctgaactccattataacttctgcaaagataaaaaaaccaaaaatattaaactaaaatcttgaaatattaaacgttatattttatcaaaggtagccttcaaaatcaacaaaatttatgttatccctttcaagcaactcacctcaattacatgtggggccaaacccacttatttttccagcttgtctttttttagaaaaaaacatttcaaaaaatcctttagacggggcttttaactatttgccactcttacggatgttgcttaacgatttgccactagggcccacatgtcatagacacatgagggctcgcatgtcattgacagggtgtggcgaatcgttaattgccatgtcacaagagtgcaaatagttaaattacattgggccaataagtgggccgggctgcccaagaggcttgggccatctcctctctctcctctcctccttcacgccgcgagatgaatcccccggcgactccactccagcgccggcgaatgccgccgcccgccggcagcggcggcggcggtggcagagccgtttgattcccccagaagtttgtgcgggggaggcggcatccagctctccactcccagggtcagttgattcatccgcgctttttttttccttctgctcgttgctcttcacaccacagtgatctgctgagccgggaggggtaggagtagtagatcggctgttgctcgggacccgtggagtgggatggattgcgttgagctcatgccaaattgagacatgaacatccttgtgattttgcttttttcagaaacatttttactagtctcaggttccttatatatttttggggtaattttggtgcccatatcagttcacgtggtattattagttttccttgccacttccatcgtaataatcggatcagtaatatgattcacatatttggttatattgtaatcatgtattggtctgtcacttattatg

SEQ ID NO: 58316 - DNA, 6089 bp, Oryza sativa
tggcaattcctccaaagaacacaccaaatgtaactgcaagaatggctttcttgatgtgtcgttttttggagatgtatgatgtttgagctgaactgcaatggtttgcaagcataggaccacataattttggattgccatcaaagatagaacttgggaatgtgctaagctgacctacagttggaactggtccttctaggtcattgttagaaacattaaatgctgaaaggaagtgcaatttgttcagtgcttcagggattgtaccagtgagattattgtttgacaagtcaagcatctgaagatttgtgagattgcagattgattctggtatctgtccagacaatttattggagctcaaattgagtaaaagaagtgccttcaactgaccaatctccttagggattgcgccagcgaagttattgatgcctagattgagcactttggggaaagcactgtttattcggtactgaagtgattgggctgtaaaaattggcagctcaaagacttttggtgcaacattgtctgtttttagcattggcatctccattaatgctgttggaatttctcctgaaaggctgttgttcgttatgtctagatagaagaggaagtttaggctgctgatccagataggtatttgtccagttagttggttgtcatgtaaaaataacatctccaaatttgtgagctttgataaccaatgaggtattttcccagacaatgaacaaccatacagggaaagaacctgaagattctcaaaaccatcaatgctatcatctaaaggtatggtttcgtgcatgaagttgatcgcgattatcaaggttgtgaggtttttggagctctgaagcatctgaagtgtactggttatatttgcaagagagttcttaacaagtgacaggaatgataaggacttcagattacctattttctctgacagctgcccacgaaagttgttgaaagataatcgtaatgcagttagattgctacatgagtaaatgctttctgggatcgtcccattgaatttattccacacgacatctaaagtttttagattgggtagtgtggagaagttaaccttggtgagctccccactgaagttgttcttttttaggtcaatggttacaaggtttgtgcagtcactcaacgttgatggcagctcccctgacatgttgttgttgtccagatggaactcctccagtctcttgagctgtcctatggaatgtgggatgctgccaatgaacttatttcctccaagatcaagggtgaccaaatttatgagcttggtgatgccgtcaattgatccttctaactgattgttaggaaaagagaggtgcttcaaagaggtaatatcaaagatctcatatggaatagccccagtgagattgtttttgccagagctgagcaatgtcagtgtggaacaattactgagccctggagggatgcccccactgaattggttataactaatatcaagcaaggcaaatgatggtgcactggcacagaacgaagttggtatcttcccagtaaagctgttattgctggcgttgagcgctacgagactcttcatcacctcccatgttgttgatggaaaatttcctgtaaacaagttgcttgatatgtttagtacctgcagaggccggtcatgggtcgaagatggcagatcgcttaagtctcctgtcaggtagttaaaactgacatcaaggatcatgatgctgctggatgacaccaattccagtggtaagccaccagacagtgagttgtgggacaagttgaggcgcatcaagcctatcaggttgccaagggaaggtgagatgatcccctcaagccctctagtagccagaaacacctcattgactgtcctatttgggttgcaggtgatcccttcccatacacagcagtccgtgccattcttccatgacatgcccaggccaccatcctttgaaagccaagcgagaaactggatcagggagttgctctctttctcggtgcaagaactggtgggagaggccaagaagagcagcagcgcaagagcaagaccaaaggaagttatggggaatctgttgctgtagttcttgttcgagaactggaggggttgcatggttttctccataacctagcatcagagccaatagtttgaagaagaatgatcatgatatgaagggaacaagcagctgctgcctcttctttgttttatcttctcaggtcaaaatcaccacatttatgagtcaggactaagctgctattggttagatgtgacatcactttccaaattcactgttcacaccagcaagctgctatagtctactggtaagtctgacttccattcactaatggtttggtaatacttataacagacatccatgattcggccattattgaacttttgtagcgtgcgttaatttactcgatatgacaattatacaagtttcattatgtttaacttttgctattggcataaacatttaagactaacaaagatgaatagaaaaaaaaatccctttttgctgggcaagaaagtggctctctcaaaattgcaaggagctaaaagagtttcacgaaaatgaatgagcccgcaagcattgaccataccaatgaatatttgtctgtaactatcagtatatttcagcatgtcaggtaacttttttttctcgaaaatatgtcaggtaaggatcaaaaagaaaaatgtaggtttttttttcacaaagtggttattacagtcccattaggccatcaccaagaataaaatgtttatccatttgcttcctttttttttattcgctaggattttttttttctgagaatatgttagttttgtgctctctaagaaaacaaacaacaaattgattcatatattttgttactacatggtaatcatgtgttgagctgtcacttattaaattcctggtatttgcctcttgaatcatgggctctcgataatgttgtgaatcttcgtgttgtttatcgaattctaactacagaatagttacaagaagggaaaaaatgggtttgaattacaaaatagtaaaaaaagataattcatgagagactgtgcaaagtacagtgcaacactcagcttctctctgcactctaaagtagatcatcatgtgttatctaattctattttaattgagttttgttgtctgcagctcggtgcctatgatgtcaggcaggagacaccctcttgtatagttggtctcattccaggattatgatttacacactggcatgcaacttcaagaaccttcaccatctgtttttcatatcctgtgcctcggagtgttggatccaggacctcaatatacgttcggtcagatatcatctcctgcacccactcgacaagttgttttgatgaagacaagattggaacaggccgccttccggtgagcactcgagcaggactactccaaagctgtacatgtcacctctcaatgtagccacccacccttgtccatactctggggggatgtaaccgaaagtgccgactagctctgttgtgacatgggttctgttgggaaggatcaaccttgatagcccaaaatctgcaatgtgagctttgaattctttgtcaagtaaaacattgctgcacttgatgtcacggtggactatttgaggcttgcagacatcatggatgtaagatataccctggcttgctccttgtgcaatcttgagccgcattggccagttaagaaacgagctggcatcatcattcctgttatgaagccaatcatccaggctgccattctccatgtaggaatatatgagcaacattgagtttccctggatgcagtaaccccacagcggcacaagattgtcatgctgcgctgtagagagtgcgtcaacctctgcactgaattccctctccatcagacacatgtcgctgttgagcttctttatggcaaccatcgatccatcagataactcagctttgtagactagcccatatcctccacaaccgatgatgttctccttgtcaaagttttttgtagccttcagatcagtgaatgtgagcttggtttgctctccctttccttgtgacagcatcaccaaggtttgctccgacttgatgttggacaatgtttcttcggtgccatcgtttctgcatctcctgttctcagtcacgaaattcttgcccctcaagaagagaataagacgagctagcaagaacaggatggtgatacctccaaaaaatacaccaaatgcaagtgctaagatggctgtcttgttatgtcgctttttggagacatacgatgttttatctgaaccacaatggtgtacaagcataggaccacacaattttggattgccatcaaagctagaattcggaaacgtgctaagttggcctacagttggaactgatccttctaggtcattgttagatacattaaatgctgaaaggaagttcagtttgttcaatgctgcagggattggaccagtgaggtcattgcttgatatgtcaagcacctgcaggtttgtgatgttgcagattgattctggtatccctccagagaatttgttggagctcaaattgagtaaaagaagtgcctttaactgaccaatctccttcgggatgacaccagtgaagttattgatacctagattcagcacttttgggagagcactggttcttcggtattgaagtaatggagctgtaaaaacaggcaactcaaagacccttggttcaacattatctgttttgaacattggcatctccattaaggcttttggaatttctccggaaaggctgttgctcgataatctagatagaagaggaagtttagactgctgatccagtcgggtatctgtccagtaaattgattattatataaaaataacaccgccaaatttttgagctttgataaccaatgaggtattcttccagacaacatacaattggccagggaaaggacctgaagattctcaaaaccatcaattatatcaccctctggcattgtttcttgcttgaagttgcgaccaatgagtaaggaggtgaggttcctgcaactctgaagtacctgaattgtccttgtgatatttgtaagagagatattaacaattgatagaaaagagaggtactgcagatttcctattctctctgacaactggccatggaacccattgtaagacagccgtaatgcagttagatttctgcatgagtagatgctttctggaactgttccagaaaaattgttccaaacgacatctaaagttttcagattgggcagtgtggagaagttgacattggtgagcttcccgctgaagctgttgctcttgaggtcgatggttacaaggtttgtgcagtcactcaaagtccatggcagctccccggacatgttgttgttgtccagatggagcttctccagtcttttcagctgtcctatggaatctggaatgctaccaatgagcttatttcctccgagatcaagggtgaccagatttatgagcttcatgatgccctcaattgatccttctaactgattgttaggaaaagaaaggtgcttcaaagaggtaatattgaagagctcatatggaagggtcccactgagattgtttctgccagtgctgaggaatgtcaacttggagcaattaccaagccctggagggatgcctccactgaattggttattactaagttcaagcaaagcaaaggatggtgcactgacacagaacgaagttggtatattcccagtaaagctgttggtgctggcattgatcgcgacaagactcttcatcacctgccatgtggttgatggaaaaattcctgtaaacaagttgcttgatatgttcagtacctgcagaggccggtcaggggttgaagatggcaggtcactcatgcctcctgtcatgtagttaaaactgacatcaaggaccacgatgctgcttgatgacaccagttccagcggtaagccaccggacagcaagttgtgggacaagttgaggcgcatcagacctgtgagattgcaagggaagtgagatgaccccttcaaggcctctagaagccagaaacacatcagtaaccatcctgtttgggttgcaggtgatcccttcccatgcgcagcagtccgtgccattcttccatgacatgcccaggccaccat

SEQ ID NO: 58317 - DNA, 8286 bp, Oryza sativa
  unsure (1)..(8286): unsure at all n locations
atgtgaggaacgccaaatatcatgacactgtgaatggcctcatgccctcatagtatctctgggagtatctttggctcactggacgatgggcccaggactggttatctgcttcgatgctcacccgtgcagaattgcacacgtgttgctcccaaaaattggagtcatctccctcagctccggagacggcgaccggcgagcggcggcggcgtcatggtccctcttccgagcagcagtacggacatcgccggacaaccgagggtaaggtcagtttactcactctccgcgcgttcgcctctctgttcgttcgtcatgtgaggatttcgcttgctttaatgcgctgcgggtgtgggggtctagggtgtttctttagggttcgtggtgggtggggggcgatgcttgttgcaaacatgctcctccgattgatattcgtcgcaaaacgttgaacgattagactattagaggttgtcgttgcaaacgggagtgggtgaaatggttcctgccctaacattatgccctaaaaagtgatgatgaattttggtgtctcgattcatacccctgttagcctttgtttatgcgcattcttgtttcggtatttataccctggcattctggtgaaaattgtgatgcatccttctaatcctctattgccacagtttcctttttttttttctttgcacccaatcaaggaagaagcgtctactttttacaccgtcaaattgccgagtttgcgtggtacctttgggagagggcatttgtgcccctggcccgtgcaatttacgaacatgttattctgcaatttgattcatatttgaggagttattttttgaataataaatgggatcctgaaaactaacccacctcgaattcaaatttattcgagatacgcaaagaacattctgaggatggatgatgtgtgttcataacctcttaggactttttttttcatcatggtatacattttaccctgataaagggagaaatgaatctgtcaaaaagctgtacaaaggattagactggagtagtcattcttgcaaattacatgtactatgtgcactggtatacaagataatcctgtataactgcatcctatcttaagttttgactgaattttgcatctgcagtttggcgtctatactgtccaagcaggagactacttcctttatagtcggcctcatgcagggattacagttgacacacttgcaagcagtttctagcaccttcagcatttgctcgtcatatcctgtccctcgcagtattggatccaggacctcaatctgattcccttctgatttcatctcctgtacccacttgacaagttctttggatgaagacaagatatggacaggtcgtcttcctgtgagcagctcaagcaggacaactccaaagctgtaaatatcgcctttcaaagtagcaacccatccttgtccatattcaggtgggatgtagcccagagtaccaactagctccgtagtgacatgtgttttgttggcaaggattaatcttgctagcccgaaatcagcaacataagctttaaattctttgtcaagtaggatattgctggacttgatatcacggtggatgatatgtggcttgcaggcatcatggatataagaaagtccccggcctgctccttgggcaatttgagccgcttcggccagtcaagaaatgtactcgcatcatcgtccctgttgtgaagccagtcgtctaggctcccattctccatataagaatatataaggagccttgaatttccctgtatgcagtaaccccacagtggtacaagattgtcatgctgtgccatagaaagtgcttcaacctctgcagtgaattctctttccatcaggcacatctcaccaaaaagcttcttgatggccagcttggtgccatcaggtaaatcggccttgtatactagcccgtagcctccacacccaatgatattctccttgtcgaagttatttgtagccttcacaatgtcagcaaaggtgagcttgtttttacctcccttgttttgtgatactataactaatgattgctctgaatcagacttgtgcgaagttgcgtctacatctgcattctcgctactcctgttgttggttatacaatctgtaccctttacagtggcaagaagatatgccagaaatagaagaacagcaattcctccaaagaagacaccgaatgcagttgcaaaaatggctttcttgttgtgactttttgtggaaatggatgctgcttgttctgaacgacaactgcgatgaagaatatggccacataactttgggttcttgtaaaagctagaatttgtgaatgtactaaactgggctccatttggaataggcccttcaagatcattacaagaaacattaaatgtagaaaggaagtgcaggttgttcaatgctgatgggattgcacctgtgagatggttgctagacaagtctagcacctgcaaatttgtcaggttgccgagctgctgtggaatttctcctgataaatcttcgaacttaaactgagatgtcgagtgatttcaactgaccgatgtcttgagggatcacaccactgaagttattattgcttagattcagcacttttgggaaagcactggttatccggtattgaaagcccgctgcagatctatatataggtagctcaaatacccttggatccaaacgggtggtattcttctttgttattagcattggcatctccattaaagaagctggaatcccccctataaggctgttatttgataggtctagatggaacagtgactctagtcttttgatccaaggaggtatagatccactgagtcgattatctagcaaaaataacatctccaacttttctagcttcgacagccataaaggtatatttccagacaatgagcaattagctatggaaagaaccttaaggttctgaaaaccatcaattgagttatcttctggcatggcttcgccatagaagttggtcccgataagaagggtggtgaggttcctagaatccttgaggatccatagcatgtttgtgatatttgtcaagttgttgcaaccaaccgataagaaagtaagggacttcaaattacttatttttggcgaaagctgaccttgtaaattgttactagataaccgaagtgcgaccagattggtgcaagagtaaatgctttctggaactgtaccttcaaatttgttgcccatgagatctaaagtttttagattggacaggttggagaagttcacattgctaagattgccgctgaagttgtttctcttgaggttaatcgttatgagatgtgtgcagttgctcagggctgatggaagctccccagatatgttattatcacccaaatggagatcttgcagccttttgagctggcctatagagtctggaatccatccggtaatgttattcccctcaagatcaagagttgacagatttctgaggttcactatgagtgtaccattaattactccattcaactcattatttgggaaagagaggtactccaatgaggtagcgttgaagagatcacccgggagattcccgctgaggttattgtgaccaactttgagcactctgagcttcaagcagttaccaaaaccaggggggatgctgccactaagatgattataacagagtgcaagcgctgtaagggatgctgagctgctgcagaaattactcggtatgtgtcccgtgaagctgttgttgctggcattcagcataaccagattcttcatcatctcccatgtggcagatggaaactgtcctgtaaacgagttgctcgagatgttcagtacctggagaggccggaccggggtggaagacggcagctcatgtatctctcccttgaggtggttgaagctgatgtcaaggacggtgatgctgctggacgccatcaactccagcggcaagccaccggacagcgagttgtgggacaggttgaggcgcagcaggccggtgaggttgccaagggacggcgagatacgcccctcaaggcccttggaagccagcgagacatcggtgaccgtcccatctgcactgcaggtgaccccttcccatttgcagcagtctgcggcattccgccatgacaccgcgagaccgccatcgttggagaggccagagaggaactggaggagggagctcctctcctgctctgtgcatgagctggtgggagagccagagagagcaatagcagcagcgcaaaggcaagattgaacctaaggaaatctatgaaacatctattgctgcacttcttgcatgaggaatggagttgctgctgcttctgcatggcctccaagcaaatggtgcctacgcctgattctgattggatgtgcaaatgaaatggacctgatgatgctttgaggaagaggaggaagaagaaaacaaagcaagctgcttatgttgcagtcgtattcacaatatagaaaggaggattgggtcaagaataaggtgtagtggccacacatccacactgttgatgatgtgcacaattgccagtaagccactgcaggtgcagcttcctggttcacaccatataccagcacgtttcagttggagctgcctgccacaaaattttattaaaaatgtccaagtgcccaacctttttgtacaaaaaattgttgtctgcttttgcaatttgcatcctccctcgattatgtgattgttcaattggtattaaacaattgttttggtttacatgatgatatgagatgatattatatagtatgacatgtgttctgttcaccaactttacaatgacatcttttcagatactgcagtatgaagtggtaattgtttgtgctactgttgtcagtgttggtcattcccactcccactcacttggttctctgtggcctctgctccacttataaattattagcattggctaattgattcgctgtctctgtctgttctttttttatcccagaacaaatcggccgttgctaaaatttaaatattagataaatcttaggctatttttaatgtagttttttttttcaacattaacttttaagtcagtaaggatacatatataaaatgttttattcacattacttgttagtcgctaataaatcgtttggtatttaggtagttcttggtcaaccgatggggcattatggattgtgtaagttgattataatcgtgtcatttagagacgccaaagctatagctagtcttttttccacgcaagaaagggggtacagctagtttttgaccaatcatttattaacgattccatcctgcgtctggagagctcttgtcctatatgtacatgaattgtttgttggtcagagagataactctagaagttcagattgctgcgtttcaacaaaaatgttcagaatttcaggttgccaagtcatgataacatgtggccacggaaatggttggacaaattgctgcagtagagtcaaattgctgtacatgagttctttttaacgaaaattgctatacatgagtagatatgcattatgggactatgccactgaaagtctgaaatagttcatgtaaacatccaaaatttttagattgggcaatttgaagaagctggccttgcctcatctccgctgaaatgacaaacaccacagttaaatttatgcaatggatgggttaattgactcaacggttactcccacagtttcagtaagaacgtaggatgttttgattttgttttaaattaaacttatttaaatttaactcagtttataaaagaataaagccaaacaattactacctccatttcatattataagtcgttgtgaccatttccttgtcaaagtttgaccaatattataaaaaaatattgcagcatttccaatacaaaattaatctattatcaaaatatatccaatgttatatttaatgaaactattttaacattatagatgttgttatatttttctataaatttgatgaaacataaaaaaatttgacttagaaaaaagtaaaacaatttacaatatgaaacaaaagggtatatcataaaaatgtattcaaggttaataaaattaatttggcattctagatattactatatttttttcataaacttaattaaatttaatttttttccaggtgtcgaggatcgtctcgtttggcgttggacatctaaccagcgctactcagcgcatttggcataccaggctttcttccatggccaacattcctttgcctgtggtgatcttctctagcacgcaaagggttgctaaatgcaggttcttcttttggtttgctttccagcagcgctgctggacggctgatctcctccagaagtgtggcattgatagtcactcagcctgccctttttgcgctcaggatcttgagacggcgaaccacatcctcctcgactgtgtgtttgctcggcaggtctggctccatgtgctgtcgcctcctggctgggctgccctctctccccccctgtggcagctggttccaggactggtggtcgtcctccagggcctgcttacctgagcatctccggcgctgcttcgactccctggtgctcctggtctcttggcagctatggaaggaacgaaactctagggttttcaactctgcgctctcttcggtctcagtggttctggagtccatccacccagagggctatctgtggtctttagctagcgttgccgcttttggggacttgttgggagtgtagagtggctcgaccccttcctgctgcttggagtttgtatttagccgccgtagttttaagctccaacttcttttttgcttttttccccttccctctacataagccggtctggctgattgcgtcgtgtaactataactcttttcttctaatatattgacgtgcagtctttttgcgcgttcgcaaaaaatttaaaattttttacttgggacaaaacccaaaatagaggaagtagattaatacagagcaatcaattgtcacgcacgacgcaccctaagccccactattttaaccgtccgatcgtccgtgtacggtttggatcaaacggtcgcgggagattcatgggaaaatttacgtggaagccctcgaagttctctccattactacttctgtccctttttatgcccttactgagttgggccggaatacatgggcctcctccagtagtcgaggtggtcgtttccatttgggcccaacacgagacaatcttttcgttcttctcacagactagcggcggccggcgggggaggtcaccgcggccgccgccggcgacggcggcggctgcgggattgctcctcccggaccgctgccgcgcgcccgcgatgcccttgaactgttctacgacaatgccagggctggcctggtcagagtggaggcgcttcccttccctgtgaggtggcgcactcagggtgttcggcgaaatgctcgagtaacttgtaccgggcggcagcgagcgtggccataggcgccggaggatgacgccgcgtgtgtgcgttccgcaatgccacgctctcttcacgcgcgcgagtcaacctccttcgagatggttagtcgttctgcattctcttcccactccatactagtgcctagcatttgtgctggtcttttatccacgcatttcacagcactgcnnaaatctgtaatcgtatctatacgtctgacaatacctagtatcttcacttgaatgggaaccattttgatttttgcattgaaaaactcaaggaacataacaatttcctcacttgtttcgaccttttttcatgcctgtgcaacctgagaatgaacaatgtttaataaacagggaaaggaagacgcattacatacccactttctaatgtaaaaacaagtacagtaaaaaagggaaatgcctcaaaatcacactagcctgtcacacgctgtacagaacgaactataagatcaatcaaattctagttctagtgaaaccagatcaactctgttcacttaaagtacaagattatctatcatattattgcatctttaggtcagggtctatactgtccagactggctactacttccatcatagttggcctcatcaaaggattaccatcaacgcacttgcaagcagtttcaaggacctttagcatttgctcttcacaccctgtgccttgaagtgttgaatccagcacctcaatctgctttccctctgatatcatctcctgtacccatgggacaagttcctttgaagtagatagtattggaactggcctcctcccagtgagaagctcaagcaggaccactccgaaactgtacacgtcacctttcaatgtagcaacccatgcttgcccatactcaggggggatgtaaccgagagtgccgactagctcggttgtgacatgagtt

SEQ ID NO: 58318 - DNA, 16178 bp, Oryza sativa
tttatgaaacgtttagactgccatgtgtcaaagttcttgtggttttgtgaaacttggaccattatagatgaggttttacaaaaattactccttttttaaaatcaaaatttaatcacagaataatttgctgaacgaaaaaataggtttggatacaaaacagtaaaaaaatggtaatctatggaggactgtgcaaaaaggaagtacacaaatattaattcttctgctactatgagcttctctgtgcacttcaaaagtttaagtgcatgatcatcatgtgctatcatattctgatttaattgagttctgttgtttgcagctcagtgcctatgatgtctaggcaggagactacctctcgtatagttggtctcattccaggattgtggttgacacactggcatgcaacttcaagtaccttcagcatctgctcttcatgtcctgtgcctcggagtgttggatccaggacctcaatctgctttcctttggatctcatctcctggacccactcgatgagttcttttgatgcagacaagactggaatgggtcgcctcccggtgagtagttcaagcaggacaaccccaaaactgtacatgtcacctctcagtgtagccatccacccttgcccatactctgggggaacgtaaccaagagtgccaactagttcagttgtgacatgggttttgttgggaaggatcaatcttgataacccaaaatctgcaacataagctttgaattctttgtcaagtagaatgttgctggacttgatgtcacggtggactatgtttggcttacaaacatcatggatataagcaaggccctggcttgccccttgtgcgatcttgagtcgcattggccaatcaagaaatgaactggcatcgttgtccctgttgtgaagccaatcgtccaggctaccattctccatgtaagaatatatgaggagcctcgagtttccctggatacagtaacccaagagtggcacaagattgtcatgttgtgccatggagagcgtttcaacctctgcactgaactccctttccatcaggcacatttcaccattgagcttctttatggcaagttttgagccatcaggtagctctgccctgtagactaatccataacctccgcatccaatgatgtgctccctgttaaaattatttgtagcttccataatgccagtgaatgtgatcttgtcttctgcttccttgccttgctgcaacattactaacaaatgctctgaactgatgttggatgataatgcttccgtgtaatcattgctgcacctatttttggtcctgaaactcataccactgatcgaccaaaggagataccctgacaacataagaatgacaatggctccaaagaagacaccaaaaacaattgcaagtatgaccttcttgttttgttgtttctttgagatcaaatgtccatcagctgaactgcaatggcgtacaagcataggaccacacagctttggattgccataaaagctagaatttgtgaatgtatcaagctgaccaccagttgggataggcccttctaggtcattgtatgagatgttgaattcggaaaggaagtttagattgttcagcgcagctgggattgtaccagttagattgttgcttgacaaatccagcacaagcagatctgtgaggttgcagatcgactgggggatatctccatataatttgttaaagctcaaattcagtgaaaggagcactttcaacagaccaatctctggggggatcaaaccggtgaattcatttttgcctagattgagcactttgggaaaagcactggccttgcggtattgaagtagtgatgcagatatatatatgggtaattgaaatgctctacggtccaactgtgctgcagccctgtctgaccttagcattggcatctgtaataaggacatcggaatttctcctgtcaggctgttatttgatatatctagatagaagaggaagtttaggctactgatccagtctggtattggtccagttagtcgattgttgtctaactctagcacctccaaccttgagagtttcgatagccatcgaggtatttttccagataatgagcattcacttagggatagaacctgaagattctcaaaaccatcaatactgccatcaggcattctttcattcatgaagttgtggccaataagaagggtggtgaggttgctggagctgcttaatatctgaagtgcatttgctatgtttgtaagacagtttcctgcgagtgacaggaaggagagggatttcagattgcctagtccctttgataactggccgtgcagcttattggaagatacccgcagagcagttaggttgctgcatgtgtatatgctttctggaatttcaccactgaagttgttccgcataagatctaaagtttttagattgggtaagttggagaaattgacatagatgagctctccactgaaattgttgttattgaggtcgatgattttcagacttgtgcagttactcaagtttgatggtatgctcccaaacattttgttgttgttcagatggagttcctccaatctgttgagctgacctatagactctgaaatgttaccactgaagttgttctctccgaggtcaagggtagccagcttactgagtttgacaacatttgcccattcaagtgtcccttgaaaatcattgtttggaaaagagaggcactctaacgaggtagcattgaagatttcatcagggatagtcccactaaggttgttgtggccagccttgaggactctgagcctggagcaacttccaaatccagggggaatgctcccacttaattggttataactgagttcaagcacagataagtatggcgagttggtgcagaaattagctggtatatgcccactaaagctgttgttactgacattgagtgcaaccatatttttcatcactacccatgtggatgatggaaactgtcctgctaacaaattacttgagatattcagtacctgcagtggccttgcaggtgttgaagatggcaactcgtcaagatctccatccaggcggttaaagctgacgtcaatggtgatgagactgctggaagacaacagttccttcggcagggcaccagacagcaggttgtgagacaagttgaggcgcagcaatccagggagattaccaagagacggtgagatgcgtccctggaggctcctagaggccagggaaacatcagtgaccgtgctatcttggctgcaggtgatcccatcccatttgcagcaatctgtaccatcctgccatgacgcagcgaggccgccatcttgagagagctccctgaggaacctgaggagggagctcctgtcctgctctgtacatgaactggtgagagaggcgaggttgatgagcagcaccagggcaagggcaagaacaggtatgggaaatttgttgctgtgtttcttgcacggagaatgaagtgggtgcatggttttcttgtgaatctagcatggaaacttgatgctgagtttgtatctaagtatcttcactgggaaaagcatcagatggttatatcaagaaagagcatcaggagtaagaaagagtgtctattggttccattttattttggccttctctgacttggggaatgcatcagatggtcatacctagaaggagcatcaggaggaagaaagaaacgtctataggttccagtttatttcagccttcttgtcattgtcatcacaaataaatgctggtcaatgatttgatgctatagtatatgggtactcattaagatttaggacctcacaaaaactgtcagtgcagttttgttcgtcgcactatggcgttccagtagcggctgccagttatactattggaaagtcaacttctcgacattggcggccgtaagtaattctctccgtagccatccttaatttttaaccttaatcacgttgacattgttacaacatgccttagtttacttgatcaggcatgacttctcttaccagcttcaccatggatctcttcggctcttcgctagctattattccggaccaaattttgacacaacgattgaactgaaggatgctgcatcacctttattcaacaggaaaatgcactgtatttgcgaaagaacaaaaataattgctgaagatttgtaagttggagagatagcactacatggaattaaagcgtcattccaagaagtgtatatgatttacagcaatcatcatgcatcggcgtcgcggtcatggtgtgtacaacaacaatgaacaactggtgagtggagggaccaaaactgctgctcccttcttcggcttgaatcttgaccgtttacttgctgactctgttgttatcaagcgtgcgctttggtttatttgctccacacgcttgcagttgttttccgctttccactagtatataatgtaggttttcgctcttatgcttatgcctatgtttatgaactaaaatttaaattttaaaattattcttatcttaaaattgattttgtggttttatttatcatggtttattttttttgtatcactaagaatataaaaattttaccattaaattatttttttctttgctaataaacgttacgaatagacgtaagataagcgaaacgatggatcacgagcataaaatcctaagcatgtgatggatgggtggatgactagttaactcagacgatcacttatgtccttttttgttttttgaaatgagattataaactgattcactgggctttgatctattgtcagataccttctctgcatcccgccgccgccgccgtggaggcgtggaggtgtgattatttattggagaatgggcgcggagcggtgaacggtcgccttaccgagcggtggccatctggtctcgtttcaacggttcggatcaagtcgcgcgtgcgagcgattatataatacttcgtccgttttataatgtaagactttctaacattatctacattcatatggatgttaattaatctagacagtatgaataatggtagaaaatcttacattatgaaacggagggagtagtaacattttgcacgtgagcccttagactactgtgcattcgtgcttaagggctccttaaggaatgagccctttagttttttaggaattttagagaaaaattagcatgaactcacacctcctggaagtctttgtatcactcttttctccaaatcctatagcgttttcatgtgaagcatccaaactatatgactagacaattcttgtgttctatgatttgacattatttaggatgagatggtattataccgtcctaattcctttgttttcctgttgcctgtgtttttgaattctgctttttaaagtcgttccgggtaggatcactaccaatagtagcgatctgtatgctgcttggatcaaggttacaggcaacctcatgatatttctacttagaccatgttttttttcttcaactctaaattttaattttctcgatttttgttagtacgtgttttaaaatgttaaataatgtgtgtatttgttaaaaaaaatatacagaagttgtttagaaattcaagtaaaactattttttttttaattttatgatagttaatatttaataaatcatgtactaaaacatttttctcgtttcgaatgctttgatttaatcattaataaagctctctctttcatgtaaaaaaaaaattcccagcagctacgaacaggccattaggaatttaggattccttggactttttttttttttttgctcttctttgagttgggccggaatacatgggcctcaactcctcaagtggtcgttcccatttaggcccaacacaatccacaggcattcgttcttcccccagaccggcggcgacaatgtccctctctgccgccgtcgctcctcaaatccctccggcgagtggcgtgctcgcggctccgtatcctgtcctggcttccgccaccacccccgcagcgctgcgagcttgctcctcccggcccgtgcctggcaactctgggggaagggtgggccgcttccctgtgtatcggcgcgctctcagggtgttcggcgaaatgctcgagtgtcttgccacgggcggcgggtgaccgtggccgtagaagagctcgtgcggttgagaatgtcgatcagggattggttggtgctgcgtgagttcgtgctgctccttcgagatggttagttgtgctgcattttctttccactccaatactccatgctagtgcctatcgtttgttctggtattttatctaggttacaaccaactttagtcatcatttctagaatgcgttgagcggaaacaaatggcgggcagcagctaaatcctaaatactctctccgtttcaaattacttgccgttctaggtttgtactaagtcaaacattttaatctttgaccatcagtttctatatattatatttttagattcatcataagacatactttcaaagatagatgtatttgacttaggaaaaaacatagagtgacaaataatttgaaacagatggagtatcttggtatcttcacttgaatggaaacaatttcgactctctcagtaaaaaactcaaggatcataaccatgttctcacttgtttgtactttttgtcatgcctgtacaacttgggtgtggatagtgtttcaagaaacagggaaaggaagagaatcacttaaaacactttttgatggaattaaacattcactaagcaaaaacaagtaacatcaatttgctgaaatgatattagtctgtcccaagctgtacataacaaactataagacaagtcagaagtactacttatagggaactacaaaattatctatcatgttttaaaaattttatatctttatttcagtgcctatactgtccagacaagtgacaacttccatgatagttggcctcttcaaaggattacagtcaacacacttgcaagcagtttcgagcacctttagcatttgcttttcgcaccctgtgcctcgaagtgttggatccaacacctcaatctgctttccctctgatctcatcttatgtacccatgggacaagttcctctgatgtagacaagattggaacagggcgcctccccgtgagaagctctagcaggaccactccgaaactatacatatcacctctcaatgtagcaacccatgattgcccatattcagggggaatgtaacccagagtgccaactagttcagttgtgacatgggttatgttgggaaggaccaaccttgacagcccaaaatctgcaatatacgatttgaattctttgtcaagtaatatattgctggacttgatatcacggtggacgatatgaggcttgcagacatcatggatgtaatgaaggccctgacttgctccctgtgcaatcttcagcctggttggccagtcgagaaatgagctggcatcatcatcccaattgtgaagccaatcgtctaaactaccattctccattaaggagtatatgaggagcctcagattgccctggatgcagtaaccccagaagggcacgagattggcatgctgtgccatggatagtgcatcaacctctgcactgaattccctttctgttagacacatttcactattgagcttcttgatagcgatcttggaaccatctggtaactcagctttgtagactagcccatagcctccacacccaatgatatgcgccttgtcgaagttatttgtagctttcacaatgtcagcaaatgtgaggttgatttcttctccctttcctcgtgtaatcattatcaatgaatgctctgaatcagagttgaatgaagctgcttctaaatcaccatcgttgtcactactatttttggttatgaagcgtttgctcctttctgagacaaagaaacaccctagcaacaaaagaatgcaaatccctccaaagaagacaccaaatgatattgcgagaacgatttttttattctgttcttttctggacactgaacttgcttctgctgaactgcagtggtgattgaacctagagtcacaaagctttgggtttccttcgaagcttgagtttgagaatgtatcaaattggcctccagttggaataggcccctctaggtcattgttggaaatattgaatgctgagaggaagttcagattgcttagtccaggagggatttcacctgtgagatggttattggacaaatgtagaacctggaggcttgtgaggttgcaaattgattgtgggatctgcccagataagttgttgaagctgaaatcaagcacaacaagcacttccaactgaccaatcattggggaaatcacacctatgaagttgttatggctcagattcaacaacgtagggaagccagtaagcgtgcggtattgaaatgatggcccgttataaacaggaagctcaaaagcccctgggtccaaatgggctatgtctgatgttgatcttagcattggcaaattcatcaaggtgatcggaatttcttctgtaagtctgttgtctgatacatctatatagaacaggtggtttaaggaatcaatccatcttggtattggtcctgtgagttgattgccatttaaaagtagcatctccagattcgtgagcctggataaccatagaggtattttcccagacaacaagcaactgtttatgtcaagaacttgaagattcccaaaaccatcaatactttcgtcctgtggcatgacctctcctctaaagttgtgcccaataagcagggtggtaatggtgctgcaacttttaaggatctgaagtgcttttgtgatgttagtaagcttgttgtcatcaagtgagaagaaggaaagatacttcagattgattattcccggtgacaactctccatggaaatggttgcctgataaccgtagggctgtcaaattgctgcatgaatagatgctttctggaattgtgccggtgaagttgttgaagtaaagatctaaagtttttagattgtgtagagcggagaaattgactttgccaagatctccactgaagttattgtgcttgagatcaatgattgagagatttgtgcagctgcccagagttccgggcaactcgccagacatcatgttgctgtccaaatgtaactcctccaatctcttcagttggctgatagaatctggaatcttgccaatgaactgattccctcccagatcaagagttactagatttctcagttttgctatctgtgtaccatcaatttccccatgcaaattattgttaggaaaagataggtactccaatgagacatcattgaagagttcacctgggagtgtcccactgagcttgttgtgaccagccttcagaactttgagcatggagcaattaccaagtcctgaggggatgctgccactgaattgattgtaacatagttcaagcacagataaatttgatgagctgtcacaaaaacgagtcggtatcttcccagtaaacttattactgctgacattgagggcgaccagatttttcatcacatcccatatgaagatggaaactgccctgtaaataaattacttgagatgttgagtacctgcagtggcctgataggggttgaagatggcaactcgttgagacctccattcagcctgttaaagctgacgtcaacgatgatgatagtgctggaagacaccaattcttgtggtaaggcaccagatagcatgttgtgggagagattgagacgcagcaatccagtgaggttgccaagagacggtgagatgttcccctgaaggttcctagaagccagagaaacatcagttaccgtcccatcttggctgcaggcgatcccgtcccatttgcagcaatctgtgccgtcctgccatgatgcagagaggcctccatcctgagagagctccctgatgaacttgaggagggagctcctgtcctgctctgtacatgaactggtgagagaggcgaggttgatgagcagcaccagcgcaagggcaagaacaggtatgggaaatttgttgctgtgtttcttgtaatgaagtagctgcatggttttctggtgaaactaacatgaaaaacctgatgctgagctttgttcctgactggataggactaatcaatgaagagcatcaggaggaagagagaagctgcccttgcttccattttattctggtatactagtcgtaatcataaaaaagaaatacatgtcaaagattaggtgatatagcctatggatattcattaggacttttacagatactgccacaatatcttcttggcaaaatatggttatatagcatccagtttcgcctgtcttcttcggtatgacgtctcactagcgagtactattgaaacatcaagtggccgacctccctgatcgtgcaagttatttccttttgtttggaccattttttattttaatcgttgtcacattgacattgttacaacatggattaattgactccatctgacatcacttctcttaccagctgcacccctgaagccatgaaagacctgttagcttgccagttgccactgatgcgtacaaatttgttcatccttgagaagatcaaggagaaacgcccagggatcttccgactagttccacaaggtggtgggctagccggcgttggttcgaaatctcaccccttctatttatttgatattaggttcttccctaatattcacgtttttcttctgtgagaagatcaagaaacacagctggtgaagatttgtaagatcagctttgcaggtggtacatgggaagcatcattcggagagttgcatataatctagagcaatcatcggcgtcgcggtcgtggtgcggcacatgctctggacaccaacaaacacagctgattggttggtaatctggtgactatctcgtctctattattattgttgttgttgttgttgagacgatcacgcaagggccaaggcgtttactttctgctgtcaagcgtgcgcgttggttggcttatttgctccacacgttcagctgttatccatccttcaggcttcgccgttgtatgactgttgacccatggaggcatggactattatgacgctttgtggttgtggatgccatctgaattttggaagcatatcccctgtggatgccatctggctgatcacttgcatagttgcatcgggatttaggacaccacaggggatactggttgatcacacataatcatcttatgtattcttccgttctaaaataacttaaccgataatagaatatgacataacttagtacaataaatctataaacggattacgcaccaacaggctaacccttatgggcctacacgtcagaggtaagtagaagagcctcatcggtgtagacatggttgaatgtagagtactcttgaatgtacttcctggacctggagctacacaagccttagtttaattgaaccgttgtgtaaaaattgtattttttttaagtcatggtcatatatttctttttctgtttctaattccagtttgcgtacgaggtatttgcaaatttactcatttatggtgtatatatgaagtgtaattccaatcgttctatgcgcaaaggttatactatactatcccttaccatctctgtttatatgatcataattcaatttctgctgttctctaacaaacgacggcatgtagggaaaaaaaaacaattctaattggttagacttcggctgaaatccgtagaaaaatgaacgaggtattacaattttttttttgtggtttaaaagccaagaccgaaaagaatagactaccatataaaaaccctaaaatcaactaaccataccaaatatagtttagggtattgtgaacttttttttttttagaattgtattgttaacttcttttttttttgacacggataactttagtttccattaaccagcagcctcggacaaatcgccggagaggcggagaccaaactagttacaaactccggggcttggctccagtaacaagttgagccaggggccacggtaacagctccataggaggccattcgatcggccaccttgttacagattctagggcaaacagatatcaaaagaagtgattaacagggccctaatgattttgaacaaagctccatctgcactccgatccatctcctgggaagaaattgtattgtgaacttagagtaagtttaatagtatagccaactactagctccaattcatctataaccaatctaatagctcattcatacaatagttacatactacactattaatatctagtctcacctatcatacacacactgcgtcttggagtccgtgctataaatctgtagcccgctgcgcttctctctccttatttatctgcttaaaatatgtttgtagctggcttatagcctgctattgtaactgctcttattcctaaattttaactacgactgataagccaacgatgaaattaagttgggctggaatacatgggcctcgtgtggtcgtttctctccgggcccaacacgagcccgaaagcttcgatacttctcccagactagcggcggggaggcgaccggcggcgacaggtggccggctgcccgcggcgccgcggatttgccgtttgctcctcctccgggaccgtgtcaccgggcagcatgacgccgcgcgacggcgacgcggcgacgcccttcgactgttcgacgcaatgccagggggaggggttggggttggtctggtggaagtggaacggagccgctttgctgtgaggcgccttgctcagggtgttcggcgaaatgcccgagaggctgtccagttccggtcgggcgccgactgcggccgtcgaagatctcgtggaggtgggctcgtcgaccaggcgactgaggggccatgcttcgtgagtgcgtgccgacaatgccgcgctctcttcacgcgcgccagtgcgcctccttcgacatggtcagttgtgctgccttctctttcagctccatgctagtccctagcatttgtgctggtattttatcaacgcatttcacaaccaacttagcaaaatatcttggttagcagaatttcacaaccaacatggttagtagtgctgacctagttaattttttcaataacacattgatgatcggaaacaaactgcttatagcagaatatcttggtatctttctaacctttttgacgttgtttctacctttttgtcatgcctgtacaacttgagcataaatagtgtttcaacaaacaagtgaaggatcaaagcaagacgaattctttcagcactcaatgccctgaaatgatagtagtctgtcacaagccgcggagaacgaactataagacaagtcagtcagaagtactaattctagtgaaattacataaactcctgttgggtgaaagtacaaaattatctatcattgatgttatgtgtttcggtcagcgtctatactgtccagactagcaactacttccatgatagttggcctcatcaaaggattatagttgacacacttgcaggcagtttcaagcacctttagcatttgctcatcataccccatgcctcgaactgttggatccaggacctcgatctgttttcccactgatctcatctcctgtacccacgggacaagttcctttgatgtagacagtaaaggaacaggccgtcttcccgtgagaagctcaagcaggaccactccgaaactgtatatgtcgcctctcaatgtagcaatccatgattgcccatactcaggggggatgtaacccagggtgccaactagctcagttgtgacatgagttttgctaggaaggatcaaccttgatagtccaaaatctgcaatataagctttgaattctttgtcgagcaggatgttgctggatttgatgtcacgatggacaatatgaggcttgcatacatcatggatgtaagaaatacctaggcttgctccttgagcaatcttgagcctggttggccaatcaagaaatgagctagcatcatcatccctgttgtgaagccaatcgtctaagctgccattctccatgtaagaatatataagcagcctcgagtttccatgtatacagtaaccccagagtggcacaagattgtcatgctgcgccatggtgagtgcttcaatctctgcagtgaattccctttccatcaggcacatttcactattgagcttcttgatagctaacttggagccatcaggtagctcagccttgtagactaatccataacctccacaacctatgatgttctccttatcgaagttatttgtagtcttcatgatgtctgcaaacgtaagcttgttattgtctcccttgccttgtggcatcaccatcaatgaatggtctgaatttggattgaatgaggctgtttcttcatttctgttgttagctaattccccttttctcatcaactttgtagccctgagtgacacgaggagactactcagggataaaagaatgataatgcctccaacagacacgctgagtgtgattgctaaaataactttctttttgtgttgttttctggacactgaaggtgctcttgatgaatcacagctgcggaagatatttgagccacacagctttgagtttccaacaaagctagaattttgaaatgtactaaactgacctccagttggaatagacccttccagatcattgttagaaacattgagcttagaaaggaaatgcagattgttcagtgcagatgggattgtacctatgagatggttattggataagtcgagcacctgcagatccgtaaggttgcaaagcggttgtgggatctctcctgaaatactattgaagctgatattgagtgtccggagcatttttagttggccaatctcttgtgggattgcacccatgagatggttcctggctagatttaatgttgctgggaaagcacgaaatccacggtattcaagtgatggtcctgtataaataggaagctgcaggatccctgggtcaaaatatggtgtagaatttgctgatatgagccttggtatctccatcaaagctgttgggatcccccctgtcaagctattgtttgatatatcaagatagaagaggaagtttagtctgttaatccaggcaggtatttgtccagtgagttgattgttagataaatctaacatctgcaaattagtgagttttgataaccaaaatggtatgttcccaatcaatgaacagtcatcaattgatacaaattgcagattctcaaagccatcaattgtttcatcctctggcataagctcaccattgaagttcactcccataagcaaagtgctgaggctcctggagttcttgagtatctgaagtgtatcagtgatattcgtaagagaattgttggaaattgaaaggaaggagagggacttcagattgcctattccctttggcagctggccatggaatttattggaagacatccgcaatgcaattagattgctgcatgaatagatgttttgcggaattgttccattgaagttgttaagcagaagatctaaagtttgtaaattgggtagggtggagaaattgatcttggagagctctccactgaagctgttgctcttgatatctatggttttgagatttgtgcagttgctcagagtcgatggcacctctccatacatgttgttgtggcccaaaaggagttcctctaatttcttgagttcacctatagattctggaatcctgccattgaaattgttccctccaagatcaagtgtaaccagattacttagtttcatgatatgcgcactatcgagtgttccatttaaaccattgttgggaacagacaggtgctccaaggaggtggcattgaagagttcatcagggagagtcccactgagattgttttgaccaaccttgagcacatttagcctggaacaagctccaatccccgggggtatgcctccactgaacaggttgtaacaaaggtcaagcaccattaaggatggcgagctcgagcagaaatgatccgatatctgcccagtaaatctgttgttgctggcattcagtgcaaccaggttcttcatggccttccatgtggtggatggaaactgtcctgtaaacgagttgctcgagatgttcagtacctgcagaggccgaacagcggtcatcggagatagcgggtcttgcagctcccctctgagtcggttaaaactgacgtcgaggacactgatactgctggaagaaaccaattcccatggtaggtaaccggacagcgagttgtgcgataggttgaggcgtagcaggctagtaaggtttccaagagatggtgagatgtgcccttcaaggccctttgattgcaaggagatatcagtgacc

SEQ ID NO: 58319 - DNA, 11155 bp, Oryza sativa
agatatggtaggtaatttgctgctatacctgttgatggaaaatggagtgctgcatgattctctgatgaaactatgatcaaaacaagatgcttggcgtgtaaagaatcaattgtgtagtcaagaacgagccatgaggaggatgaaagaagccacttttgcttctaattttgttttggacttaccggtcgcagtccatccaggattagatatttagatgcaatagcctataaggagtacttgctaagttttcacaagattgatgcatggtctttgttaacgcgtgtgctgttaaattctctaccggttgactgtagaatgatctattgcacagtcaaccttcctgggtatactagctactaccggatgggatatatcatagtactacgaatctggacaggtctctgatactagattgctatattatggcacggatcaatatgttttttttttactgaagcattaattctttactcaatccttatcacgttgctcttgttacatcatggttaatatttgaccgtatatatcacttatgttaccaggttctccccagcttgtattttgtgataattcggttgaagatttgcaattgtgtacatggaaaatcatcattccgagaggtgcatataatttggagaaatcattggcgttgtggtcatggtgtgtacgcatattttggacaagaacaaattgagcacaagtggtggtggtgagtgggcgacccggtgtgttgctgtcttcttcttcttgaccgtttactttctgttatcaagcgtgcactttggcttatttctccacacgtttgcagctctttttccatcttctaccggctccactgttgtatcattatagaccatggattatgactggaaatttgggagaaatttgataatttgacactttattcattgttgttttgctttaattgatacttgtgcgaatgatatgtgggaccatctgagtgaatgaaagtgaccagaacatgatgttaaatactccaagcccacttttgtggaatgtcaagttgtcaaatctgtcgaaattttggaagcgtgaagaaaagtacaatgggtaccgtatgagggctggatgatgtggggcaagctatatcacttgggacatcatggtggagccctgactcttgtacagacatatgtggtctatggaacggactggagccacagaattgcactagaatctgggctcattttgcaagctggtgtaagacttgtcctcctttatcatggacatatttttctaattttaattccgatttgcttacgaaggtctgttaaaaagttcaggtgatatcatttcgatgctcggtagtaggtctagtgcacttcaattattttgttccattgtctttgggacataatgcaagtatgcaaccacctagacagtctttctttctttttttcatgatcatttttcttttctgtttcttattccaatttgcacatgagatatatgcagttttactcattagtttatggcttatatgaaaatctgtgattcgagtcgttatatgcgcaaaaattatatagtactaccttcatcctaaaatgttgctatctaatgtaagatgaggcactacctagtgctacgaattttaacaatgatgtctcatcttatattatgtagtacttactctgtttcacaatgtaaatcattttagcattttccacatttatattgatgtcaataaatctagacatatatatttatcttgattcattaacatcaatatgaatgtggaaaatactagaatgacttacattgtgaaacggagggagtaacattttgggatggaggtactatctcattcaccaaatgttgaggtaaccaacataaaaaaaaaaggagcgagtagtactacctctgttccaaaataagtgcaactatggatatccgtgtccaacgtttgaccgtccgttttatttgaaaattttatgaatttttttaaaaaattaattacacttaaaaggactattcatgttttatcatttattaacaataaaaatactaatcatattttttttcaaataagacgaacgatcaaacgttggacactaatatcgcaaaactgtatttattttgggacggagggagtactatcatctctgtttatacaatttataattgaatttctgcaatgatcatactagtgcttctgtccataaaatcatagacatcgccgttatgccaagggatggattcatcgattagccttaagttgggctggaatgtgtgggcctcgtgtggtcgtttcccttcgggcccaacacgagcccgaaagcttccatcttcttccagattagcggcggggggaggcgacggcgaccggcggcgacgggtggccggaattgcggttccgtatccctctcctggcttccgcccaccgcgccctttgactgttcgacgcaatgccagggctggcctggtggagcggccgagcggaggtggtggagccgcttcttcgctgttaggcggtgcgctcagggtgttcggcgaaatgctcgagaatctggccggcggcgagtccggccgttgaagatctcgtggaggcgaagggaccatgcttcgtgagtgcgtgctgcaatgccaagctctctccaagcgcttcggcttcgcgaggttagtgatgctgcattatctccccgtcccatgctagggcttagcatttgtgctggtgtggttcacttatctattctcttccggtattaagaatgcgttgatcggcaacaaacatctggcaacacctagtatcttcacttgaaccgaaaccattctgacttaatttctgagttaaaaacttaatgttctcagtcattgttacttttcatgcctgtgcaacttgagcacgagtagtgttcctaaaaacttttgtttagtttatatccatcacgcacatttcacctttgagcttcttgatggcaatcttggagccatcaggtagctttgccttgtatactggagttaatggcttaccacattcttcactatatcgatctttttacgtggttggtactctcattcttttgattgactagatgcgtgttcagcttctggtgatcacagagttttatccctaccaccccaaaaactgcgttgcattctcattctcttccatacttgaatcacacatttctggcatgtattcattagattcctgtggtttctatgtacgtcaatcagaaacaagagtgctgatatcacctaattgccttagcatttgcactcgatttgtttgagcacacaaagaacaggatgatttggcaggaggctggcctagtctagctctggttgtagacaagtgtagctcctagcgtttcactgccgtgaggcggtgctgccccggcaatttaagtttgccgagcatttatgtactaaactccttttaaaatctaatgaaattcagatggcgtccttctgccgtcccagcgaaaaaaggaacaggatgatcttttcacttgtttatacttttcctcatgcttttcgccaattgagcgtactcagcacttccttcagtggaggagaaatgtctggttatgaaactaaaaactcctgagaagatacaaaagtgcaaaatggtaatatgtcagcagctgtacacaacatgttacaagaccagaaaaactactactacgtaataccacatttgctctatgcactgagctacaattttgtcattgtataactgcaatctaccttgactgccttgtgccttctatatcttcagtcggagcctacactgtccaggcaggaaactacctctgtgatagttggccgcatgcaaggattacagttgacacatttgcaagcaacttcaagcaccttgagcatctgctcttcattccctgtgccttggagtgttggatccaggacctcaagcatgtttcccttggacttcatttctagtacccatggaacaagttcctctgatgtagagaggattgaaacaggccgtcttcctgtgagtagctcaagcaggaccactccaaaactgtacacatcgcctcttaaggtagcaacccatccttgtccatactcaggtgggatgtaacctagagtgccgactagctctgttgtgatgtggtttttgttcggaaggatcaatcttgacaacccaaaatcagcgacataagctttgaattctttgtcaagtagaatgttgctggacttgatgtcacggtggacaatgtgaggcttgcagacatcatggatatacgaaagaccctggcttgctcctcgtgcaatcttgaaacgtgttggccagtcaagaaatgagctggtttcgtcatccctattatgaagccagtcgtccaggctaccattttccatgtaagaatatatgagtagcctcgagtttccctggatgcagtatccccacaaaggcacaagattgtcatgctgtgccatggatagggcttcaacctctgctgcaaactccctttccatgaggcacatttctccattgagcttcttgattgcgagtgtggagccactgggtaactcagctttgtacactagcccataacctccacatgctataatattctccttatggaagttatctgtagcctccatgagatcagtgaatgtgagtttgtttgcttctccactgcctcgtggtatcattaccaacaaatgctctggatcagaggtgaacgaaccggcctccagatttccactagtgttgcttttgttttcgattttgggaattgcatccctgagcgagaaaaggaagtgcgccaatagcaaaacaattgcggcccctccaaagcaccccaaatactattgcaagaatgaccctttgttcaactgttttttggatgctgaggcttcttctgctgatttgcatttgtgagtgagcatagagccacacagctttgggttaccatcaaagctggaatttggaaatgtactaaactgagctcctatgggaataggaccttcaaggtcattgtttgaaacattgaatgctgaaaggaagttcaggctattcagttcaccaggaattgaacctgtgaggttgttattggataaatcgagaactcgcagacttgtgaggctgcaaactgattgtgggatctgtcctgataaattgttgtggctgaaatcaagtacgacaagcatttttaactgaccaatttgtggggggatcacacccatgaacttgtttaggcttagattcaacagtgtcggaaaagcagtacgtgtacggtattgaagaaatttaccatcataaacaggtagctcaaagaaactaggctctgaataggtcttattctgggttgttcttatcattggcatgtccatcaaggtaattgggatttctcctgctaggctgttgtttgatatatccagatagaacaggcggtttagtgagctaatccagtctggtattggtccagttagttgattgttggataaaaatagtaacttcaagtttgtgagctttgatagccaaagtggtattcttcctgataatgaacagtggtctactgagagagcctggagattctcgaaaccatcaatggtttcatcctgtggaatgacctcttccatgaagttgtacgcaataaacagggtggtaaggttcgtggagctcttaaggatctgaagagctcttgtgatatttgtaaaagaattgttactcaaagataggaacgagaggtacttcagcttgcctatttctgatgacagctcaccgtagaaattgttatacgagagccgcagtgcaatcaagttgctacatgagtagatgctttctggaactttaccactaaagttgttcatgtcaatatctaaagttttcagattgggcaatgtggagaagttgaccttgcctagatctccgctgaagctgttgctcttgaggttgatggttgtgagatatttgcaattgcccaaagccgatggaagctcaccatgcaagttattgttgtccaaatggagctcctgcaatctactgagctgacctatagtatctggaatcatgccactgaagttgttccctccaagatcaagtactaccacattactgagttttactacaggtgtactaccaatgtttccttctaaattattgttgggaaaagagaggcagtccaacgaggtagcattgaagagttcgtctgggagagtcccactaaggttgttgttgccagccttgaggactctgagcatggagcaatttccaagttcagggggaacgcccccactgaattggttgtaactgagctcaagcacagcgaaggatggtgagttggtgcagaaattagttggtatatgcccactaaagctgttgttactgacattgagtttgaccagatttttcatcactttccatgtggaggatggaaactgtcctttaaacaaattgcttgagatgtttagtacctgcagtggcctggcaggggttgaagatggcaactcatcgagacctccattcaggcggttaaagctgatgtcgatgacaatgagacttctggaagacactaattcctgcggtatggcaccggatagcaggttgtaggacagattgaggcgcaacaatccagtcaggttgccaagagatggtgagatgtgcccctcgaggctcctggaaggcaatgaaacttcagtcacggtcttatcttggctgcagtttatcccttcccattcgcaacaatccatgccatccttccatgacatgctgaggcccccatcctgagaaaaccccgtgaggaaattgaggagggtgctcttctcttgctttgtacatgaactggtgggagaggtgaagttgagcagtagcacaagggcaagaccaagaacaggtatgggaaatctgttgctttgtgtcttgcatgaagaatgaggtggctgcatggttttctggtgatactagcatggaagccttatgcttagtttgtatcctgagtttctgactgggcaaagcatgagatgatctaatcaagaaagagcttgaggaggaagaaagaagtggctcttgcttccattttcctagcacgtgacaactttattctgtttttctactcgaagtcataaaaaagaaatacaggtcaaggacttcataaaatcttctattgaaaagtctgagtggtctgcctccctgaccgtacaagttattttcctttaatcatttttatttatttcaattttcctttaatcatttttatttatttcaatccttatgacattgacattgttacagcaatcctaaattcacttgatctgacaccattctcttcccttgacagatatgtttgcgtgctactaatacggtcatttttttacacaaggatgcataccttttggtaaggaggaaaggactcatgtctgtaaaaagaaacaaagcttctgaagatgcttgaagagtttaagtaagctagggtgtagtctagtgattgcagtgacctgagtaataccccaaggttctgagttcaaatcttcataggagcgaatttcagagattaggttgtttgcggggctaagttccctatttcaatggccgtatatatccagttggatgtagaggccgggtaaaaaatacccttctctaaaaaaaagaaggtagcgtgtgagggctgcaagtggcagcaggctgatcacttgggagttgggacaccacagggaagcatagaaaaactttattctgattgtacgagggatatcaagttcttgacattttgatatcaagtttcttgatacgacctatacaattccatagcaaaattattttagggcttgtttggattgaagctaatttttgccctaccaattttattacgattgtacgaggaatatcaagttcttgacattttgatatcaagtttctcgatacgacctatacaattccatagcaaaattattttaggcttgtttggattgaagctattttttgccctaccatttttttgacaactttaataatatcgcatagatatttggtttgctacttaattttggcaactcttaactagattgatgcatgaatatatgctttgcggaattgttcctttgaagttgttaagcataagatgtaaagtttgtaaaaattgggtaaggtggagaaaatgatcttggagagctctccactgaagttgttgctcttgatatctaatctatggtttcgagatttgtgcagctgctcggagtcgatggcacatctgatctctccatacatgttgttgtagcctaaatggagttcctctaatttcttgagtttacctatagattctggaatccctgccactcaaattgttccctccaaggtcaaggttaactagattacttagtttgcaagattgctgaagatttgcaaagattcacttggaaagatggtactacgttacatggaaatcatcattccgagaggtgcacataatttggagaaatcattggcggcggcgtggtcattggtgtgtacatggtttggacaagaacaaattgagcacaactggtggtggcgactggtgagtggtgacctggtctatttctctcatcttcttgaccgtttactttctgtcggaaaagcgtgcgctttggcttttttgctccacacgtttgcagcggtttcctcttctggttccaccactgtgactctgaattctcgtgagaaatttgataatttgacactttattcgttgtggatttgttttaattaatacttgagagaatggcacatgggaccattcggataaatgaaagtgggctataatgttaaataatcgaagcccacttttgtggagggcgaaattatcaaatctcatttttggaagtgtgtgaagacttgaagtaaaccggttagcgcgtgaggcctatatgtgacaggggcaagctggttgaacacttggaggtgggagggacaccatggtggaggctgattcttcgttcttgtgcagacattatcatttcactgcttttgggcataagcgaaacggtatatttacaaatgaaaaataatttgtaaataaaacttgtatatacgtattcttaacaatctaaaagtaaagactaaaaaataaaccatgatgaaaaaaatctcaaaatcaaatctaaatttaaagttgaaaattcaaaatttagctgataagtataagtatataagcgaaaagatgaggccgctggtttattgaaacggacgggagccacagaattgcacaagaatatggggctcattgaagctggtgtaacacttgccctccttttctttttatcatgatcatgttttgtaatttcaattccaatttgcgttttgagatccttctaaaaatttcaggtgagatcattttgatgctctatagtaggtgtagtgcccttcaattattttgttccgttgtgttgttgaccaatctttttgtaataatcatatattttttcctgtttctaattccaatatgcgcatgagatatctgcaattttactcatttattgcttgtatgaaatgttgtgattctaatcattctctgtttatacgatcattattcaatttctgcaaacattatattaggacttccgtctatacagagagtagatagacatcgcagttttcttttcttttcttctctttttttttgagagaagacatcagtaagacagtaactgtcttaagttaggctgaaattcgtgggcctcatgtggtcgtttctcttcgggcccaacacgagcccaaaagcttcccatcttctcccagaagattagcggcgggggaggcggcggcgaccggcggcgacagggtggccggatttgcggtcccgtctccctctcctgggcttccgccaccacccgcgggcgcttctcctccaccgggaagcctgccgtcgcgcgacggcgactcccttcgactgttcgacgcaatgccagggcaggcctggtggagcggaggcggagccgcttcttcgctgcttgaggcgaggcgttcagggtgttcggcgaaatgctcgagagtcgcttgtccagtcctggtcggtggcgacttcggccgtcgaagatctcgtgggcggcgactgtgcttccgcttcgtgaggttagttgtgctgcattctcttcccactccaagctagggctagtagcatttgtgctggtgtggtattcacgtattccgcaactaatgatagtcgtatctactacatatacaatgcgttcatcggcaacaaacagctgacagttgacaacacatagtatcttcgcttgagtagaaatcattttgacttaatttctcagtgcaaaactcatggaacataacaacattctcgctgcttgttacttttgttgtcatgcgtgtacaacatgagcacggttagtgttccaataacaggaaaaataaaacacattacatgaactcttatctactactactaatatagtgaacggcaatgcctcaaaatgacattagtctgacataagctgtacagaatgaactaaaagaccaatcagaaatactagcactagtgagactagatcaactcagttcactgaaagtacaagattatttgtcatattattgtatctttaggtcaggccgtcagggtctatactgtgcagactggctactacttctatcatagtaggcctccgcaaaggatcacctttgacacacttgcaagcaatttcaaggacctttagcatttgctcttcacaccctgtgccttgaaatgttaaatccagcacctcaatctgctttccatttgataccatctcctgtacccatgggacaagttcctttgaggtagacagtatcggaactggcctcctcccagtgagaagctcaagcaggaccactccgaaactgtatacatcacctttcaatgtagcaacccatgcctgggcgtactcaggtgggatgtaaccaagagtgccaactagctcagttgtgacatgagttttgttgggaaggatcaaccgtgataatccaaaatctgcaatataagctttgaattctttgtcgagaaggatgttgctagatttgatgtcacggtggacaatacgaggcttgcagatattgtggatgtaagaaaggccatggcttgccccttttgctattttgagccgtcttggccaatctagaattgtgctggtatcatcatccttgttatgaagccaatcatccaggctgccattctccatgtaagaatatatgacgagc

SEQ ID NO: 58320 - DNA, 6263 bp, Oryza sativa
aagattgtcatgtcgtgccatggagagcgtttcaacctctgcactgaactccctttccatcagacacatttcaccattaagtttcttgatggcaatcatagagccatcaggtaactgtgccttgtagactaatccataacctccacatccaatgatgtgctcctggttaaaattgtttgtagcttccacaatgccagtgaatgtgagcttgttttctgcttccttgccttgctgcaacattaccaacaaatgatctgaattggtgttcggtgataatgcttctatgtaatcattgttgcacctacttttggtcgtgaaactcatacccctgattgacagaaggagataccccaacaacaaaagaatgacaatggctccaaaaaggacacaaaaaacaattacaagtatgaccttcttgttttgttgtttctttgagaccaaatgtctatcaaatgaactgcaatggtgtgtaagcataggaccacacagctttggattgccataaaagctagaatttgtgaatgtactaaactgtccgccagttgggataggcccttctaggtcattatacgagacgctgaattcgataagaaaggttaaattgttcagtgcggctgggattgtaccagttagattattgcttgataaatccagcattagcaggtctctgaggttgcagatcgactgggggatatctccatataatttgttaaagctcaaattaagcaaaaggagcgctttcaactgaccaatctcttgagggatcaaaccggtgaattcattgttacctagattcagcactttgggaaaagcactggccttgcggtattgaagtagtgttgcatctatatatacgggtagttcaaatgctctagtgtccaattgtgctgcagccctgtctgaccttagcattggcatctgtaataaggccatcggaatttctcccgtcagattgttatttgatacatctagatagaagaggaagtttaggctgctgatccagtcaggtattggtccagttagttgattgttgtctaaaaccagcatctccaacctcgagagttttgataaccattgaggtatttttccagaaaaggagcatccacttaggtcaagaacctgaagattctcaaaaccatcaattctatcatcgtctggtatactttcattcatgaagttgttgctaataagaagggtggtgagtttgctggagctccttaatatctgtagtgcattgttatgtttgtgagattgttgtaaccgagtgacaggaaggaaagggacttcagattgcctagtccctttgataactggccttggaatttattcaaagatagccgcagggcagttaggttgctgcatgagtatattgtttctggaattttaccactgaagatgttctgccgaagatctaaagtttgtagactgggtagattggagaaattgacattcatgagctctccactgaaattgttgctattgaggtcgatggttttcagacttgtgcagttgctcagggttgatggtatgctcccaaacattttgttgttgttcaaatggagttcctccaatctgttgagctgaccgatagactctggaatgttaccactgaagttgttctctccaaggtcaagggtagccagcttaccgagtttgacaacatttgccccttcaagtgttccttgtaaattattgtttggaaaagagaggcactctaacgaggtagcattgaagatttcatcagggagagtcccactaaggttgttatggccagccttgaggactctcagcctggagcaacttccaagttcagggggaatgctcccactgaattggttgtaactgagttcaagcacagctaaggatggtgagttggtgcagaaattagttggtattttcccagtaaagctgttgttactgacattgagtgcggccagatttgtcatcactacccatgtggaggatggaaactgtcctgctaacaaattacttgagatgttgagtacctgcagtggcctggcaggggttgaagatggcaacttgtcgagacctccattcaggcggttaaagctgatgtctatgacgatgagtttgctggaagacagcaattcctgcggtaggacactggatagcaggttgtaggacaggttgaggcgcagcaatccagtcaggttgccaagagatggagagatgtacccctcgaggctcctagaagcagtgaacatcagtcacggtcctatctgttctgcaggtgatcccttcccactcgcaacaatccacgccatccttccatgacatgctgaggcctccatccttagaaagcccggtgaggaaattgaggagggagttcttctcctgctctgtacatgaactggtgggagaggtgaagttgagcagcagcacaagggcaaggctaagaacaggtatgggcagtctgttgctttgtgtcttgtatgaaaaatgaggtggctgcatggttttctggtgatactagcatggaagttggatgcgagtttgtatcctgagttcctgactgcgcaaagcatcagatggtctaatcaagaaagaacatgaggaagaagaaagaattagctccaacttccattttattctgtctttctagtcatggttataaaaaagaaacacaggtcaagaactttataaaaaagaactgctatagcagcttcttggttcacattatgacgttgcactagcaggtgcctgctatatatatatatattgaaaaaccaagtggtcggcctccctgaccgtacaagttgttttccttttaatcatttttatttcaatccttatgtcattgacattgttacagcttgcctaaattcacttgatctgatgtcatttctcttccccttgacagacctggttgcttggtactaacacacacaaatctttacacagcttctgaaggacgcataccttttggtaaggagcaaaagactcgtctctgtgaaaagaaacacagcttctgaagatttgcaagatccactttgcagatactacatgcaaagcatcattccgagaggtgcatataatttagagcaatcatcggcatcgtggtcatggtgtgtacatgctctggaaaacaacatagcacgactggtgggtgattgggtgggtaatctggtgctctcttcttcaattcttcttcctgttgacccaagggccaaggcgtttactttctgttatcaagcgtgcgttccggcttatttgctccacacgcttgcagttgttttccattctcccggctccactggtgtatctttgtagaccatggattatgactcttgtgtctatctctgaattttggaagtgcttgaagacttgaagtaagctgcgtagcgtgtgagggctgcaggctgccagtgggagctggcttatcatttgggacaccacaggggagactggttcttgtgtagacatggtctatggactatggaacggactgaagccacacagatcttcaggtttgtgagaattccatttcttccttccttcttttgtcataatcatatttttcttattttaattccaatttgcatacggagctggtttaaaaaagttcaggtgagatcatttgatgctttgtagtaggtgtagctgcactttaattaattcgtcccattgtctttgggacataattcagccacccagaccttaatctttttttaaggggcacccagacggccagaccttaatttagctgaacagttgttgtttcgaaaggcatttatctgcagatgagatcctctaataaaatcaacccggatcgttctgatatctgatgatctgtagcaggcgcaattgcactttatattcatgtccagcttctgcggtatgatgttccatgtgctaatacaggtagctcaaaattgtttgtgtctgcattaactgaaaaaatatagacagcaagtttctgtcaccaaacaccatcaggatctccatatgaaaattacatagttgcaattacatatgccatccctcctgcttgtttatttcccatgctttcattttctctcttatacgtgttttatgtcgttggttatatggttcttttgacaccatttcaggtgcagcacaaactggagaaatccttcggccagaacagaaacagcatggggaacacaagatgattacagaagatcggctgcacaaagaccaattctagaaacagcatagaggccatttccagttcagacgactgtagtgctgtactgctgtgctgcacgtcgtacacgtcgaagtctgaagaggattgctgcactgcagatcaatcaatgattttccaattttcgtcaaaacaagaaaccaatgattttccaggctcatggacacggtctacccaggcacccatccgtagacggtaagcgatcctaatcatcactgtaggagtagcggggccctgtgtcttttgtcgtgctgcatatcatatcgtctatggaagaatacatgggccgtgtttagattcaaaatgttttcttggaacttccaacttttccgtcacattaaatgtttgcacacatacatgaagcattaaatatagacgaaaaaaaatcaattgcacagtttgcatgtaaatcgcgagacgaatcttttgagcctaactgcgcaatgatttgataatgtgatgctacaataaacatttgctaatgatggattaattagacttaataaatttgtctcgcagtttacatacagaacctataatttgttttgttattagtctatatttaatactttaaatgtattttaaatgtatggccgtatacttaaaaaaattttggaccacgaactaaacacaaccatgattaaaattagtctcgcctagcgtttcacacctgtccacttgcagtgcaaaattatgaaaaactgatggcgatctggcgatgaatgaatgaatgattcggaccgccgctacgttgttgctgccgacgcgttcgttggccgtgtgtccgtgtctcggtctgcagtcttcaggttcagaaagttttctccttgttctgaagtcttcagaggaaaattttgtttgttttttactccatcgtcccgtggattctgcaatttttttttataaaaaatgtaatttgttgtttcttcagtgtctcagtccgatcggaatgaaatggaatggaggagatggcggtgtgaactgtccttggtagtggagttgtggattggctcgtatacgacaaatgtatttggatatttggcacttgttatcgctggaaaaaatatagtcaagtcgtgtacgaggaaaactgcatgctactaccatacatacgaaggatatcaagttcttgacattttgatatggagcatagcaaaactgttctagttctcgtttgaaatgcgagaatgtgttcacaaaaggctgattcattttatttaaaattcacgcaatattcctctgttcgaaggaaaggtcttgttgtgtttttctttttcttttttttcttttctagtgcaggctgatctgctgtgctgagtgcagaccgtggcagaagtgatttacttttccttgtataagggggtgtttaaatccggggtgtaaagttttagcgtgtcacatcgaatattatataaggtatcgcatgtggcagggtttacattaccggttgaccactaaatttcgaaccccatcggtatcaccgttttcgataaattttgatcggttttcgataaatttcgaccaaatctattgtttatccttcgaaattccaatcgaaacttaattccgagccatgtaaacatcgaaatttcatggaatttgaccggtttttgtcggaattatgaaccctggcatgtggtgtttgggtactaataagaaaactaattacagaattcgtcagtaaagtgcgagacaaatttattaagcctaagtaatacatcattagcaaatgtttactgtagcactacattgttaaatcatggagcaattatgcttaaaagattcgtctcacaaattagtcgcaatacgtgcaattatttttttagcacatatttaatacttcatgcagatgtttaaacgtacgatgtgatagggtgaatatttttggggtgtgctctaaacgaggcctaagagcatcaccaacagattatctataattttctcctaaaaatttgatttttgggttttctaaactgaaaatagaaagtgaaaaaactcctctctccaacagatagcctaaattcaatccccaaaacttaaaagtgagcccttctgttaaactaccaaaagaaaa

SEQ ID NO: 58321 - DNA, 11161 bp, Oryza sativa
  unsure (1)..(11161): unsure at all n locations
taatcaaatttttaggagaaaattataggttttttcactttctattttcagtttagaaaacccaaaaatcaaatttttaggagaaaattatagataatctgttggtgatgctctaggattctattctggaatcctttcgcttttatcggtttctcccaaaaagccggatcaatagcaattatagccgagtgcaggaccgtggcagaagtgatttctggtgcaccaacgggtgatgagccctgcagcccctgctcacatttgtagaatttttttcgtttttagatttttttttaatatttacagaaataatctatcggcgagaaaaattgcaaaaatagaccctgccgcccaccattggggcggcaagctgacgtggcagacggtgggtcgaccgcgccgtctgccgccgtcggccaaaattccgattaggcccttgccgcccatacagagggcggcaagggtctaatagaattttggctgccctcaggagcttgcggctgtactttttgcatctgggtcccttgccagatgtaaaaagtacggccaaaatatttttctatgtaatgttaataaaaaataaagaagtatttgttggtaaaacttgttaatattgttataaaaatgtattgaagttggttgttgcgcaatttcatatgttaagtgaggtattattttgtaccttattcgacgtattagtactcggataattaatataggcctatcgcagtctcggtcgtagaaacattatatggacttaaacaaggagaattatgtaacatgaagaaatagtagtacaatttgaacatgatacaactatttcgattgcggttacatagatgatattagattcgaactaggagggaggtagtgtaatagttgaacacaacgacgatgtagtaatgggacaaggaagcatgacggtagaaattttaatttgccaagttgtccgataatagctaacccctacgtgaggatccctctcctctctcaaaccgcgctttagtaaccctgtattgctctggtagttcaagctgcacaacacggcaaggtggagttagaacccttctggtgtctatccattctctgtattgacatctccttggtggttcctgggaggaaagaatagatgtaaagcgagcaaagttagtaaatgttgtgagaaaataatgattaatgtaatcaaaatattcttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctttaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatttgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctgcgccagtttggatcctcaacaccccggcgtctagccattgacgaaagccggtaggatttgtaatgaagaagtggggaagagagtactgaatgtgactgagttctgaaagattgtgaggcctcactcgttaaggcgacttatatatgcgcaaaaaatcgagtgatatccttgacatgtgaacgtggtggggcatggcgggtacgactgattggcgccgaaagttgcacgcttgatcggcgccgaaagttacgttggtcgtatgcggcaaatggcgggcaaatactcgtagagcatgcgaataaaggaggctgcatcggtgcgggagaaagcaatcgtgcatgcgccgaaaggtatcgtgcatgcgccgaaagatatcgtgcacatataacaacaacgtagtcattacataagcatacagtactggaaagtcaagcaaataaacaaagagaagattgctctactggccctgccccgcgccgcgaccacgcttggtcctccgggcctgtgctcgcacgtggtcctgggagtaggtgaaacgatccggtggcacagcacgggtagcacgagtgtctggcggaggagtggcctgcgcctggtcctgcgtctgcaccggcggtgcgcctcccagctgtgaggggccgatgacgtcctctgccgagcctgaagcgaagtcgaagtcagtgatgtcgaagagcacggtggaagacagcaagcggtccgacgaggtcctagcatggtctagtggtggaccttgactcgacgtgccggctgcctgtgacgaagccccggtgtactgctggaactgcgctgagtgcgaggtcgacgcagctggctgagacgctgaccctgcagcgtgggagaagtaggcggcctgcgtcatagcgaactgggcgaaacctacacatcgacaacgggaccttgtaagctaagacataaaatacatgtaaattgattatcgaagtaatgttgttttttaagtacctatggggggcacacctgaaggcctagccgaggaaggtggggtgctgaacggtgcacgaaaccctgaatcaatcggcaagtgaaacggctcacatatatgtgcgaggcatgtacagaaaaatccttaaaaatacttacctccgtgcggagggggagtcggcctaggaacgtgcgcagctggacggggaccagtcggtacgggtggccgctgtacagctgcgtctgcccgagcaatgtcgtctgcacgacaggtgagcactcggagaatcgagcgcatcgactccaccatccgcgtgtacgtcgtcaggtgctcctctacgggtaccggaatccctgcgtctaaacgttggatcgtcgttgaaccgtcaacgacgacccggttgatgtcgtcgacctgcatggttaatttgttcatacatattcgtaacatttgacgatgagaaagacatgaaaacataaaggaatggtgcgatgcagggtactcacagcacgagcgaagtcctggtcgcggtgcctagcatagaggtctctagtgctcgcaacgtggggctgctgctccaagggagcgaaggtgaccctagtacgggtgtgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgactgctgacccttgcgtgagtacctacgaattaatgtgtaatattagtgtgaaacgacagatgttacaaattattgcaacaatggaaagcgtagtgcaagatcttaccggtgaacagcagctgggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcaatcggcagaaggcggtcgaactccataacaaactcaggatacgaccgcctaatctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtcgtgcacgagtcccttgtcgaccgcgtgcccgtgacggccacagaacatcacccagccaaaaagccagagcaagtacgcctccaaacatcggctgtaggagtactcgtcggcctccgcctgtagctgctcaacctgcaagcagtcgataaaatgttaggcaccttaactgcggactaaagatgtaatacgattgtcatttcggtaaaaaacactcacggtgaactgaagtagccacctcttcgtaggtccggtgttgcggtggtgtgccaacggctggagcgggaggtgcggtgcgcgctgtactagtgcgaaacgtgccgtcagttcgtcctgccagtctacagccgtggtcactggcccaacagcgtctcccgcgagcggtagccccaacaagcacgatacgtcctgtagggtaggggctacctcacctcacggcaagtgaaaagtgtgcgtctctggcctccatcggtcgaccaaagctgctaggagggacctgtccacagtccatcgtctggccgggtccgcatggccggcggcagcctccaccagccgacacatcggtaggaggccggcctcacgcagcctgcaataagaaattaatatgtcattacaaaaaatattacagcgcaactaatttatagtaatatactgttcgtacctctcgacgaaggagtcgtgaaccgtgagtagctcaccgcacgtccgtgcccggaacgtcccaagctgagccccctgcaccgcagtaaggtgagaccggtgtcggagatctatcgccgggtccaacagctgaggtgtatcctgacgtgccatctctgaaaaatatagtgtttcgtattagaacaattcaaaaagtagtaatgtaaaacaaaagatgactcgcaagttaatgaaatagtaaaaaaatcatgagaataattacgtacaacaagagtacagcctatttaaataaagcaaacgttactaatggtacataacgatgacgtgcaatttaacatatatgtagagttcgataatataacataacataacataatattacgtgtcgaagtccgacatacatcagcatacgtaaagacactaggtgccttagtctgacgttatatcacgagacctaaagacatgacaagccgaagtctgaaattacacgacgaaacataaacacatcgataagttcgaaacagattacaagcaaacccacatgccaacatagaacataagaactacaccacgtagccagacgtggcacgacgacgcctaggacgtggtcgagtggaggtagtgccttcacccgtagggcgagctccatctgctgctgatcctgatagtcatgcctccgccgcacttggtttctccttgtctttaggacaatgcttgtaggtgtgcccacgttcatcgcatttgctgcaacgcttcaccctgccagcctccgactcgtccatattgttgcagatgcgacgagtcctcctccttccagccttgcctcggagcttcgatgggtcaggaatattgagtacttcatcgttagtctctgtgaactccccagctatgccgaaccggtaaatctcgccgctccatgtatgatatattgcttgcttactgaagtactgcgacacatatactgcatctggtatgccacactccgctgcggcagcaatgacatgggtgcatggcctgtggagcagcttcggctttgaacaagagcaatgacatgtgccgtcggttttgagaacacactcctgcttcactctcttgcggtagatacccctgcctgccttatcttgacatagtatctcgaacctatgttgttgggtaccttgcactagagctcgatgtttcatggcctttttatgcaactcctctagctttttctgcatgaaagttccaaacaaaatgctgttgttcggcatagagggaagaattgcctggaaccgatccctaaaatacctgtatgtcccatgtaaaatgaactccactatgccaactagtggcagtccacggacaccgcgcatcacccagttgtaaacttctgccaaatttgttgtcattattccatatctagcaccaccggtgtcatacgccttggcccatttctcttttggttcatgcagaatccactgagaaaatttccgaatctccaatccagttcttctaaccaaagttggactatccgttggaagaggtccaagagcttgaggagggtcatcaacggcagtcgatggagccgctgcacgctgatcactgcatttggctgtcaactcatctaatctcttccaaagctcattgaattttttctcctggttctgattgcacagcctcctgaacatgttcacgagctccttgttcttgaattgcttgaagaaattagctcccatatgacgcatgcaccacctactctgtacatcgtcccaaacaccagggtatcctcgttccatgctcccaaactgcaactcttctatcgttcgcagaatgccagcgtgcctatcatgtatcaggcacacatttggcctcatactaacaacttttgttttaaccaatttcaggaaccagtaccagctgtcggtattctcactctcaacaaaagcaaatgccaagggaaatacctgattgttcccatttacccctattgctgtcagtatctggccccgatactttcctgtcaagaatgtcccatcaatgcagataactggacgacagttcacgaatgccatcttgcatgcatgtagagctaagaacgccctttgcagcacactcttgccaggatgttcaattgatgggaatttcttcacttcgtaagagctcccagggtttctttcctcgataacaccaagcaggcgtggcaaattgtcatacgagacttcgtatgttccaaatctcatctctattattttctgtttggccctccaggccttggcatagctaatagtatacttgtatgtctcctcgatgtgtcggattattgaccttggttcgtatgtgagattatcgatgacatgcgcatacatctcagatgcgacaaatgcacatgtaatgttcctgtggtatttctgaacaccaggtagaaaacatgtatgcttggtaacgactgacactgtccaataatccttccatttccccttatacgcgtgcactctccagggacaaccatctttttccttaacacaccgaacttcatattgcgaccggttggacttggcagcccaaaactctctatgaagtgacactgcaaaatgctttaccgcctccttcatatcttctgttctactataaatcgctccctgaataacctcattttctttgtattcccatctcacactatcctcttcagagacgatcagcccagaaaaatcctgactagcccattctgctggattaatatccgtctcctcatctgacgaatcaccttcctctacacgcccgttgtcagaatcctccctctccatttcatccacaatggctgcgacagtctccccctcgtcggccactccacctggttgaatgcccactggagctactacgcccccgtccactcctgcgttgacctcctccacagaagtctcatttacttcagcgcttggtccctcgctatcatccatgttcatctgcacacctggatccttcgggtgcacaaacggaaccaaagctagaggccacccacgttgcattgcattttccacataccatctccacacttgggagttttgaactggcattagttcccaattgcccgacttactataacattgattgttatgtcacttgtctgtggatcaactctcaaacccctcattaaccatccttttatagaaggtacactcctctcagccggtctctcaattcccctttctgatacaataaaatctgacagatctaccccagttggcccgtaacggacgtttcctggtccatggtaaacttgaaatattggtttgttcgacatatctgtcaacgaattaactagatcatattactctttcatgcaataaacatctacaacgtaatatcttcttgtgtaagccaatgcaacggtaaaatattgattccaaactagcagatctacgttgttaccgatatctacaatacgcacttctaaattagtacaactaaaaccataaaaatataatgcatttattcaaataaattttttaaaaatacacactatttaactcaatagtcacatataggatctacgaatattacctgaaatcggcgtctgaatccggcagggcttcgccccttcttctcttctcctcccctctcttctttttttttcactggatttgagaggtgaggaatgagggctgggggctgggtggcaggccttttataggcagcgaggcctgccgcccggccagagggcggcaaggggccgcctgcaaaatggccggccccctgccgctcttttgcattcggaccccttgccgccccaccagagagcgcaagggttttcatgcaaaaaacccaccctccgtcaacgcccgttcctcccccgtttgtcacgtcagcttgccgcccaccattggggcggcagggtctatttttgcaatttttctcgccgatagattatttctgtaaatattaaaaaaaatctaaaaaggaaaaaaattccgcatttgtacggatcctctcccggcccaaatggcccaaacaaatccgatccagccagcagcccgaggcccatgttggaggcccggtcgatctcctacaggcgatctgaagaaccatctcctcaccatcctcgccggccaaactgcggcctccaacacgcgccggcgggcggaggctcgcggcagatgcgcccggcaggtcaggccgccgccgtagcccgtagatagggtgcgcgcaggacggagctgttcgtggaggccgtggggtatgcgctcttgaggtaaatcaaagcttcttggttgattctcctgtctttgtttagggattgggacgtggctgcaaaaactttggttgagatttctggcatttctcgatgcggattagcggcccactcgttgtaaatcacacatgaaaaatattcgaaattgtttagggattggggcgtggcagcaaaaactttggtagccactaattaatacaagaacattttgcattcacgtatgattgtaagacgatgcatttactaacagatttcagtttacttcagtcctccccgcaaaaaaataaaaaataaaaaataaaaaagagagagagtttaattctcagtgttgtaaactcatagtagaaggagcatcatttgattagcacactttgttttgtgtggtaaattaacatcttgcatcttatatattgtggatcaggccatataacttatttcttttttgcaatatgtatgacttgaaaatgcttgttttctttttgcataattgatgctagctaatttggagaatttgatctctcaatatggatatgtttacagctatatttagctgatattatgttgatgtacattttggctttctgctaacaagttgtgtactatttccagtccaaagagagatctttttttttttttttttttggggcaaagagagatctctttaacaagctaagttttgtataactgtgtgagtggagctaaaatgataatataaagctttgattgggatgtgaaaatccatgggtggactcaggtgcatggggtctatcaagaatttagataattattgttagcaaacatgttttaagtgttcctctgctttgtccagtacctttgtgtattgtcacattgctattagctttaggagcaagataagggctaaagatcaaataggttccagcaatgccaaatatttcaccatgttacaaacaccaatattggttaaagtttctaagtattttggtttgttccatttggtttttggcagcttcagtatggtttttgtgagctaactttttattgaaaattttgctttgcattgcccagatgtctaatctatcagagccctcaaaagaagctgtgtcagctgacgattcaagtgctgtccagaaaactggagcatggagtaacacgttgaacattcttctgcaacaaacttcagtctatggtgtggctgctggttattgcctgtcagcatctctgctctccattatcaacaaatgggcagtcatgaaatttccttaccctggagcattgacagctttacagtacttcactagtgttgttggagttctcttatgtggacaactaaagcttattgagcatgatggccttaatttgaggaccatgtggaagttcttgcctgctgctgtgatgttctacatctccatcttcacaaacagtgaacttctactccatgccaatgtggacactttcatcgtgtttcgctctgctgtgccaatttttgtggccattggagagaccttttatcttcaccaaccatggccatcactcaagacatggctttcgctttcaactatacttggtggaagtgtgatctatgttttcacagacaaccagttcactgtgactgcttacacttgggcagtggcatatcttgcaagcatgtccattgactttgtctacatcaagcacgttgtcatgaccattggcctgaacacatggggccttgtgctttacaacaatctggaagctttcatgctcttccctcttgagatgcttctaacgggggagcttaatcagatgaagggcgacaatgctaaagtgacaaactggctttcatctgatgtcattcttcctgttgctctgtcgtgcttgttcgggctatctatatccttcttcgggttctcctgcagacgggctatctcggcaactggatttaccgtgctcggtatagtgaacaagctcctgactgttgtgattaatctccttatctgggacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58322 - DNA, 773 bp, Oryza sativa
aaaaggaaaattaggaatgtaaagacgacgccgtaacgacgcaacacacctgtcacgcatcgccacgtttccttttgtctccccaccctgacctgtccgcgcgatggacaagtagcgcacgtcgcccaatagtcaatccgcctactacggttggaataagtcaatttgctgtccctcgaatttacgttgagtccgatagattaccagatttgccctttgtactgcttagacctccccagaaaacgtgtcacccccggttcgcggcggctcggccgagtccagtcccgcaggggcaaaaccgtccttcagactctcctcccgataaccggcgccgcccagcccatcagtccgtccgccccagaggccccaactccccaggtccgtaattttgataatttgaccctttgaaaaaacttattttgatattgatccatgtcaaaacctattttcaaaaatagaccttttttcgtgccattcgctgagctacaacatcatagcgccacttactttggcgctgagataccgtccgacatgtcactggtgtcacacatcatacgatgtcagcgccaaattctttggcgctaacctccgtggcttgctatgtataaatactatgcatgtactaccgtgatacatggaagatttggcctagtggtgaaagcccgcctctcttaactagaggtcaggcgtaccacgaagatgttagcatgaagagctctccaccaagctatctcgttttttttttcagttgtggtagcttgtagcttgataat

SEQ ID NO: 58323 - DNA, 1339 bp, Oryza sativa
  unsure (1)..(1339): unsure at all n locations
ttttcacgtttgtaataattaaactcaattaatcatacgttaatatcacatcggttgatgataatgcctaccacctgaataatctctcccctttgggaaggctctctcaagtctcaacccaaggactcgaactggctggtcccacctgtcattggctttaatatggtcgacgcatcgtcctgaaggtgtctgcttgcttttctttctttctttttttttctctcgcttccaagttacgcccgccgttaaaccctagctccttccccggcggcggcggcggcgggagggggcaggaagcccggagatgccaccggcgtcgtcggttgcgtcggcggtggagaagctgcaggcggcggcgcaggacgcggcgaactcctcgtcgcgctcggcggccgccttctccgagcaggcgcaccaggtcctcgtgcccagggccgcagggtatactctcctctcctcctcacttgccctccacctactctagcttgaatgttttcgcacattggagctccaggttcagctcaatttcttgcttgccttgaattggtttggtgctggatttgcagtatcgaatgactccaattgctcccgatttgtgccatgtagctactatctgaaataagcaaactgcaattaggcgtgtttacaaaaactgatcagagtttgatagggtgatttggtatgtcctatgaaaagccataccgactgagggattgtaaaataggtcaatagctcgaagttgagaagtgctcttcgcaattaggtggtgcagtgttcaagtaacttttggcatcactggcatattgagttcctgaattcaggagtattgcaagggctcgtctcaaagttgagtgtattgatatgttgcaaggggtctgtatttgtatagctctcgtgtcatacaagatgcaaccagaagaggcaatggtgagttcagaagaatatgagcagattccattgtgatcctagcagctcattgagttcagagtagataaaattttagtgtctttctagatcaaaagctacgaggtttaagaccgtgagagtacttgattgtgattgagctgtgttcagaatttcagttggatgaacagtgaatatattgattgtataactgtgtttgagttgcaaaatagcctagagtttgtgtgcattggtgctgctgttactaaatctgaaagcttaacaacaagagctagacatggttgcataccctatatatatattctgcatgcagctttccttgacgacgaagtcccatgacttgccttcttggaaagggagnnnnnnnnnnnnnnnnnnnnnnnnnnnnnnnnnnnnnnnnnnnnnnnnnnnnnnn

SEQ ID NO: 58324 - DNA, 3766 bp, Oryza sativa
tattaagctcgatgatagagttgtaatttcttcctagaaagatcttttctcctcctcactcagaactctaaacatgtactccctccgtcccataaaaaacaaatcagtactgatatattctagtacgatgaatctacatatgtatgtccagattcgtaatagtactaggttggtttttatgggatggagagagtaataatgatctaagagttttactcccgtcggcgtccggcagcctgtaccagacggtactagtaccgggaggtacaagatcaaatctggccgtccatcttgaaatgatacgattgggaaacagaaaagagaagcggaacgattccagagtcacgccgccgctttcctccctagctgcgctctttctttcctccctccccgcatcgcttctttctcatctattcctccctccgagcgcagaaacggagcagttgcgccgcatccacgccccgctggacgattttttcccatccatctaccgtccgcgccgcggtgctggagaaacggcgcgctcgccccgcatccacgcctccgccagtgcccattttttccccatccatctgctgtccgcggcagcgaagccaccgacgcgctccgtcaccagcaacgccgccgcattcacgagcgaaggtgccgtggtattctgtgtcccctatccccccccctcgacggctcaagcaagtacctaacctcccccgctgccatcggcgcagcctaggcccccattacggctcaaacactgctccactatatggtctagttattttgtaatgaacaattcaatctgccatgtttcttgtaatgaatttgtgagaaaagcacaagcttttgctggagactttaatctttgaatggaaaattttaagctcatctgtcgtctgttttttttatgctgtttacagggcatgatctatcgttgaatggagcttttgacataatttttgtctgctgtgaacagagcatgatatatatgtcgtattgagagccattaatattttgtctgctgtttttgctcgatctcctgtaaaatacatgtcattctgcggagtgatcagcagcacaacaatggttacaaacaagtgttttcaatgaacagcaatccagctagagatctaaaagttgaggaatcactggagtaaagtgctagacacatgggcaataattgctgaaaaaaagtataatttacatgattctgaaagactgaaacaaacatactcgtactagtgagctgtaattcagagtttcagacagtgggagtgttaaatatgtgacaatatattcggattagtttcccagtaggagtttctatcaggtgtatttattttatccccctatatatactcttgtaagccgtacaggaaggggtgacgttcacattgtgattcccctacgtttgtaatcatctcctctgtagtgatcattgccggtcggcatccatggttttttcccgcaagggttttccacgtaaaattcgtgtctccgttgtgcatatattttcataacaagtggtatcatagcattggacatcaatctactaatcacgcggccaccggtgtttttgggatcggagaatcaatctgatcagcggcggcggcggcgctcgtcgttcgttggtgtcgtcgagttgccgacttgccgtcctcctgaccgccctgcgcatccacgcaggagcagcagcagtgccgcgtggaagccgcgcgggagaagcagaaaagcaggaggagcaacagcgtccaatccatccaaccagcgcacagttcccgagaaaacaaaaataatctaccgagagatttctgatccggttgattttttcaaagtgggaattgctacggccacctaagcttgtgtaccaggagataccctgatctacgcttcgtgcacacggaaagtgcaccagaggttcgcgtttttgctagatttaccctaatttctttctagcaaattcaggattaattcccatagcgagtttgaagtatgatctaccgctcctggaccaacacacaagattctcactttgacaagtgaagatgcgagccgttcttgcacaacaagacctcgatgatgcactttctggatttgacaagaagacacaggattggtccaacgatgagaagaaaagggatcataaggctatgtcatatattcatcttcatctatctaataatattttgcaggagatgcttaaggaggagatagccgctaggctgtggttgaagctggaacagatatgcatgactaaggatctgaccagtaagatgcacctgaagcaaaagttatttttgcacaagttgcaagatgatgggtctgtaatggaccatctctccacttttaaggaaattgttgctgaccttgagtctatggaggtaaagtataatgaagagaatttaggccttattttattgtgttcattgcctagctcatatgcaaacttcaaggatactatactttatagtcgtgatactctaactttgaaaaaagtttatgatgctttgcatgccaaagaaaagatgaagaagatggtaccctctgaaggttcaaattcgcaagcagaaggcttggttgttcggggcaggcaacaggagaagaacacaaacagcaaatcaagagataaaagttcaagtggctaccgtgggagatcaaagtccagaggtaggtataagtcatgcaaatactgcaagagagatggacatgatatctctgaatgttggaagctacaggacaaagacaaaagaaccggaaagtatataccaaaaggtaagaaagaagaggaaggtaaagccgcagttgttactgatgagaagtctgatgcagaattgcttgttgcttatgttggttgtgtacaaactagtgaccagtggattcttgatactgcatgcacctatcgcatgcacctatcacatgtgcccgaatagggattggtttgccacctatgaagctgtccaaggtggtactgttttgatgggtgatgatacaccatgcgaggttgcaggtattggaacagttcagatcaagatgtttgatggctgtattagaacattgtcagatgtgcggcatattccaaatttgaagagaagtctcatctctttatgtactcttgatcgcaaagggtacaaatattccggtggagacggaattttgaaggtaaccaaaggctctctcgttgtgatgaaagctgatattaaatctgccaacctataccatctgcgaggtacaactatattaggtaatgttgtagcagtttctgattcattatctaattccgatgctactaatctttagcatatgcgtcttgggcatatgagtgaaattggtttggcagaattgagcaagcgaggattgctagatggacaaagcatcgggaagctcaaattttgtgagcattgcatctttggcaagcataagagggtgaagttcaacacatctacacatactactgaaggtatacttgattatgtgcattctgatttatgggggcctgctcgtaagacatcctttgaaggtgctcattacatgatgactatcgttgatgattattcacgaaaagtttggccttatttcttgaagcacaaatatcaagcttttgatgtgtttaaaagagtggaaaactatggttgaaagacaaactgaaaggaaggtgaaaatccttcgtactgacaatgggatggagttctgttctaagatatttaaatcatattgcaagtctgaaggcattgtgcgtcactacaccgttcctcacacacctcaacaaaacggc

SEQ ID NO: 58325 - DNA, 1223 bp, Oryza sativa
ggagttagaagaggacatttatatggagcaacctgaaggttttgctgttcctggaaaagagaacctagtttgtaggttgaagaaatctctttatgggttgaagcagtcacctagacagtggtataagagatttgactctttcatgctttctcagaagtttagaagatccaattatgatagttgtgtttatctcaaagttgttgatggttcagctatatatttgcttctttatgtcgatgatatgttgattgctgcaaaagacaaatcagagatagcaaagttgaaggcacaattgagtagtgaatttgagatgaaggatttgggtgcagcgaagaaaattctcggtatggaaattactagagaaagacattctggcaatttatatcttagtcagaaaggttatattgaaaaagttcttcgtcgtttcaatatgcatgatgcaaaaccagtgagtattcctttagctgcacattttagattatcttcagatttatgtccacagtcagattatgatattgagtacatgtctagagttccttattcaagtgcagttggttcacttatgtatgccatggtatgttctcgtcctgacttatcacatgcattgagtgttgtcagtagatacatggctaatcctggcaaagagcattggaaagctgttcaatggattttcagatacctacgtggtacatctagtgcttgtttgcagtttgggagatctagagatggacttgttggctatgtggattcagattttgctggagatttggataggagaagatcgctcacaggttatgttttcactattggaggatgtgctgttagttggaaggcaagtttgcaagcaactgatgccttatctactactgaagcagagtatatggctatttctgaagcttgtaaagaagctatttagcttagaggtttgtacactgagctttgtggagttacgtcttacattaatatattttgtgatagtcaaagtgcaatatgccttacaaaggatcaaatgttccatgagagaacaaagcacattgatgtgagatatcactttattcgaggtgtgattgctgaagatgatgtcaaggtatgcaagataagtactcatgataacccagctgatatgatgacaaagacaattcctgctactaagtttgagttttgctcaagcttggttggtgttacagtatagtcctagagactatttggcgcgcggtgagggg

SEQ ID NO: 58326 - DNA, 1116 bp, Oryza sativa
  unsure (1)..(1116): unsure at all n locations
ctcggcgacgagaaaggagatgagccggcgacgaccggatctgggagggcaccggcgagagcgagcgacggcggccggggagagaggatacgaggtggcgaggtgagagagaggaggcgcggcgacagggttgccggcgagagaggaggcgaggggcggcggcagagaccttcaggcgagggcggagaccttcaggcggcggcgaccttttcttttttttttgtctcctttcccttttattcctttctgcttttttatttctatttagattttttagtatattgatatttttttggtgagaatttggaggggtatactcaccacctctaatgaaagggtgattgcaaccacttatccatcccactcccccaaccaaacaaaaaaatggatcaccatatccactttcatccctacaaccaaacaaaaaactagatcgtcatattcactccactaaacaaaaaactagatcgccatatccagcaaaatatggaccgccatatcccatccaaccttgaccgggaaccaaacacaccctaacagtcgcgcggcgcccacgattggtaaattaagggacattagaagcatcacattaatgttaccccatcacaaagagatcgatcagaatgcatggtcgttgtcaaacaagcttcaacgtcacactcaggccaggtcagcagagcacaaattggtagacaaaattaaataagaaaaacatcatttttagtcttcttttgtatacagtactcgcgtttgtttagtgagaagagtatatatagaataaggccaaattggaccatttgatagtagtcctgtgtcccaattcccagatggccccttagcatgtcggtttaatgactttattaatcacacacctagagactagagagagagagagaggggtgggtgtggaggaagaaggtggcgctcacttgcatatgggtcccatctcgaggccgccgaccgcaatcctcaactgtgtttggatggtgggtcccatctcctgaccgcaatccgcaatcctcaacttggcagcccatttttttttggnnnnnnnnnnnnnnnnnnnnnnnnnnnnnnnnnnnnnnnnnnnnnnnnnnnnnnnnnnnnnnnnnnnnn

SEQ ID NO: 58327 - DNA, 1335 bp, Oryza sativa
caagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtttgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggt

SEQ ID NO: 58328 - DNA, 953 bp, Oryza sativa
cctggtatgataggaattgaccaggctggtatcgatgagatggtcagcatctcacttaggcgactaatggaagacgaggctgtcaaggagcgcctttgccagtccatccttgtcactggaggctgttctttgatcccaggcatgatccctcggctggaatccggaatccggcagtttcggccctacctctcacccctgaagcttgttagagcagccgacccccttatagatgcatggaggggcgctgctgcctttgcagcttccagcaagtttgggaggcacaccttcagcttagcagattacagagagcatggagaaaacttgtttcatcggtacaacattgtttactccttgtagtatctttggcagcatgggctaacatggatatgctgacacccaatgttgttacatatttatgaacaaagaacacaagtcaatttattgacaggcaatagcagtaaccatttttgaagcaactcggtgttcggcgtaattttactgtggcatttatggttttattatgtatattggcctgttagctttagaaccttttaatgtaagacaatggtagcttgcatattatacagagagggtcttgagtttcgtcaagaattttggtttcggttacgttatatagtcagcgttttattgtcctgtataatttaccgtcgcgaagaattctacacacattattataaattgtcaataaaaccatatcgaaactgtcaagatggccgagttggtctaaggcgccagtttcaggtactggtccgaaagggcatgggttcgaatcccattcttgacaagaaattttttttgttttttgggtaaaaaaattgaattttcggtcttcatccctctctctgcaactcaaatttcatgaaacttccctaaaaactcgaattttcggtcttcatccttctctctgcaactcaaatttcatgaaactcgaa

SEQ ID NO: 58329 - DNA, 8570 bp, Oryza sativa
aggaccgaggtcttgtataattttcttccgcgggcggcggctacggccatggagatctcgcgactcgcgggtcgcggccatgtgccggtgaggtcggcggcttcgccggcgtctccgcctccgcatctacgcctgattgatcccccccaacctatctccactgtgctatcgcgtttcttgcggacttgcggaggttgtggttgaggcagtagcctgtggggcggtgatgcggcgccgagatcccgctcgtccacggatttccggtcgccatcgccgggattcgtcttctccggccaacccctcgccgcgccgcccgtcctcggcccggatctggtcgggatcgcttgtggtaggtgttgggcacttggggtttgaaagacagcatcgttgatgtgctttgagttcctgcctaattgacttacgctgactctgtcaatatcaacatcttcagttactattcccataatccctaaaatcccagcagttgcgtggtaggttatgtaaagcgcattcctgtgatgaaaaatagaccctaggagacatataatcaattgtatcaagtgatccaacacactaggtccccaaatattgtcgtagataccattttctcttcagtattctgtttaaagactgatattggtctttggatgatgtgcttgttcatcgcaccagttgatctttactattggtgcatatttagttccaaggcgtcgttttagttaagctgctgaagcgttgagcatcttgtcatgctgatattcttatgagtggttcaagatggtttgttctgttttagtggaagtgaaagaaggggctgtcccctgcttatgggaagagaaaaagagatgtattttagcaaccatgtgtttacagtacaatccaattagttcactaagctattatttatggctgttatatcctgttctgagtatttatttgttatactgtaatggtattaaatttctggcattgttatacatgattatattcgatcatatacagctattagtaattcatgtagttagagctgaatgggagttttgctagaaagacattgcttctttcaacgacccttattcaaacaaaattaaagtacctttttctctgttgtgctgattcccattgttacatagctgaaacttaagtaattgcaaaatttgatggaactcatatattcttctactcttataataagggaggtttgtatgtagctacactcatgctatatgcatgcgctctgtctatctgacttttgtatttacatttgtattcaagacattgaggtcaactaaattctatgcccaatggtgcagccatatttcatacatgaatatggctatctctttgcctggtaggttatgaaatatgaactctatgtgtttattttgatgtgaaatggcctcagggcaactcattttgatgtatgagtatacatgtcaatccacacagtaggtcctgagatattttattaatgaccttttcacttttcaccatccttcacttgagaatatgctctggttgatagtagttagtttccgtgctttgacttattgccgaacccttgagagcatcttgtaatgttcaactcttatgaattgttgatgatgaccttatctcttttgatgaataggatgaatagcggcatggcaacccaagggccaaggccagagcactagggcctagagccgcaggagtggagctagagcgaaacagagggtggtgccacttgcttaatttactctactttagatcaagtttaagctgatacgggtgcttaagtttgtattgaggagggtgcatacatggtgaaaataggtaaggtatagctaaaaaaatttcttgatcgggttcctgggcacccccctaatatatactagctccgcccctgcctagaggcattcctagaaacttaggagcaaacgaagaaaggtagcagaaccagtgtagaggaggcattaggagaaatcttaaggacatttggtaactttgaaataccataatgcgtctcataaaaaatattctaattttaaaatttgtactatgtaataggtggttaaatgctgttcttctgagtgatggagttgcagattgtaaatcaatctttacttatacaaacgatgggccaatcattggcttgttctcgtctcttttttttttgggtcaaaatgaattggaatagcaggtgcctttgaagtgtaaatataacagaacaagtgggtaaattttaatataattccgaaagaatcatcatccatgtgtcattttctttttcatgcaatgaacaacagatttgtatatatgtatttttaccatcagtaacagtcctttattaatgcatagtatgtggttctgcttttctgtagggggacgttgagttgtaagaactaagaagaccagatgcatctgctcagattttacaggcctgtataaccagttaacgagtggcaaaaaaaatgtctcgcggccgtgtctgatacataactttgccaggagatctatctgttgatgcacacaggctgccatggcattgttacccagttgctcttacatgcatttctgctggcataagatggtggaggttctgttgttgaacctggaacacaaccggtgctcagaagaattttgtatcactacaacctatcaggatttgatcgaacaatttggtatgttcatacacatttgagcaattgtacagtactccgaagttggtgttttctatcatctggtaattgtggatcactggcatatcgaggaattgtggatcactgacatatggaggaattgtggatcactggcatattgaggaatcaacctgacatataatattcagggtgtcttttgtatacgtggagactgttgtgtatgccatttttctggaatgtcatgtaatatcaacgtatccgtatcgccgtaccagtatcacgtatccgtgcatcacaaatagccatattattttctatatcgatatttatgattaaattgagttaagaatttcttttgttgtgcggataactgcactgattgcaaatctgccaatgagtactacctccgtcccaaaataattgtatttctatgattcaaactttgtcccaaattaattataattctagagcactaattgccccatcaatcatctctcattcaaatttcttcctattataccctcaaccatctttccactctcacataaacaccatttaatgaggggcaccatagtcttttttctcaaaccttaatatatgctaaacaacatagaattacaattattttgggacggaggtagtaccaaaatattcgtgatttagtgcattgtgttcctgtgactgaatctgaaagtttggcagctagaatgaataccaagtattgttgtgcatatccccgtggaataagtctatttacctccatcattgaatggtttcccttaaccacaaggctgggtattacgtcatcttcacaaaccagtgcaaattaccttcttcagtggtttgacaatcggtttttgttgacgtggctgcttgattgcagttgactcgccgagttggcaggtgggatccacatgtcagcgacatccacctcatatcatgcttttctccccttctctttcctttctttaatctcccttctctctcttaccttccagcagcaacagaggccatgagggctacggtggtagtgagccggattcgggggtggcgacgacgaaggaggagggaaaggaggatgtggagacgaagtagcaatagcagcaggaagcgactgcagcagcgagagagagaggaggttgtggtggcggcgtcgaagcggaagcagcaggtggctgctgtggtggtgagggagaggaggctgcgagacgacggcgtggaagcaacaacagcagcaggcggtggcgttgaagtggaaataataggtgattgcagtggcggtgatggagatgaggttgctacgacggcaagggagaggaagtggcggcatcgaagcaacagtagtaggcaacgacgaggaagaggaagtggcgacatcgaatcagcagtagcaggcgatggtagtgacaacatcgacgcagaggaatccgcggatactcttgatggcttcctcatctccctcctctcttcctcgccggccatcgaccgtgctactgccttgcttgacgatcactagctgttgtcgtcggcttcgtctccggctaccaccactgcagcaacctaggaccaacctgtgactagtgtaaatggagtggtatatgtaagtgggcccatctatcggatgggctaggctacgcggttgtagaggtagggctgttacacgaccggccgtcttcctcgttgggagaacaagattgggaaaaaaaaaaggaaagaaaggatagagaaggaggatcaaatgtttcactgataggtgggtcccacctatcatgttgataaaacccgttttccaaaccaccgaagtagtcgatttgcactggtttttaaagatgagggagatgctatatctagttttgtggttgaggaagatgattcaatcgggagtaagagatgagagaggaaaagtagacttgcttatctccgtagcccggacatgatccaactactaagctcggacaaattacgtggtccgactaaggtgggtctagttctcgaacgttcgcatctcgcaaaacagttcaataggttttatcgttatcagttctaacgacgtgtttaagctcgtactatatagtattttgttatttcagttagaagaccaaccaatcactttttcctattatcaagttgttcagattggattttatttcttgaaaaaaaaatccagtgatgcttaaattttttttatttatactgaaatttatacactaataattaaacttctaattgcaaattataattcatactataaagtttataaataaaaagtccataatataaagtgtatatacttaaaggctctatgcatagaaagtttatatacataaaatctatatatggaaagtttatacacataaattccatatatatagaaagcgtacatgtaaaaaagtaatacatgtaaaaaagtttgtactaaaaaaagctataaaaatgactataaagagaaaaaagtaatttaacaaaaagaaggggaaaaaatgatatgtaccgttaggagaattaacgtaaaaaaaaggaccacggtaaattgaaaagaatcacgtagaaaagaaaaaaggaaaattaggaatgtaaagacgacgccgtaacgacgcaacacacctgtcacgcatcgccacgtttccttttgtctccccaccctgacctgtccgcgcgatggacaagtagcgcacgtcgcccaatagtcaatccgcctactacggttggaataagtcaatttgctgtccctcgaatttacgttgagtccgatagattaccagatttgccctttgtactgcttagacctccccagaaaacgtgtcacccccggttcgcggcggctcggccgagtccagtcccgcaggggcaaaaccgtccttcagactctcctcccgataaccggcgccgcccagcccatcagtccgtccgccccagaggccccaactccccaggtccgtaattttgataatttgaccctttgaaaaaacttattttgatattgatccatgtcaaaacctattttcaaaaatagaccttttttcgtgccattcgctgagctacaacatcatagcgccacttactttggcgctgagataccgtccgacatgtcactggtgtcacacatcatacgatgtcagcgccaaattctttggcgctaacctccgtggcttgctatgtataaatactatgcatgtactaccgtgatacatggaagatttggcctagtggtgaaagcccgcctctcttaactagaggtcaggcgtaccacgaagatgttagcatgaagagctctccaccaagctatctcgttttttttttcagttgtggtagcttgtagcttgataatatttgtagactggagagaggtgacctcggataacgtgtaaaatccgtgacacctcggatggcatctcagcgtcaatgatagttgcgccaagacgttatagctcagcgccaaccacaatggcgctgagaaaacggcctatttttcaaattagtttttggtacagttcaattttgaaataagttttctgaaagggtcaaattgtcaaaattacgggaggtcttccccttcgcatccataaaagcagcccgagccgcgcgtgatcccgacgtttctgtagcttgatctttctagcatctctgctactgctagtactccaaccttctcaattccctagctttgattctgaataataggaagacccacacatcggagatgatggttgacaatattgctcgccgggaagcggaggccgacggcggtgcttccaagatcgcggcggcgctggggctgttcggcgtcgccacggcctctctgatcatcaacctggtcgccgcgttcgacccaccgcagggcttcgctgaaagcgcctgctacgacctcgctcttgtggggtccttcctcgccggaatgggccaggttggcgcggccatctgggtcgccgacgacccacgcggccaccgtgccgccgtcggcaagaagatcatgatcgcctccatcgcgccgctcgtcgtcgccatcggcctcaccggagaggcactgctctggtaattccactacacgtaccaacaccatggatcggagcgagtgtatcttgtactactatcttacttagtggagtcgcgtgatagtgtgatgatgctttttacttgatgtttttgtctactggctactgctgtttgtgttagttgatcaatgcttggattgatgaatatttcatgtaaattttaagtccatactattgtgtactacaatcaatgaaaaatttctcaaaaaaaaaaaactgctaatgaggggaacagagtatatggaattttggagtactccaattttcactgacgccggcgagcatgcgcttcctgatcaccaattcaaggtgcacttcccgccgccgccggcgggggtatttaccgctccggcgacggtggtgcggccggcatgccgccgccttgtcctccctggggaagcagccgctgtgagcctgtgactcatgcaacggccaaaagggcactctgttttttttttttaaagattctgatggaattgttggaagggggagtaggccatatttaagtgggccccacatgctaaaaattttccccaaaaagggaagggaggagtaggagatatcataggagcggcggccatggcgccttcgcctgtcccgcccactccatgtctctgtctcgctgctgcggcgccttttctacaccagcttgcccccacctctccgtctcaattcgcgcgtgcggcggtgacacggcgcgcgagatttcgctccggctcggccacgatctgacctcgtcggcgccggcggaatcctccgtcttccgcggccaccccctcgccgcgaacctgcgccgggaggacctggttggcatcgccgttggccgtcgcgtctgtgctattgcaacagatctgtggatagtactccctccgtttcaaaatatttgaaaccgttgactttttagcatatatttgaccgttcgtcttattcaaatacttttatgaaatatgtaaaattatatgcctacataaaaatatatttaacaatgaatcaaatgataggaaaagaattaataattacttaaattttttgaataagacgaacggtcaaacatgtgctaaaaagtcaacggcgtcaaatatttcgaaacggagggagtatgtgattttttgtttttttttccattggaggcgttgacttggaagaacatcagagtaccagagccatatctgttccgattttggaggttcatacattacaggtatctgcttgcccttacatagttacgtacatgcatttttcattggcaaataataatccttgggtgatgatgatcctgttgttgaacccttgaactgaaagacaacaggttcttaggggaatttcgtagggtgtgatagcctatcttacaatttgatagggcaatttggtatgttcggtgaaaattctgtagacatttgaacaattgtttggtgctgcgttttctgtcctctggtaattgtgaatcactggcatattcaggaaccaagcttttgtatatttgtcatgctcttgtatttgtgcacatgtggatgtggaggctggtgtgtgtatgacaatttcctggcatgtcatgtaatcggaagcattgtttcggagagggaagggcaatctcctttctaataggcatttacaggtttgcttgtgttcagacttcagactagttactagaaaatggtgcgccagttggcgcacctagtacttttatagcctgtatataacacttgtatgtaacagttacgacttagttacgacttatttagaacatatatttattagttttcaaggtatcctataatttttaattctgtcaattttatccgtttttaagaactcatgaaaaatagactatatattttctatggtttgtttagaacacaataatttggcacagtca

SEQ ID NO: 58330 - DNA, 3742 bp, Oryza sativa
  unsure (1)..(3742): unsure at all n locations
accctcggtaggcctatttgtacatttaaaattttgagaggaaaaaaggatcagtcacgccctttataaatagctctcggccaaaacgaagtattatcaaatcggagggagtagtgttgaacaaatcattcttcctaataaagcttattgtttttctccaccattctctgtctcttatttttgtttcctccccgctgcccaagctactatattgttcggaaggctgatatgcggctgcggctgtacaaccaaccttgtctttgcttcttcgaacatgcatgttgacagccatagcacatgctgcattgctgccaaacaggtctattgtactaaaccaagcctatatgacacatgccggcgaactccccctctaaaaagttaccgaggcaaaaagaaacgaaaaaagaaaactaaatagagagacatattgtttcgcttgcaccaccggtacaccgctactttgatctaaacaactgaacacactctaacacccaataggggaaacctgtccaattttaatgagggtgaaatgttaaccaatcagcttgtgcggagtgcgatcagctttagattaactgataatagcttatattgaaaaatatagtttgtttttacttcaacattttttaagtgtaaatatgatactatctaccaattggcaacgtctagagtcgtatttttaaacatttaacaccgttttcatattaaattattattttcctattcttttttaatttttatcatgagattttgtattttattaagtttattatagcgtgaaatctgttaataactaacaatttattttatttcttctctcaccaactactgatattccctactgccctggcagggagcaccactgggaatagagcagcagccagctcctttttatttttttttatcagcccagatgaataaaaacggcacaggcctaggcatggcccaaatcgcatgcgtggctgccctggaataccgctcgaaggggcgagaagatgtgcgctagcgcgttagaaagcgattttttaccatcgtaatttgcatatttatcttaaccttttttaatcaagtagaaccgtagaaggattaggaggccacatggcacgattttagaggaggtaatcctggaaccaggtagtgccacgtggccctataagaggcccgagatcgcaccctgaaatcgtatataaagataaccatatgctattttctatatcgatgtttatggttaaattgatctaagaatttgtcttgttgtgcggataactgcactgattgctaatctgccaatgagtgccaaaaatattcttgattcagtgcattgtgctgctgtgactgaatctgaaagtttggcagctagaatgaatatcgatcaatgttatgcatatcccgcggcccggacatggtccaactaccgcagtcaggtcaggcccaactaaacttggatggcaactaactgtagcgatccagattcacggtcaccaatggaaaaagtccaatttgtctcccttaattgttcaccgaatctaattcgtgactcttaactggaaaaccgggtaagatgacttcccgaattattgaaactaatgtaatttgactcctccagcggttttggagggcggtttttgctaacgtggcagcgctgacgtggttttcattccacatggcgtttatgtggcattagaattaaaaaaatatctatgggactcacacataaatatattgtgggacccaccgacatgtggggcccacatgtcatcctttctccttcccctcttcctcttccctctcttcctctctcttttctttcccccttttctcttcccccttcgaacgcatcaccgtcacatcggccacctcctctcctctcccattgttgccgtcgcgccggctgcctctctccccctctcctgccgccaccgccagccgccgcttccctatctgccgccgcacctgcttgactgctcgagagaatcaaggagagaagaggaaaaaaaaagaaaggagagatgtgggatccacaccattttctctcacttacatgtgggctcgacatatttattttaatttttttgttgactaggctgccacgtcagcgaaactaggcatctatactgtctcgggacttttttttggatggttttacatagtttaggggtatacatttctggtattgcggttaggggacctcaaacagactcggcgtaaagctgagagatggctgatgaacttatttctctcccgggtgcctggcccaagcgggcgctgaatcatgtgtagcttgtgcagttctttttcttccggttatttgtttgcctcttgatgcgatatactgcactactcggtatacactagtttgctctatattttgaattttccatgtttctgcatttcaaatgtgcaatggaataattaaaaatgattcatcgaatggaaactattgactgtgagattttgctacatgattatgggttttctgctgcttctttttttttttccgctgatgccttatagttttttcatgggagagaattagggaaggcaatttcccccgcggggacccgaccctatgggggcggggggcggggacgggttaagtttttgacccgcgggggaggcgggggcgggccccgcatttttacgaggaggggacgggggagacagttcacccgcggggcccgcgggtgtatattaacccttaaaatgtagcacatagaagacccaaaagagcccaacccaataaaataaagataaaatgaaaaggaaccctagccttatcctcaccagtgtcttcccaactcccctcctggctcccgtacgcatcatccaccggtggaggcggtgctaggggccagggcgcacgagcacacgacgcacttctttggatctcgccggcgccggtcgccctctcccctcccctccggccttccgagtcccatcctctccaatatccctctccggctctccctcaggtctgccaatgaggcgacgacgcacaggcgcacgggcgcggcgaggacgccgtcnagaggcgagggtgtggcgcacaggcgtggcagccggcaaggggaccgacgtggcgtccggcgagcagcgaggggataggtgcgcatgaatcgaatgatggatcaatgtgttcttggtttcttgctgaattttttgatgctatttatttttatggtgttaattatgtacaatatttgttcttgccgaattgatgattgtcttgtaatttttgtgctgattggatggagatgctacctaatgcagggccccggtcgggttgcggggccccggaggggtccgggatgggggatgatgtcgggggtcgggtgcggggccgtttcagcccaacccggccccgccctgccccgttgccatccctagagagaatatgataggtgagcccactaatttttaaaatataatcgttgaatgttgcgcgtacgtcatgtagaacaaaaaccacttcagattgagaggggtgaggggtaatttggtttgagtagttgggtgtatcaaaatgtctggtattcgagatcatgggttagttaggtcgactgcaataattcaagggttaattcgaacttcttcctcttataatattattttgggagttcaacaatcaatttaccatgttttcacggttcgcttaatcccataagggattagggggattaattccatgttgcaatagcagnnnnnnnnnnnnnnnnnnnnnnnnnnnnnnnnnnnnnnnnnn

SEQ ID NO: 58331 - DNA, 1510 bp, Oryza sativa
ttcacaattttttttaataagacgaatagtcaaatatgtgctaaaaagtcaatggtgtcaaacattttgaaacggagggagtatttgaggatacgccctcgtgaaaatgaaagaaaaaggagagatagagaggaagttctaagtctcgacaaatcctaaaaccctaatatactcatccgatcaggagatgtttggaagatgttcgtgtgtggtggtctccagatagtgccattggcgccccgagggacttcgcttcaccaactaaaaacattcggcgcgacggcgacctcaagcatgttaaatcggcgtctatgcatgcttcccttgtagcagaaccgaagaaagaagaaaacaaggaagaacaacaaacggaataaatcaaagttgttggaatataaactgaattacccacattttctcattagtttaagcttttggattaaattggtcggcgtatacaacttaatgtataagtgattgcgattgactataatggctttactaaatacaagtgattgcgattgacttatcggttagataaattttcgcattgaacaaaagatgatcgtatatagactaaggctgtgttcattgtgggaggttgggaacaaatctcctatacatgaaaaacggagcgttctattaacgcgtgattaattaagttttttttttcaaaaatgaatcaatattaattttaagcaactttcatatataaacttttttaaaaaaacgtattgtttagaagtttaaaaaacatgcgcgcggaaaacgagaaagagaggttgggaactagtagaaggaacgcagtctaagacttaagtgaataagtaaactaaggctgtgtttagttggatccaaagtttggattttggttgaaattgaagatgatgtgattgaaaggttgtgtgtgtatgacatgtgatgaaaaaggactgaagtttggatccaaactttgggtctaaacacagcctaataaactacaaaagtatatgcagttgttgctgtggtgcagtggacctgctaattttgcccgttaaaatttcttcccgtcttcatgtatgatctctcagctgattggtcgagatgaaaaagtgatgacgtcaccaacgtgtcatgctaccagtggtggacgaaacgagttgagagaaccgaagtaaaataaatatagaaaaaaatacccgtgcattgcaacggaaaaaaacatgagaaatttacgtaaaggttaagaaatatttatattatgtaattaatttaaatataaaatcgcaactatacgtgtatatgatgttgaagaaaaaaagctcttaaaaataagttaaatgtggaaaataaaattttccaaataaactatagctggatttaatttttattaatctccatgattaataacactatgtgaaatttcttcggtattttcagagcagtagagcaccattgctaatctatctatctatctatctatctatctattatattattaaaacagccttgaaaggaggcaccacgttcg

SEQ ID NO: 58332 - DNA, 1522 bp, Oryza sativa
tttatgtcaggtttggtaggtcgtgatctttttactattttgcccattgtgcaaaattttctactacatgcaaaatccgtcgaatgtcggcgtttcgtttgcgtccgccgggttatcactatatattcctctctctctccaggaaaccaagccttccccacaggatcgagtcgggcagccacgaatcgatcgagagatctaatggcggcggcaaagctactgctgggtgatgctcgccgcgaaccggaggcctcagctttgggcgcgctcggcgtcgccgccatctccacggccaccactttggccaccgcggcgttcgagccgccgccgggcggcttcggcaccaccacctacaaccatctcgccgtcgccgggctcgcagggaccttccttggcggggtggccctggtcggcacttcagtgtgggtctctgacaacccagctgcccgccgtggcaccggcaagaagctcctctacgccgccgtcccgccgctcctcgccgccgtcgttctatcggtggcggcgctgctctggtaagcatgtacaagcccctgtccgaccgcattactatccgccatgatcggagccaagccggccgtccctagcgtgctccttgtgtcaatcaaatgcaatcttagggtaccgagctctattgttcatttgtttgttttgttggtcgatcgctccgtcatgtgttatgtctcgtggagttgtagtatcatcatgtaatagtgcttgcttcttcttcttctagtccattgtgtgtatcacatatgtatgatcacgtctcctgttcttggtctgtcaaagtgttattcgattgatggccggcttaatcgacgagtgttttgttaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctcctttttttttcttttctttttttttggaggcaactgttagaagagagggaatggtgggccatattaagtggggcccacatgccgtatcatatccatgacctttgtccttgcgttgccggcggcggcggcggctacggccatggagatctcacgcgaccatttgccggtgaggtcggctgctccgcctccgcctccgcatctacgcctgattgatccccacccctctctccactgactgtgctatcgcgtttccggcggtggttgatcgaggcggtagcccgtgcggcgcgcgagattccgcccgtccacggatttccggtcgccatcgccggggttcgtcttctccggccagcccctcgcgcgcgaactgcgccgcccgtcctcggccaggatctggtcggggatcgcttgtggtaggtgttagggggcacttgggtttggaggacagcatcgt

SEQ ID NO: 58333 - DNA, 3020 bp, Oryza sativa
ccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtcggccgtcgtgtccttctggtgctaaaagcccatctttttctccttttttttttcttttcctttttttttggggggcaactgttagaagagagggaagggtgggccatattaagtggggcccacatgccgtatcatatccatgacctttgtccttgcgttgccggcggcggcggcggcggcggctacggtggccatggagatctcacgcgaccatttgccggtgaggtcggctgctccgcctccgcctccgcatctacgcctgattgatccccacccctatctccactgactgtgctatcgcgtttccggcggtggttgatcgaggcggtagcccgtgcggcgcgcgagattccgcccgtccacggatttccggtcgccatcgccggggttcgtcttctccggccagcccctcgccgcgcgaacctgcgccgcccgtcctcggccaggatctggtcggggatcgcttgtggtaggtgttagggggcacttgggtttggaggacagcatcgttgatgtgctttgactttgagttccttgctaatttagttatgctgactgttcccataatccctaaaatcccagcagttgcgttgcgtggtaggttatgtaaagcgcattcctgtgatgaaaaatagaccctgggagacatattatcaattgtatcaagcgatccaacacactaggtccccaaatattgtcgtagataccattttctcttcagtatgctgcttaaaacgcaaagtgtaaggttttctctgtgctgtccagttacatctaattccttatgtttaaagactgatattagtctttggttgggtgtgatgtgcttcttgttaatcgcaatacttgatctttactatgatactatcggtgcatatttagttccagtatgcccttttagttaagttgctgaagcattgagcatcttgtcatgttgatcttcttgtgagtggttcaatatgatttgttctgttttaatggaagtaaaaacgagggctgtcccctcctaatgggaagagaaaaagagatgtattccagcaaccatgtgttatagtacaatccaattagttcgctaagctattatggcctttatatcctgctctgagtatttatttgatttgctgtaaagttattaaatttatggcattgttatacgtgatttgtacttgattatatgctgctattggtgattcatgtaattagagctgaatgggatttttgctagatacacattgcttctttcaacaacccttatgcgaacaaaattaatgggctggtttctcttctgtgctgatttccattgctccatagctgaagcttaagtaattgcaaaatttgtaggaactcatctgttcttttgctgaaccaatagacttttgtaaatacatttgcacaagacattgaggtcaactaaaattcttctatgcccaatggtgcagccatatttcatacatgaatatggctatcgctttgcctgataggttatggactgtgaactctgtgtttattttgatgtgaaaatggcctcaggggaacgcaggataactcatacatgtcaatccatacactaggtcctgagatattttcttaatgcccttttctcttttcactatactctacttgttaaacttctaagaaaagtcttatccctctactgttctattatatctataattcctttgttttgatgtcaaaagcagtgtattcagctgtatattttgttgtgatatgctctggttgatagtagttagtgtccgtgttttgacttgttgctgaacccttgagagcatctcgtaatgtttaactcttatgaattgctcgagatgaccttttttgtcttgatgaatagtggcatggcaacccaaggcaagagcactagggcctagaggtattcctagaaacttaggagcaaacggagaaagacgtagcaggaccagagcagaggacatttggcacctttgaaacaccataaatcatctcgtaaaatatattcaactttaaaatttgtactatgtaataggtggttaaattctgttcttctgagtgatggaattgcatattgtaaatcaatctctacttgtacaaaagatgagtaaatcttttgcttattcttatctacttttttttgtcaaaatgaataggaatatcaggtgcctttaaagtgcaagtataatggaaagagttggtaaattttaatatacttctgaaagaatcatcatccttgtgccattatctttttcatgtattgaacaacagatttgcacatgtatttttgccatctctaacagctctttattaacggatagtatatggctcttcttttatgtagggggatgttgagttgtaagaagaccagatgcatcagctctgatttagtgattttagaggcatgtataacctgtcaaagagcagcaaaagaaatgcgtcatagctgtgtgatacataactttgccaggagatctctctatttaagcacacagactgctatggcattgttaaacatttgctcagtttctcttaaatgcatttctgctggcataagatggtagcatggtggaggttctgttgttaaaccctggtatcaggacttgatcaagcagtttggtacgttcggt

SEQ ID NO: 58334 - DNA, 942 bp, Oryza sativa
tgatctcaattaaaaatggctaagcaatcctttttagatttttaacaaataccaaatctaccctttcatatactgcaagtatatactttaagtagaatgtactgtaaaagtcctctttttttcgccccccatgtagttaagctggcaattaatcgtttttttgttcatacttcatttgaaatgtgtaggatcaacaaaacacacacacttgtgaatcgacaaacgcaacctgcaggtgctaggcatgcaccgtgaattattgtatattaatctgtcaaagactcaaagagcagcaaaggaaatgtctcatagccttgttaaacataactttgccaggagatctgtatgttttgatgcacacaagctgttatgagggttgctagttgctactcacttgctcttacatgcacttctgctggcataagatgatagtctggtagaggttctgttgttgagccctggaagtctggaacacagccggtgctcagaagaatttcatatcactacggcgtatcaggatttgatagagcaatttggtatgttcggtgaaagtcatacacatttgagcgattgtacagtactcagaaattggtgttttatatcctctggtagttgtggatcactgtattgaggaatcaacctgacgtataattgccgggtctgtaattttgtatatgtggagactggtgtgtataccaattttctgctggaatgtcatgcaatgaggcatgggcaaattctcttgtagggctttcatcgttcattgagtttaacatagctataacagtactgttttatatgacaaaataacagtactattttctatgacaaaatttgtgattaaactgtgttcacgatttcttttggttgtgcagaaaacaatgaactgataaaacatcctagagttagtgaattttgtgctggtgtaactgattctgaagg

SEQ ID NO: 58335 - DNA, 706 bp, Oryza sativa
ttgaagaattgttcatttgtttgtaaatctgtgcttgtaaatctgtgacgtgatgtatgcatgatttgatgaactggtgacttgatgaattgtttgtgattctttgacttatttgatgaattacatgtgaatttcatgaatttgatgtgttatgtcaatttgttgtgttgaattgaacctttgaaggggtttttttgccagggcgtgcctaggccggcacgggcacaatgggctagccgggccgtcgggccagcccggcacggcccgaggctacttgggccgtgcctgggccgtggttgtagcccgtgggctggcacggcacggcacggcttgttcgtcgggccgtgccggcccgactgacctcggcccaggcccggccgtgcctgggccgtgccgtgccgggcggcccatatggccaactatagctccagaggaggaagaggctgacgaggaaggtgccacggagctggcctttgtagtagaggatgaggaagaggaggtagacgacatagagggcctggttcatcatggacctcgtctgctggctgctgtcgttgaagctgaacgccgtcatggtgtcggcgctgccgaggaggaggaggaagcaggcccagacgacgaacagctcgttctggatggacgactactgcatcaggccgatggtgtaggagatcaccgggtagttaaacatgaaggctccccagac

SEQ ID NO: 58336 - DNA, 814 bp, Oryza sativa
actctctttttaatttgtctaattttggattttattttattctgaattttaattaatctcgtattgggttcttatatgtacttttatttcaatattgcttgtacttaattccgaattttagttaattttaaattgtattattacttgaactcttcttttctgtttttttcctaattttgatttgttttattttttattccgaaatttaataatcttgtattgggttttatatggactcttctttcaatattgcttaattttaattccgaattttagttatttttaaattgtatttctactcgaactcttctttttcctttttttttgctaatttcggattttattttattttatttttttattctgaatattaattaatctcgtattaggttcttataaggactcttttttcaatagtgctttttttaaatttcaaatttcagttatttttaaattgtatttctacatggactgtccttttctttttctccgattatttcttttttttcccagtaatatgtcgtgtaggtgttgatatcaagatgaattaatgcacgtggctttagcgggacggcaagattatttgggctaagtgaacttgagtccagatggactcttccatggactgtgcatctgttttttttcccttttattccacacccaatcggaaaacatccttgatcaaagagtactattagaaatccaacataaatgtatgctcattatgtacgtgaaagattaggggtaactatcatgtattgagtagactttgtttcgtattgataaaatttctagttatttcctaattgtattt

SEQ ID NO: 58337 - DNA, 1448 bp, Oryza sativa
  unsure (1)..(1448): unsure at all n locations
nnnnnnnnnnnnnnnnnnnnnnnnnnnnnnnnnnnnnnnnnnnnnnnnnnnnnnnnnnnnnnnnncactaaattgtaccgcaaacatataaaaccagtccaaaaaagagaataaaatagtttccttgcttttgataagtcttgaactcatgatcttttggttaaatcattttaatcttcgatacactaaccaactcaactccatgtcattacttgtatacttgttcctttaattacttatatttagtcgtttagtacacattatcattctaaaaagtgtctctacatagtttaaaatgtctcaacaaaatgcctttacatattagacgcattttatagtgccgaaagaatgcctctacaagataaaatctaacaaactgatataaaaatgtctctagagtaaaagttttctaggcaatttttaaagtgtctctataaagtgtctctacactataaaacttctgattgtagaagcaatttacaaaatgcctctacaaaagtgcctctatacgaggtttttgttgtagtgatgagagttaataagaagagaggtaaaaagatgaagataccatttctcgtaaagaaacatctttacacgagaaccaagaataaaaacaaggggattagatgtgaatttaatttgaagacatcatccattggatatatagactctatatatagtgtctatatgacatggtaagtatggaatatagtttctgctattgtgtcttctctaactactttaccgaattattattgctggtcgccaacgcgcggatcattattattgatattgtatactactccatattttaaagtttaatatatgttgaatacataggctattttctatactatagcgatttagattactaactgttttcagtttttttttaaaaaaaaatcgtaattaaaataataaacatcatatttatttaatattgaattttgcagttgctacatttattaaaaaactatatgtaattaatacctaacacattattacgatctacagttgtgatattatgatttattagatcaatgactagatttttctgattaatgtgagagctcatagaaaatgttaggttagtataggtatagatatagatagatagatagatagatagatagatagagggttaaaagctatttttctttgtggtggagttacggactgcaaatccatgtcttagctaaatacaaaagacgcccatttttttttaaaacaacggcagagcttgccatttcactgaataaagaagggagcaatatttacatgtaaggagaaaagtaatatttacaaaggcgaccgggcactaaggcaacatctctgctgagcacctgccccgaagaggcgctcgacccctgcgccgccgcgcgcagggaacccgcgagcggctgccgttgcagcgagagcaagggtgttcctgcgcgggtaccgagctc

SEQ ID NO: 58338 - DNA, 1245 bp, Oryza sativa
  unsure (1)..(1245): unsure at all n locations
nnnnnnnnnnnnnnnnnnnnnnnnnnnnnnnnnnnnnnnnnnnnnnnnnnnnnnnnnnnnnnnnnnctcttctaaacaactcttctgattaaatgacattccagaaaattagtacacacaccagtctccacatacacacaaatacagaccatggcaattatacgttaggttgatttcctcattataccagtgatccacaattaccggagcatagaaaacaccaacttcggagtactgtacaatcactcaaatgagcatgaattttcaccgaacataccaaattgctcgatcaagtcctgataccagggtttaacaacagaacctccaccatgccaccatcttatgccagcagaaatgcacgtaagagcaactgagcaaacggttaaaaatgccatagcagtctgtgtgcataaacagagagatatcctggcaaagttatgtatcacacagctacgaggcatttcttttgctgctctttgacaggttatagttatacatgccactaaaatcagagcagatgcatctggtcttcttacaactcaacatccccctacataaaagcagaacaatatactatccgttaataaagagctgttactgatggtaaaaatacatatgtgcaaatctgttgttcaatacatgaaaaagataatgacaaaaggatgatgattctttcagaagtatattaaaatttaccaactctttcgattatactttaaaggcaccctgctattcctattcattttgacaaataaaaaaggagtagataagaatgagcaaaagatttactcatcttttgtacaagtagatattgatttacaatctgcaattctatcactcagaagaacagaatttaaccacctattagtctattacatagtacaaattttaaaagttgaatattttttacgagatgcattatggtatttcaaagctgccaaatgtcctctgctctggtcctgctacatctttgtccatttgctcctaagtttctaggaatacctctaggccctagtgctcttgcctggggttgcgatgccactattcatctagacaaaaaaaaaagtcatctcaaacaattcatcagagttaaacattatgagatgctcccaagggtttagcaataagtcaaaacactaactacaatgagctagagtatatcacaacaaaatgagtaattttacagtccttgaggaggtaccatgaggtactattttttctattgtaaatttagtatctcttgat

SEQ ID NO: 58339 - DNA, 849 bp, Oryza sativa
  unsure (1)..(849): unsure at all n locations
actatagggcgaattcgagctcggtaccctgttgttttctttccatctaatctatgatgcttccggacaactacattggtaaaagttgctttgtattttgagccctgtgtgtttgaatttctgcttacttttccatggtaggctgcatactaactcatccaatccaagttagactattcttctctgtagtgtatttttcacaatttgtttattgttgtcatgatcctgaaacaatcaataaacaaaaatattatgttgtactcatcaaagtggttctgtgaaataaaatcttctttctttgtccacatatgcattctgattaatgctttgctgtgtatatgcattcagtttttaaagggagaacctgtgttgggggcatgctgcagaaccaacgttggtggctttcacatcacagattttctgaggcagctcctctctctaaagtatccctatcacaggtaggtgcccgcagcatatttctgaagtgctccatgcatttttttttcctaccatgtctaatcgttgccactttacattgagtagtgcaagcattacatgggaaaaggctgaagagctgaagaaggaacattgttacgtagctcttgattatatgtcagagttgcagatatttaaggtgagaaacttttatttaccgtttgttttcttaccaatgtaaattccaaatccagttcatctatagaatgcacagggcttttctaccgtgttacatttctagctctttctttcaacactatgaatttattgatccacttggcagaacaataaggaagannnnnnnnnnnnnnnnnnnnnnnnnnnnnnnnnnnnnnnnnnnnnnnnnnnnnnnnn

SEQ ID NO: 58340 - DNA, 1353 bp, Oryza sativa
tgttaacttctaagaataagcttatccctttactgttctataacatctataattcctttgttttgatgtcaaaagcagtgtattgagctgtatattttgttgtgatatgctctggttgatagtagttagtgtccgtgttttgacttgttgctaaacccttgagagcatctcgtaatgtttaactcttatgaattgttcgagatgaccttttttgtcttgatgaattgtggcatgacaacccaagagtactagggtctagaggtatccctagaaacttaggagcaagtggagaaagacgtagcaggaccagagcagaggacatttggcacctttgaaacaccataaatcatctcgtaaaaaatattcaacttttaaaatgtgtactatgtaagtgttgttcttctgagtgatggaattgcatattgtaaatcaatctccacttgtacaaaggatgagcaaatcttttgcttattcttgtctacttttttttttttggtcaaaatgaataggaatagcaggttcctttaaagtgcaagtataatggaaagagttggtaaattttaatatacttctgaaagaatcatcatccttgtgtcattatctttttcatgtattgaacaacagatttgcacatgtatttttaccatctttaacagctctttattaacggatagtatatggttttgcttttatgtagggggatgttgagttgtaagaagaccagatgcatctgctctgattttagaggcatgtataacctgtcaaagagcagcaaaagaaatgcatcatagctgtgtgatacataactttgccaggagagatctctctatttaagcacacagactgctatggcattgttaaccatttgctcagttgctcttaaatgcatttctgctggcagaagatggtagcatggtggaggttctgttgttaaacccggtatcaggacttgatcaagcaatttggtatgttcggtgaaaattcatgcacatttgagcgatcgtacagtactccgaagttggtgttttctatcctccggtaattgtggatcactggtataatgaggaaatcaacctaacgtataattgccatggtctatatttgtgtgtatgtggagactggtgtgtgtactaattttctggaatgtcatttagtcagaagagttgtttagaagaggcataggcaaattctcttgtaaggcttttgtagttccttgagagtttaacatggttataacattagtgcgccggccgtcctcggccaggatctggtcggcatagcttgtggttgttgggcacttggggtttggggtttgaaagacagtgtcgttgatgtgctttgagttcctgcata

SEQ ID NO: 58341 - DNA, 806 bp, Oryza sativa
cttgatcttttggctaatactccctctatcccaaaatatttgacgccgttgacttttttaaaaatgtttgaccgttcgttttattcaaaaaatttaagtaattattaattctttttctatcatttgatttattgttaaatatacttttatgtatacatatagttttacacatttcacaaaagtttttgaataaaacgaatggtcaaacatgtttaaaaaagtcaacggtgtctaacatttagagaatgagggagtacttccttttatcattttgttgtctttccctatcgccatctttccacctttttctattaattgtccccattgagggacctagctagcgtgtggatcgcttgatacatcccatcgccatctttccatctttttctattaattgtccctattgagggaccttagctagtgtgtggatcgcttgatacatcccagggtcaatttttcatcacaggaatgcgctttacatagcctaccatgcaacgcaactgctgggattttagggattatgggaatggtatctgaagatgtggatactgatagagtcagcagaactaaattaggcagcataacccactttctccggtcctttggatgaaccacacttagggttgaaaacggagcagatagtttctgtccgctccggaggaaaacgaaaacggatacctctcggatcggatatttctcggatagttcggatacggatacgaatacggatattttcttccggatgcgaatacaaatatggtatcggggtttccgtcggatacggataataattcggatgtccggtg

SEQ ID NO: 58342 - DNA, 2169 bp, Oryza sativa
aggcggcgagtaggtggtccatgggaggcggcgaggaggtggtggctggtccgcgggctgcggtggtgaggtggtgttggcggcggtgtccggtgcttgggcccgtgtccgcgaggtggcggcggcgatggcgtcggcagcaggtggttcgtggcgggcatccttcttcaacctctggttattctgtagcactccccacagctcaagcactcaactgttatgttgagaaaacgaaggcagaagagagaaaatgaagctagagctggaaatggctgaccggctttcagacatggaaaattcattcaagaagttgtccaagcagaaaaaagagactgatgacattagaaattggttcataggaatagtagttgtagctgtgttccttctcatgaagctatttgataatatgtactatgcttgccattgttgattttgtacatgtcaattaccagaattaatggatggggatcacccagcatgttgatgtctcagcaaccaatccatgtgaattttgtttatctatctcccattgtctgaaactctaaattacagctttttgagatggttgtctaacttatccttcagttttagattcttgctaagtcctagttcgttctgtttggctgaaaatttgcagaactctgtttatctatctccctgttatgaaaatagatgcacaacggacacgaattttacatggaaaacccttgcgggaaaaaactacggacgccgaccggcaatgattactacagaggagatgattacaaacgtaggggaatcacaatgggaacgtcaccccttcctgtacggcttacaagagtatatataggggataaaagaaagacctaatagaaactcctactatgaaactaatccgaatatattgtgggcccaaaatttggatcacatatttaacaatctccaccttgagacgaatttcctcttgtagcataaaaacatcaatcaccaaaaatacctcatgtaggtaaaatcaccgcgcgccaaatagtctctaggacaaggcacaacaacaatgatcaagcactaaaatagtgcagtaactgcaaataaataacaccaaaatctactataatcaagagaagttgaagttaatatgagcatgaaaaagtggaatagcaaatactccacatcattgtaccaaatattacctcaatctcagcaaagcaattgcaatgctgtaaacatgattatgctaccaattacagtatgaaaattactccttttctttaaaaacaaagttaaataactaatcccaatccctactatagcaacatagaacataacgcaaacaacatatgaagtacctaacggcgacagattgcttaagtttatttcatggtaatatataatacgactaaaatcaaaacaaacaaaggggattcaatgatgtcaaaagataattctctgatgatagagcagaagatcgaatagcagcatttgatttagtgagattcaggagctcgcgcgcgcacgcacccggtcttggtcgccgtcgctctcctcctcggcgtcgttgatcgcgttgtcgatgatcctgacgagctcactgtcgaaggcgggcttcgtcaagggggccgacgacgagaacggcatcgagcggggctgcggccgcgccgccgcggcggccagcgggcggagcagggggagggtggatgtggcggcgcggcgagcggcggcgaagagagccatggcgacggtgcagcggcggatgacgaaggttttagtcagggttttgggggtttacgagctgtggagaattggagatgaggacgacaatttatgttgttttaatatggaaaaaaaaatggaaaggaccattctgttatcaatcatgtttgtttgcttcttggagaagaagaaaaaaaaatcgattatctaccaaatatcgttatccgttaattaaattcaatcaagaattgttgtccattagtatagatagttaataaattcaattgttcttttacggattttctctttacccccttgctttgctcattatctaatcatcattgccattatcagactatattactacctctattcacatgtttaagcattcctagtagcggtttaagttttgaacagacatccatcgaggtatttcttttcacatagaatatcatttcagccatcacaattcacaattcc

SEQ ID NO: 58343 - DNA, 1397 bp, Oryza sativa
  unsure (1)..(1397): unsure at all n locations
tttacaaatataactttagttataaagactgtaattttatattttaaaatacaaataaatattttcttacacaacattgttataaaaattacagtacgcacttacatgtcatatcacttgaatttacaaatgtaatttttattatataggactgtaattttgaattttatttttattttagtttcaattgagagagaacgagagagaacagcgtgcatatcaattttttagagcgcaaaaaaaaaagaaattagcgcctctaacccgcccgactgaatcctatgcggattcccagcgctatatgtgcacgaatcttgtcacttatcgaacagcctaaaaaagacaaatccaagagaaaaaatcacacgacaaatctatagcaaaatcggcacaacattacttgatattcattctcgctgccaaattttcagattcagtcacagcatcacaatgcactaaatcacgaatatttagtgcaatttagtcataaattttgatatacaaaatggtatggttataactagtctgaaaagggctgatggttgcacacaagcaacggtaaaagcctaatattagaaaggagattgagcatccctctcctaataacaaatcttccgattattacatgacatgccaggaaaactgtcatacacaccagtctctccacatgtgaaaaatacagaaactggcaaatatacaaaagttgggttcctcaatatatatgccagtgattcacaattaccagaagacagaaaatgatgcaccaaacaactgcacaattgtttaaagagctttcacacaacataccaaactgccctatcaaatcaaattctgataggttatcgctcacactgtgaaattcccttaagcacctgttgactgatgtctttctttcacaacatgaccacagccaccaaaatgcatgtaagtatgtaaccatatgtaattgtaagggcaagcagatgataacctgtatgaaccactaaaatcagaagaggtggctgccgtgttcttacaagtcaacggctgaacggcgcacggccatcatagcatccacaaatctgtttgcaataccacagccgcgatgccgaccagatcctggccgaggtccgccggcgcaggttcacggcgagggggtggccggaggacggcttccggcgacagtgatcggatcgtggccgagcaaaatttggcgcgccgtcgtttcctcaccgctgcacaagatctagcgaattgaggcagagaggaggtaagaggatgtagttaggaagccggagcagcgagatagagactttttgggcgagggcgagggcgaaggcgaggtcgccatggccgtggccctctnnnnnnnnnnnnnnnnnnnnnnnnnnnnnnnnnnnnnnnnnnnnnnnnnnnnn

SEQ ID NO: 58344 - DNA, 1471 bp, Oryza sativa
  unsure (1)..(1471): unsure at all n locations
nnnnnnnnnnnnnnnnnnnnnnnnnnnnnnnnnnnnnnnnnnnnnnnnnnnnnnnnnnnnnnnnnnnccctccccctagcgacagcgccgctgcccgagcagtggcggcggtggcggtgcctctccccccgagtggtggcggtgtcagcgtcctcccccgcgagcggcgacggtggctctcccaccactggcagcgcggctgcgtcctccctcaccaccggcagcgcggctgcgtccttccccaccaccggcagcgcggcggcgtcctcccctaccaccggtggcagtggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactattaaaacgaatagaaatcgaattttttgccgcgcttttttccgccctttttattttttttttgttcgttttttactttttactaaccttttttttttgccacggaatcgaacagacctctgtagatgtgaattttttaagtagggacaggagtagagatacatatgtatacaaagtttatatacaaaacgtataaaaatataaacgtatacaaagtttgtatacgtgtatataaaatttgtatatatacatagtattaagaaataaaaaaaccaaaaaaacaaaaaaaggaaagaaaaaaactgaaaagaaacgaaaaaaggaagaaaaacagaacaaccgtgcgtgggccggaataggatttttttcccctttttaagggatcggatctatttttttcgccactttttgtgtttttcgaatttgactttttttttcccgtttctaggggaatcggattacagtttttttccctattttttcctccgattttttttgtttttcttttttaagggaatcagacttcttttttttgttttttttcgctattttttatttgtgacggacgaaggaaacgtctcttattttttaagtagtagtagaagaagtagaggtagatagatagataccggtcaaaaacgaacgaatttaaaaaccgatccatacacggatgacgtaccaaagtaccgacaaaaatatcctcaatttttcgagaagtctttttcgagggagtcggactttttttaaggagtcggacgttttttttcttttttaggtagaagtttttttcctttttttgtcgcctttattttctccacagggagtcggatttttaagagtcgaacgcctttttttttgcgacagattttttttctcttctttttttgtttttttctctcctttttattttccaccgggggagtc

SEQ ID NO: 58345 - DNA, 1075 bp, Oryza sativa
  unsure (1)..(1075): unsure at all n locations
ttaaatggcggcacagtatgaggtgagtgacgcattaggcgcgctcggcgtcgccgccatctccacggccaccactttggccaccgcagcgttccagccgccgccggcgccgggcggcctccgcaccaccaccacctacaaccacctcgccgtcgccgggctcgcagggaccttccttggcggggtggtcctggtcggcgcttcagtctgggtgtccgacaacccagctgcccgccgtggcaccggcaagaagctcctctacgccgccgtcccgatgctcctcgccgcggtcgttctatcggtggcggcgctgctctggtaagcctctcaaattaacgctcatgtacaagcccctgtccgaccgcattactatccgccatgatcggagccaagccggccgtccctagcgttctccttatgtcaatcaaatgtaaccttaattcttcatattgtttgttttattggtcgatcgctgcgtcgtggttgtgtctcgtggagctgtagtatcatcatgtaatagtgtttgcttcttattctagtccattgtgtgtatcacctatgtatgatcacgtctccttctgttcttggtctgtcaaagtgttattcgattgatggccggcttaatcgacgagtgttttgttaattatgagttcatataatctcggcgtggaaatctcggcgtgggctgagagacttaagttagatgacagacatgtaatctcggcgtggaaatctctcttctccttttctatccgctccctcgatatataattggactctctgtactttctttgctattaatggattcaggtggggaagctctcccccccgggtgaattttcaaaaaaattatgagttcatatctcccaatttgaagtatggtgattcaaaggggagctatgcagtactagtttttggcttaattacatttagggaagagtggatttggagtactccatgcatatcggcgccgctcgccgtcgccgccgacgctgaatagttctggaagtttgccttgtnnnnnnnnnnnnnnnnnnnnnnnnnnnnnnnnnnnnnnnnnnnnnnnnnnnnnnnn

SEQ ID NO: 58346 - DNA, 1010 bp, Oryza sativa
  unsure (1)..(1010): unsure at all n locations
nnnnnnnnnnnnnnnnnnnnnnnnnnnnnnnnnnnnnnnnnnnnnnnnnnnnnnnnnnnnnnnnnnattttggtaagattctttagtgaattcagttaaggaaaaagcacaaccagtcgacggaaacttatccaaaagagacatagtttaagaaggaaccttgaaaactttggcatgacggtttaaattctatctattaattagacaagatttagtaatttccttttatctttaggaaatgtttatttagtgtccgatcatgacttgtatctttccttttatctttaggaaatatgtgtcatgtccgatatggactagtatctacccatggtataaatatgtacaccgatggtctttgtaatctatctcttgatcaatacaactactctcgacgtatcgccaccctcttttccgaggtttttacttatcaaccggcagaacttggcacgtgacgcgtgttgcatcggctttcgatctctggcgagggggtaagtcctacgttccgccggccctggcaattgtatcggctacattggtgttgttcaaggctgtattgtttcgacctcttagattgctctagtttggttgatatatttgcctaccggtttatcatatatcttagttaatctaatttgattattcaatttacttgtatcgatctgatcttttctagggttttactggtatcggctaaattgtttgtcggtctagattagctaaggtatccactaccctgaaaatcagtcaatggcttgattgtttagattttatgattctttttatattttgcgttgcatcagccctagtcatgcttagaatcataaaaactaatatgcatgcctttcattgctaataagagtttcatcgaggttttagccgatgggttatctggacgtttcatcggcttataaggattatatacaagttagttttagctgattgcagtaaatgtttcattgattatctaattgtttgannnnnnnnnnnnnnnnnnnnnnnnnnnnnnnnnn

SEQ ID NO: 58347 - DNA, 1185 bp, Oryza sativa
aaatcccttatatcgtgagacggagggagcatgagttatcagagccataatggctgtcaggtttgcacacccgagcacatgttttactctctccctcccaaaatataatatatatttttttaagatgggacatatcctactactatgaatttggacatgtctcatatctagattcgtagtaatatgatacatcccatctaagtaaaaattgttatattttgggacggagggagtacaagagtagcaaaattcacagatgcaggaaaattatgcagaatattgctctattctaactcttgctgtcaagcttttagaatcagtcgcagcagcgcaatgcactcaactctaggatgttttatcagtgcttttctttttctgcacaaaaggcaggaattgtagacacagtttaatcataaatgtcgtcatagaaaacactactgttataaccatgttaaacactcgaactacataagccgtacaagagaatttgcctatgcctcttctaaacaactcttctgattaaatgacattccagaaaattagtacacacaccagtctccacatacacacaaatacagaccatggcaattatacgttaggttgatttcctcattataccagtgatccacaattaccggagcatagaaaacaccaacttcggagtactgtacaatcactcaaatgagcatgaattttcaccgaacataccaaattgctcgatcaagtcctgataccagggtttaacaacagaacctccaccatgccaccatcttatgccagcagaaatgcacgtaagagcaactgagcaaacggttaaaaatgccatagcagtctgtgtgcataaacagagagatatcctggcaaagttatgtatcacacagctacgaggcatttcttttgctgctctttgacaggttatagttatacatgccactaaaatcagagcagatgcatctggtcttcttacaactcaacatccccctacataaaagcagaacaatatactatccgttaataaagagctgttactgatggtaaaaatacatatgtgcaacatctgttgttcaatacatgaaaaagataatgacaaaaggatgatgattctttcagaagtatattaaaaattaccaactctttcgatatactttaaaggcaccctgctattcttattcattgtgacaaata

SEQ ID NO: 58348 - DNA, 5945 bp, Oryza sativa
  unsure (1)..(5945): unsure at all n locations
tgaggaggtaccatgaggtactattttttctattgtaaatttagtatctcttgatacctaggtactatcaggtaccaaattctacattaaattttttggtaccccatggtacctcctcaaggaatgtaaaattgctccaacaagatatacagctcaatacactgcttttgacatcaaaacaaatgaattatagatgtaatagaacggtagagggataagccttttcttagaagtttaacaagtagagtatagtgaaaagagaaaagggcattaagaaaatatttcaggacctagtgtatggattgcatgtatgagttatcctgcgttgccctgaggccattccacatcaaaataaacacatagagttcacagtccataacctatcagacaaagcgatagccatattcatgtatgaaatatggctgcaccattgggcatagtagaattttagttgacctcaatgccttgtgcaaatgtatttacaaaagtctattggttcagatagacagagcgcatgcacatagcatgagtgtagctcgaatacaaacctcacatttattgtaagagcaaaagaacagatgagttcctacaaattttgcaattacttaagcttcagctagggaacaatggaaatcagcacagcagagaaaccagtcctttaattttgtttgcataagggttgttgaaagaagcaatgtgtatgtagcaaaaatcccattcagctctaattacatgaatcaccaatagcaacatataatcaagtacaaatcatgtataacaatgccataaatttaataactttgcagcaaatcaaataaatactcagaacaggatataacgtagcttagcgaactatttggattatactataacacatggttgctgaaatacatctccttttctcttcccattaggaggggacaggccccattttttacttccattaaaacagaacaaaccatcttgaaccactcataagaagatcaacatgacaagatgctcaatgcttcagcaacttaactaaaaggacatactggaactaaatatgcaccgatagtaaagatcaagtgttgcgattaaaaagaagcacatcacacacaaccaaagaggcaaagaccaatatcagtctttaaacataaggaactagatgtagctggacagcacagcgaaaagcttacaatttgcattttaagcagcatactgaagagaaaatggtatctacgacaatatttgggggcctagtgtgtggatcgcttgatacaagtgattatatgtctcccagggtctatttttcatcacaggaatgcgctttacataacctaccacacaacgcaactgctgggattttagggattatgggaacagtcagcataactaaattagcaaggaactcaaagtcaaagcacatcaacgatgctgtcctccaaacccaagtgcccccccaacacctaccacaagcgaccccgaccagatcctgcccgaggacgggcggcgcaggatcgcgcagcgaggggttggccggagaagacgaatccccgcgatggcgaccggaaatccgtggacgggcggaatctcgcgcgccgcacgggctaccgcctcgatcaaccaccgccggaaacgcgatagcacagtcagtggagataggggtggggatccaatcaggcgtagatgccgaggcggaggcggagcagccgacctcaccggcaaatggtcgcgtgagatctccatggccgtagccgccgccgccggcggcaacgcaaggacaaaggtcatggatatgatacggcatgtgggccccacttaaatatggcccacccttccctctcttctaacagttgccccaaaaaaaaaaagaaaagaaaagaaaaaggagaaaaagatgggcttttagcggcagaaggacacgacggccgacaaggcaaacttccagaactattcagcgtcggcgtcggcggcgacggcgagcggcgtggagagacgccaccactctgccgcctccagggcaacgcagtcccccagcgccaccgagacagtagtagtactgctatgggggcggcagcggtggcgcaattgatgagaaacgcccgccatgctgtcgccggcggcggcgccgatatgcatggagtactccgaatccactcttccctaaatgtaattaagctgaaaactagtactaaatagctccccatttgcttgaaattgcgagatatgaactcataattaacaaaacactcgtcgattaagccggccatcatacgaacaacactttgacagaccaagaacagaaggagacgtgatcatacattggtgatacacacaatggactagaactagaagaaacacgcactattacacgatgacaatacagctccaacaagatagtgatgcggccggacagggggggcttgtagtacatgagcctttgcggcacttaccagagcagcgccgccaccgatagaacgaccgcggcgaggagcggcggggcggcgaagtagagcaacttctttccggctgcacggcgggcagctgggttgtcggacacccagactgaagcaccgaccagggccaccccgccaaggaaggtccctgcgagccccgcgacagcgaggtggttgtaggtggttgtgcggaggccgcccggcgacggctcgaactctgcggccaaagtggtggccatggagatggcggcgacgccgagcgcgcccagagcggaggcgatcttagcctccggttcgcggcgagcatcacccaacagtagctttgccgccgccattaaatctctcgaccgattcgtggctgcccgatcttctcctcgtgaactacagaagagggggagagagagagacctgtgggagggaccgtcggagttggggtggcttggttgctggagctggaggtgcaaaacatatgctcagaagataggcggaggaagaaatatatatagatgacaacgcaaacacaaacaagaaatgtcagtagaaaattttgcttgaggacgcgagcgtgcacacacttaaaaaaaaggtcagaagaaagtcagacgaaagtcgcacatgggcatgggcctcccagtctcccactgacacggcgggacctttctgttctgggcccacttgtcattcggtcattccagatactcttagtactctgccgcacgtaggataactaattatgggctgtttcggtagtctgtctgtcactggactgtgcttcatgtacaggtcagccattcgactgcaagtttgaacgcgatagattggttatataagatttggagtatactattaaggggtttagcccttctctcccaaacaccccctaaacttgctcttagggtctgtttagttcgcgaaaagaaaatttttgggtgtcaagtcggacgtttgaccggatgtcggaaggggttttgacacgaatgaaaaaactaatttcataagtaaaccgcaaaacgcatcttttgagtttaattaatccgtcactagcacatgtggattactgtagcacttatggctaatcatggactaattaggctcaaaagattcatcttatgatttttctcttaactgtgtaattagttttttaatttatctatatttaatactccatatatgtgtctaaagatttaaaatgatgtttttgggaaaaagtttttggaagtaaacatggccttaaccgaaaagcccaaatgacgatcatgtctttaaacaaggaagcttctgcgaactcgcataattctgccgtttgattcaacaccggctttttttatacgttcggccttcgggcacacgtcgacccgtcccgtgtttttcctttttcgttcggggcacacgttggggtcgccatttccccggcttttctgaccgcgaatttcccataaatacatggcccacatagtattttactccacttcggttctctcaaatcgtttcgtccacactccacagtccaccaccggtaggatgacacgttggtgacgtcatccccggccgggggcttttgctgccggcctcctttttcttctgatcgaccgatcagctgagagattgtacgtgaagacgggaataaattaacacacgctctctctttctctcctgccttttatttttgactttggtagagctcgagggcgtatctttaaataggattcaaattagtttttataccgataattatctctttctttcttgaccaataagattgcctgtggtattgtttccttccaagaattggtcttgtttgttcaatccttcacccaactgctattatgatgtggaattaatccctctaatactttcttatggagattaagcgaaccacaaaaacataagcaattaactactgaacacccaacatattattttattataagagaaaagcctgaattaacccctaaactactgcgatcgacctaattaagccatgaacttgaatacaagacacattgacacacccaactgctcaaaccaaataagcctccaccccctctcaatccaaagtggttttggtcctacataacttgcgcacaacattcaacaattatattttaaaaattggtaggcctacctatcatattttctcctcccatgcaaacgtataaggcatatccggaacatcatcttctccaattgatgtggctctctcatttgaccatttccttgtgctagctagctagtagcttagctgagcaaagctaagccagttgttatccactaatcagcattgattagtttagtcaaaaaaaaaatctcaaggctcaccttattatactaatctgcagttgtgcccttaaatacccacacgcctctctttcttcctctttatcctttgcagttgcaccaccaaacagagacagaggtagagagggttcttgctttgcttagctccattgtttttgcttggcaagaagaagaagaagaagaagaagaagaagaagaagaagaagaagaagccatggaggggttgctgccgttcttgtacagggcgatcgtccactacgccaacggcgggcagacgccgatcggcaacccgttcaccaacgagtcgccgtcggcgtcgccgcgggcgccctactacgtccgcctcgccggcggcgcggccgactccggccgcctccgcttcgccgaggtgcccgtcttcccttctccggccagccgcgacgcccagctcctgtgatgtcatgtcatggtcgtctcttctcttggaggattattaattacagtaataattcccgcgtttttaattcttcttctttttctccttcttatcttggaattatcaatcgataataataaaggcaggatgaattgacaggaaaggccttgcaaatgggggcccctgtctctgtctctgtctctgccgtttgtatagtagctcgatcttgttcctgccaaattgcaggctctcaatcagaatcagaaacagtaattaaacatgcataatactatttactactatatgtaatctaagcacttgcttccaatgtgtagcacagcaaagtcttgtaaattaaatgttcttgttgatgcccaatgatgatcctttaattgtcatgcagcgcttgactgttcctttctttgatgaaaatcgatccaggcactacactaaatgttgttttcttctctctattttcttttttttttaaaaaaaaatctattttcctagcttttttatctcgttttctatgtgcacgcttctaaaactggtaaacgatatattttcacgaaaaaattatataagaaagttattttatatactttttttttaaaaaaaaacctaataattaattaatgatgcacgagggattatccaactacaagagccaaacacagcttcagatgttgtatcaaatcatagtgctagaccatttggagaaggagaattaatttcacaagcacaagaaacccatannnnnnnnnnnnnnnnnnnnnnnnnnnnnnnnnnnnnnn

SEQ ID NO: 58349 - DNA, 886 bp, Oryza sativa
  unsure (1)..(886): unsure at all n locations
gaggttgcttcgattgcacacaactatggcacttagaaccttgcaatggaaaacttaggaattaaacacatgctggaagccgagacatcaagccaaaattatatgacataacgtgaatgccaaacattagcctcattatccatactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccatgccaacaccatgaacagaagcatgtgacccattccccattaggacggtgtaactctgtgtgtcatagtaaatagcaaacagttatttgcttgcacaacaatgttctctggctcccagagctgtatcttgtcaggtcttttcaatcacgtaagacaccattggtaatatagcactgtatctttctatctatcaattatcttattaatactgccttgcaagaaggcgttatagttatctctgtaggctataacttgtcacatcaattgaattaacaaatgtaatttgtcttagtaggaactgaatctttgaattttattttttcgtgagtttcaattaagagatatcgagagagaagtgcgtgtagatcccctttttagagtgcatcaaaagttggaataagcgcctcatacccgcccgactgaatcannnnnnnnnnnnnnnnnnnnnnnnnnnnnnnnnnnnnnnnnnnnnnnnnnnnnnnnnnnnnnnnn

SEQ ID NO: 58350 - DNA, 936 bp, Oryza sativa
gggaaggagctgacaccatcgtgatgagcaaaaataacaaagactaacagctagctaagtcttctaaacttcattatttgcttaagaaaatgaagtgatatatatacacatctaggggcgagcttcaatttattcgtggatcaaggcgctgatcaattgctccctccgtccctaaatatttgacgtcattgacttttttaaatatgtttgactgttagtcttattcaaaaaatttaagaaattattaattcttttcctatcatttgattcattgttaaatatactactactactcaagtttttgaataatattcacaaatgtttttgaataagacgaacaatcaaacatatttaaaaaagtcaatggcgtcaaatatttaggaatggagggagtatttgcttacggccaaggccgggatgttatctattccattatctaaaaagttttgcttacggcaagaaaacgattgtgctaattgttacaggctaacaaaatccttcagctttctcaaccataggaggtattcttcgttttccttgtagatcatgtactcttgcaagaattttgcggccatgggtgtgatcccacgcagctccaggtacttgttcaacgccttttgcagactttcatcgaggtcactgcagcagacagggcaaagcaaattgcacataagaactcggcgattaatagttaagaattaattagactgctcaataatttaggttttgttatcttactcgaaatcaggaccctcatctgcgatcatttcattgttgtcatcctctggtggctgcatcaaggacaaggtgtcgatgacgatctcttcaggatgggcagtgcaggagaattcaaggatctgtccatctccctttgagatggtgacggtgagaggaatgctggatttggagggaacctgaatctcttcgtactcagat

SEQ ID NO: 58351 - DNA, 1208 bp, Oryza sativa
attccatctaacatccatgtccaaaccaaacatacgaggacgataacccgcagcaatgcaaacatttttatatgtagcaatgcgctgattagatgcattcaagaatgaaatggcagctctaatgtcatttagcatgggcttgaacttgtcaagtccagccttaacaatcaaattgatgatatgacatgcacagcgttgatgcaaaaataaatcaccaatataaccagacagagcaggagtaagggtgtccatagctttagaattagcagaagcattgtctaatgtaatagagaaaaccttatcagtaataccatattcttcagcaacagcaatcacacgctcagcaatattagcaccagtatgtgactcatcaataagcctaagacccaagaccctcttttctaattgccaatcagaactaacaaagtgatctacaacactcaaataatcttccttagcatgaccagaccatatatcagatgtcaaagcaatagagctagcagaattgagacgatcaataataacagaacgacgatccttaaacaacttataaaaatctctggtagtagtttgtctagagacaggaacaaatctagggttatgagcaaccttaatatagttcacaaaagcaggagattgaccaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcagagactcgaaccctattaccattggtcgtttcataaagttcctcaaagtcatcccataccttggaggttttggtcttcttgttggtacaagtcgcactagagccagtcggcgtcccattgccactgtcgtcgaccggcgggtcgtcgtcatcgacattcacatggatcgggatgtcggaggtattgccgaacacctccacacgatcctcctccacatcatcatcgcatcaccgcgcatccccatagtcctcaactcgtagttgacagaggtaggatcgtcgtccatcgcaggcactctggtccctcaacggcggctgccgctaagcaacggg

SEQ ID NO: 58352 - DNA, 1751 bp, Oryza sativa
agcagcaccggggtccgatcttgtaagggcaactatgaccccgaaaccatgaagaagtacatctacctcgtcgatgccaaagaggtggagaaggtggagttcgggcagcaagtcaaacaggtagcctacggggttccggagacggtggatgtcgagaaggtctggcaatgcaaagggaaactgctgaagttgagcgacggtcgaagggatcaaggtgtggcgcggcggcgggacctatgcctgtccttcgccctcttcaagatgctcaggttaaggtttgccgtcgatcatgttggtcgttttgccctccctttccaagaaggcaagtcatgggacttcgtcgtcaaggggctcctcgccgatgaccaagacctcgatagggcgtaccgggtggtcgaggccgagcttgggttcctctttgatttcttctatgcccgttatccatctatcaagaacagcctggctcctgaccttgctgtgtatgtcgcgatcctcacgacaagcctattcacccttttctccccggaccttctccgataccggccgcttcggcctggtcccggagacggtggagatgccagcaacatcatcatccatggcttcaaccttgacctccttgtcacccgtttggtaatcgtttggtacatcttcctcgagtcctatcagttctttaccttcatcttctctgattggcacaaggtgaagatgatgtgtcggtacgtgcgcaatgagtcatggcacagggcgctcatggaggtcccactcaaggtgttgtgccatttcagtaccatcacgaggtactggaagggaaccatcggccaatacttcctcctagacaacattcatcctcactggatcaagaccttcctatcatggttctccatcgaggccaaggccctggactcatggctgatgactcgctccatccgcttgacaccggaggtgagccacgccgtgctccgtgagctcaagaactgcaacggcaacatcaccgacgggaggatgtggttgtatcagaagggcatcatcgacatggacctcgatcgtgacgtcttgctcggcaacccatacgctaattacatcctgaagtggcacattgccactagcatctgtgactacgggctgagcatggagaacggcgctaccaccaccgacgacgagttcgcgaggaatcacgaggtcgcaatgaagttgtcagggtactgcgcgtacctgctagcgttccagccggagctagtgcaggacaacacgtacaggagcacgtcgacagttcaaggcacgctgcaaaatgcccgggacttcctcggcggctgcaagtcccacggggaaaagtacaagaagctgatcgagctggggcgctcgaaaatagtgatggaccacgagatggcgcagaaaagcaaggacatcatctacagctacgactccgacgaggagaaggtgaagaagatgatcgagctggacaactcgacgagcaacgacacggtgaacgtgcttaagatcctgtctcagggcgcgagtgtcgccgtgtacctcgtcgataggatcgaggacacgagagagcggtggaaggtgctcgccgctttctgggcgaacctgatgctgtacatctccccgtcggatagggcggtggcacacgccaccaggatggcgaccggcggcgagtttataacgatcctatgggctctgctgacacatgctcatgtggtagacccgctccagtcgcgcggcggtaactcgggattgcatatgca

SEQ ID NO: 58353 - DNA, 1379 bp, Oryza sativa
  unsure (1)..(1379): unsure at all n locations
tttgccctttctacttgtcccaccatataacacaaattaagtatgctttaattacctgaatgacacaaattaagtatacttagagaaatctacagtatattaacaaaataagtaaaaaaacaaaatgagtatagaaaaaatgctcgaaatgatttagttgttccatcacttcttatgttattatagcaaatcacaccaaccttgcaaggcgttgcatccgtgcgctcacttgttagattcttgtactagattgtacccacatatcaaattgttgcgctaccacgcttacttctcaagtttttacactaaattgcacttgcatgttaagttgatgtaccattaatgcaatttattcatcatgtataatactatttgttattgtatagctagcttacaaattggaatgatcaaattgagttaaactaaggagatagtcattggcacctcaaaattatgggagttaggctccactgcannnnnnnnnnnnnnnnnnnnnnnnacttttcaattgagtgccggattccaactcctaatggtaatggtatgaaggttttcatcaaattttggtaaaaccaaaaatccccatcaaatttaatgtttcaaatttgaattctcaaaagtgattcaaaaatttcacacggaatagcttttgtcccacatcaaaaccttgaattttcacagtttcttgcatttttgtcaaaaatgtgaacatttactccctgcgtaaaaaaaaacttctatctcgaacctgaatatgcctatgccgaggttcctatctagaaatgttttttcgatgaagggagtaaagtggtgtttgtttttactgaaaatgaatacaaaattaggatatagaaaaaatccattagcacatgattaattgagttgtaattgttacaaacataaaaaatagatttatttgatattataaagcaacttttatatacaaagttttcatataaatacaccatttagccgtttaaaaaatattgctaaggaaaatcgatgtaaaatttaaattttaatgaaaaaggaacgggtctaataagttatggcgacagaactatttttcttcctctccaagaagcgaagaatattgcttatagatcgaatgaacatactgaccaagttttgacagaatgacaggtggggcccatgcccctaccttttttttaaaaaaaaaattcccttcttaaaacaacacaaattctcgcctccccatcttccagaaaaaaactcctcctaaacccccgaaaaccctaacctttcgtccgcgccgccgcacgggtcgccatggctctcttcgccgccgctcgccgcgccgccacctccaccctccccctcctccgcgcctccgcctccgccgcggggaccacccgcgg

SEQ ID NO: 58354 - DNA, 7196 bp, Oryza sativa
  unsure (1)..(7196): unsure at all n locations
tagtatatttcagtagtgggaattgggcgtctgttatttactcacttattttaggtattttgttcttctacttccttctgcaattggtagcgtgaagcatacttattgttctgttgagattgtgtggtagtattttggtacaaggatatattggtagcgttattatgtttatagcgtggtcattgctctgctgagactgaggtagtacttggtacaaatatatatttggtattccactttttcatgcccatgtttaacctcaacatctcttgattataaatatattttgggtgtcacttctttgcagttatggcactatttttgtgtttgatcatattgtactgtgcttaattttgtgcaatgattcatgtgtttctctgtgtaagaactcaatgttccttttgctcttgttccttgtgttctttattataacctcttgtgctctttattattaccttttcccccctgtagtcttattctattaatgttggtttctaaaatcttttattttgaaacttttctgctgcttaaaactctgttggtgttttatgaatcattgtgtctagtccctgtcctttttcttgagtttttgaggggacctgattatttttctcgaactgtacagtttaagttttcatgccagcttgattactctatgcatattatacatacttatattttgtattcatatataagcttaatgcattaaagtgctggtcaatttaatgttatgtacttgggctggaaaaatggtgttctaacgacctttttgggttatgctcctaagtttccaagcctaaaagcatccatgcttttgcatcatgcactgtttgatatttcttgcttgtttgaagagaagaaaaaccaacaaaggaagtgtagtttctatcacacagatataagactttgcaatccctgctgttttgacatcaagcatctcgttctggtgatctagtcttgcatcaaattttaattatggcatgatttagtgtagagttgtacacatacaatgcaaaaagaaaccatgagggtcagaaataattgaactcccagttatatttttcttctgagaacactatgttttactttcatctttgctttgaacaatttccatgcttttccaggagcaattttctgtcactgtctgtctgagagcctcattttctttttcatcctgacacaggttgaggagattcctgacaacttcccctttaaaattagtgatgaaaagggctttaattcaattactctcacaagaacttaccagggtgagaatattgaggttctagtttccatgcccagtcttgtgactggcgatgaacctgaccgtgagaatgaggctgatgaggacagaaacgaggatgatcaggaggaagaaactcagaaggccccaaaatctagcattcctctaactgtcaccatctcgaagggagaagagggaccaagccttgaattcatctgcactgcctatcctgatgagatcctcatcgatgccttgtctgtgatgccatcagagagtggggaagatgaaatgatcacgtatgagggccctgatttcaagtaagaaaaccaaacctagtgtatttaaatttattgaacactcaaattcttcaactaatcactgtcaccgagtgctaatgttcaacaccttgccctttgtctgctgcagtgaccttgatgaaaacctgcaaagggcattccacaagtacctggagatgcgcgggattacgcccatggccacaaacttcctacacgagtacatgatcaacaaggacagccgagaatacctcatctggctgaggcggctgaaggattttgttaggaattaatgattaacacaatcatttccttgccataagattagttttgagggctgtgaaccgctcctttctataagtatacatggaccatgaattgtgaatgtatgcttatttaggcgtttaaggtcgttgtcgtgaccaagttttttggcagtatcataatggctcatgagtcatgaacctggatgttggaaccaatggaaatgcttcagttaggatattctgtgattttcatctacactgatgttgctttgtttcattcctttccctttagccatgtgcactcgttacttaaaagtaccagacatgcaaatctaatttgctgaaaacacatagtttttctctaaattcacacgtcttctgattgtttgggaactatggcaagtagttcttcacagctatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacagccgtcactgcaaaagccttcgtagccttcccatcccaactccagaccacaactggtggttgtttgggaactatggcaagtagttcatcacctctgtgaagaacttggagtattcatgcttaatcctacaactgtcactgcaaaagccttcgtagccttcccatcccaactccagaccacaaccgatggttgtgcactggtggttgtcctcaggtaggactagcaattggccacgcctcctaacgaccttccacatcacctcctggacggcatcctcagcgatctttcggcaccgtcggcactcctggttggtcctcttgttcccggcatcggtcgtcgccgcctcatcaccgtcgccctcaacttggctgatgtactttttcccagtggcgcgagcctcatcggacttgtagaggaggaggccgagcacgtaggccgctgtcttgtggcccgcggtggcagccttgtcaaggaggaaaaggccctgggccatgtcctgctgtgcgaagacgagcgtgacaccgatgatgaagcaagtgtccgggttgtccgcggcgacgaggtagcgctcgttctccacccacttcatgttatctagcctctccagcgcacacgtttcccgacgtcgcgctccttgaccgccgcgtgcatggccttgcagctgcagtacgtgtttaccaccaatacacacacagtcaatatacaaagtatttccatatacatatataaataagtttatattaacaagttaacatatgtagcacgtagactgagtaggtcggcaattggctccggtgaggtagcagccacaaggcaggcgacgtggacgatgttatcgtggtaaagcgccaactccatcgccgccggtaccggtgacaacctcttcctcttcatcatcttttccctcactgccatgctccgggtggtcaccatggtgccctacgagtgagacacttacgcgtacgtgcgtggatgtgttaattaattattaccaccttgatcccttgtaagctctcctaacaataaaacaatagcttcgcttagctatttgtaactcgcgccatgataattcatccgttcgtagtaggaatcgattagtgtagtccgaattggatttgaataatatgtttggttcggccacatttggaatcggattattcacatttgaatcggccacattttgaataatatgattaattgattattcacccgtttgttttacataggctggaatcggattccggcccaacttaaatctgataccgatacgggctcggtgtctctctcgccgccgccgccgtcgacgacgactcacgaggctcgattccatctccggcgccgccgctcctccgcctccgcctccacctcggcctgccacctccggcgccgctacctccgtgaagtggccttgctgcttaccgcccccaactgtcgtccactcccactcccagaccccgacaaccaccgtgagcgcctaaaatggcggcggcatcccgctccatgacggcgagatcatcggaatatgcttgcgagggaagcagggcgatgaagaagtcatgggtggattggcgtagcggccgacgacctcgcggttacggagtagcccatggatccacgacgatgacgaggccgacgaggacctgattgtaaaaagttaatatccagatagggacctaaatgtaagaatgacagatcgctataattgatagcgatcctcccaaatatctgcgtcctataaaggccttcgtcggattatggaccggactttgtgttcgcgttgtaaactttgggccttagtgaaggcccaacgttccatacgtccgggaggcccatcgcttcggatatcgtgggccggaaactgttgctccctcgcttggagccacggaggcccagagtagatctggcccgcatgttggccagtatcccgttccgaaggcccaactgctttattatccgttctctacttatgggccaaattcgtagtagctccgaattttgggcctcaaaatgggctgatcgatcctcttgtaccatcgagaagcccagagtcacattcttaatcgctgctaggcttacagcttgctagcctgaaagagaacacttctgcgaataatcattgataatccagatttgaaaaaaatattgataatgacatgtgtgatcgagttgctaacgtcttatcaaatcacagaaggatctttataaaagtaaatacttttatcttactgatttaagtatattattattgcttaaagtcaagacaaaactaagtatggtggatattcagagtttataatggcattattaacgaggccaattaatccacaatcgtcaagcatctctgtccgtcgcaagtgacaatgacactatctagcaggtgacattgaccatgctcaatgctgcatgatctggcaaggtttcagctggtttttctgaagaaaactaggggcggccaaatgcctaagctgtttcaggcttcctttcctgtttcaggctgttgcctatcctcttcctactgcatctgttttcatgaatccatgacattgcaacttggacaagatatacaagttataatgatgtgttcatttttcattaattattgcttagccaatagctagacatgtcctcaatacatgaccttatcttgccaaattcggtgaactctcagcacacttgattaatttagtttagcgtattttctacatcaatttgatactagcttgcaccaacaagtcatttcaacgtacaaagaaaaggttaaacgacatatactgatataccgaatttggtttgctccgacatttggttcacacagagtatatctccatgaatgcaatttagatttgaagatcatgacataaacgctccgttggttaaattccttttggtacatgtgggcttgagtctccgactcataacagatgatcgtatttacaattaattatttttctagtaataaacaaaatgacgatcaatagtgaggtatttgttgtgacttgactttgccaatcttagtctattttctcgaggatgttcatatggataacatttgcgtgtgccgattgttgggaacaatctgcgtgtgcctatatagggcctgtttgggggagctttagattctgagaagcagctgtttggtagccagcttctgatctgaaaaagttctaaacccagcttctccaggttctagcttcttagttcatttttcagaatatataactacagattctcaaaagttgtggactgtttggggcagcttctagcagaagcagcttttggaaaaagctgcagctgagataagctcccccaaacagggccataagcgtgcacatttgcattatatttttcccaaaaaaaacaacatattacgcattacaaaataaatttcaatacccaaacaaaatatcttttatatgtttaactcaaaattttccttcagtttttactcaaatttgtgccacatcacaaaattttttttaaaaaaacataaacatgtacttactcgtactacatacacaataatggaaaaaaaattatcattattaaaataaggtagggtaaaacaaacgtgaggaggtggatgacactacgcgcccaaccttcccccccccctctctctctctgcttcgaattcctcacctcacctcacctccaggcggcggcgaaaccaccagccgcttcgcttcgcctcgattccaaccctagccctacccctatccgaatcccatgcagacggaggcgcgggtcggggtcgtcgtcgacggcggccgcgccgccatgggccgccgccacatcggcaccgtcgcccacctcgccgccgggggcttcgccggcgccgtcagcaagacctgcaccgccccactcgcccgcctcaccatcctcttccaggtgagcgcgtccccccagcatttccctgcctgagatttcgctcttcgtccgtacgggcagtattgggggtggatgtactggatacggcgaggaggaggaggggattgggagctactgctactgcggaggcgaattttgttaattttccttgtctcgcaagtggaattcggggaggaagatgtttcctcccctcctttttttttttggatgtagggattggttggcacgagcagctacgacgtttgttactaataaccttgttgtgtgttgctttaacatgtgtttaataaatgatttgaccataaaggagtctcccttttgaacacatagggatttctcttcctgtgggtgaaaccagtacaattgtagtacagcataccatgtgttgttgttttggaatcctgtgtgccctaataaggaactgggagtaaagaaagcataagacaaatatgacttcttttgtcactcagaaacggtgggagtactccagtagtgagtagtgactggtgaaaatgtaagcctgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58355 - DNA, 1937 bp, Oryza sativa
  unsure (1)..(1937): unsure at all n locations
nnnnnnnnnnnnnnnnnnnnnnnnnnnnnnnnnnnnnntgtatatacatgatagttattaattattttataatttcagattttagttatttataaattgtattccaatctagacctagactcatctttcaatatttcttattattttaattttgaattttcattattcataaattctattcctataaggaccttggactcctcttccaatattcattttacttatttgtaaattgtatttctatatatactctaaactcttcttttaatattctttttttaattttgtatttcctttattggtaaattgtattcctgtatggactctagacctttttatcaatatttattttttttaattttatttatttataaaatgtatttgtatatggactctatacctttttttaatattccttatttgttaattctaaatttcagttatttataaattttattcatatatagacgctagactcctctcccaatgttgcttattttttaaatttttaattttttttctaaattgtatttctatatagactctaaactctacttttaattattttttaatttcaactttcacttagttctatattcctatatggactatggactcttcttccaatatttttatttgtctaattcccaatcttttatttataattgtatttctatatagactctatttttttccaatatctgtattttttaattccgaatttcaattatttataaattgtattcctatatagactttagagttttttctaatattacttatttttaatttcgaatttcagttacttatgaattgtattcctatatatactatagactcttctccaaattctgcttatttttctaatttctaatcttagttatttctaatttgtatttctaaaagatatttaagttgattgtgtataccagtaaaacaaagtacactcgcttgagtcaactgtcacaaatctgaatactctatcaaaagggggataaatagaatttgtaaatcacccatcagaaaacaaacattctgagtagcaattctaaggcttacggacctacaaaatatgtgtaatacagcttagaaaccataagtttgtcttgcttgcgattttatctaactgtaaaaaggattccaatttgcgggcgatgcacaaccaaacatagttctcaacactcaacagaacttgagaacaacatggcatgaaaagatttcactagtcatcgtccttaattcttttcagcagcctagcagcccaccggcgtagtcttctcttcaatgtgaagcccaccacaacaccgactgcaaagctgacggcgctgatcttcgtacaagttgatagagagacaacacgactgcaatacagaatataacacaagtataactattgtcaggttctaaggtgttggacagttgagcacagggttcatgaataaaatggtatcagtgcctggaaatgatagcaaatgttgaaaagttgtgccaaataaattttcctgaggcagtgcaacttacttaataagctcttaaagctgcatgcagaatatatatatagggtatgcaaccatgtctagctcttgttgttaagctttcagatttagtaacagcagcaccaatgcacacaaactctaggctattttgcaactcaaacacagttatacaatcaatatattcactgttcatccaactgaaattctgaacacagctcaatcacaatcaagtactctcacggtcttaaacctcgtagcttttgatctagaaagacactaaaattttatctactctgaactcaatgagctgctaggatcacaatggaatctgctcatattcttctgaactcaccattgcctcttctggttgcatcttgtatgacacgagagctatacaaatacagaccccttgcaacatatcaatacactcaactttgagac

SEQ ID NO: 58356 - DNA, 6711 bp, Oryza sativa
atcaaatgaaaccgtgggtgcaaaggaaggcaaggcaatcatatctcaatcaaatacacttccaacatatatccaggatgcagcattaaccactgtcaaaactgtaatttctcattgctgctgcagaaccttgttacagcaaagtaatgcagtaaacaacatatcaagaacaggggaacagttgaaaccaagattaggcaaggacaaacattttactgtaaataaactactggttaccagctttctagatataactcgcgaaacaggagaaaatgctaatcagatacagagtacaaatggggtacaagagcaaagttttggctacgctaactccggacttcattttgatttccgtggtctaagaagattccagtcaagcttttcacgcttgtttgacttgtgagacccacggccattgctttgggaagatgaatcaccatcgatactcttacctgtggtcttgggctgcctatgtgatggtggtgtttccatttcaagctcaggctgtttcctctttagttcattcagagatatgctttctgaactatcaatgttgaagtcactaaatcttgttcttgatacttcatccgttctgcatttccattgtaaaagggatcacgtgaaaattcattacatccacaagctattcaaagtgctcaaaattatatgtgccacataagaacttgtacaatgattttgagcggctcaaaattacatccacaagctattcaattgcctcacaatgattttgagcggctgtagttagcattttcataaaaagtacagatgaaagtgttctcctggtgaattgtgtccataaggctacacctttttgtgttgcatagtagtgatttgttaatttcttatctgaccgaactgaatcagaattctactaaagaatttcattaatttttttttgggtgccaaaaatgtatgcattctagatttttcatgccatttgtgcaaaaagcttcctcatttgtgaatatgcagtaactcataagcttcagaatagcattagttgtataagctttacttttagcaaataatgttaactatagcaatacatcaataatgtctgaactactcagagcaagctaccagtaatgacggatatagtgatatacagttatacactaacaatgaatggtaactctgcatccaacattagcgccacaacgagtgtattttttaacaaatcaatcacttcaagcttagatttctaccttacatgatgtcaaagctgcagtgaagttattaacaggtgattcatctttcacaaggctgaagtgcactaaatgaatgttaataatgtcaagtctggtaactatgtaagagcttcaggctcttctgctttggttatgtttccagttcaatgatcaaaagtccaaactaaataactcttagcacatactcacgacattaatccacatattgtgacaggtaatctatattttgtaacagataaattagctataggttaacaacagttacagcacagaaaagagctggtaaatagctaacctgctggaattcgaaccatcctgatgattattactaggtgatgctaactgtgattggcggccacccgttgcctcttgagttaatttctacagttctaggtttgggtgagggaacacgacaatattgcaaataacaagatataaaaaaataatcttgaaatctcacatcaatggatgggttgaaattcaggaatgacattcgaccctttgcagctccagggtgtggattaccctccatgataactacgctgaagaaagagttagtattggtttagtctgcattgacagatcaaagaaaggtattggtaatgaagtactgcgtgtccaaaactaaacccaaaaaatgaatttgcatgacaacatcaaatgcatgtttagctgattagtgtgaagcatatctgggaagaaaacgttaaaaaaaagtatccaattatggacatacacatgaatgttatagtttctgaagcacaaagtatcatttctactacctccgtcccacaaagacttcatttctagctatgaacttagacgagtacttgtccaggtgcatagccagaaatcccaaattctctgtaattaggtaagaagtaaattagatgggaggttttgccagatatctcatctaacaaacccaaaaaggcacaatcttcatctaacagattcagcttaactcaaacataatctccaattcttcatcgcaccttgttatatagcatacaaaacatcccatgctaccctagagtcaaaatctctaataccatgctaaaaacaccaactcagcataaacgattaaaaaaacgagcctttcaatccccataccacttccgagcgactttaaccgacgagccaacacctccgctaggcaccgtcaccacctcctcctccgcgcgccgccgccgccgcctcaaccttgggcttctcctcaaccttctgcgcaacagccgcccgctgcataaactgcatcccccccgcacacaaatacaaaaataaaaacatcagacgagatagcaacgcgtgcggatgtaataagaggcaacatttccaagggatttcctcctcgccttgaggttcctgagggtgctcgagagctcccgcttcgccgccatcgccaccttcctcctccgccgccgcctctgccgctgccgctgcttcgcttaccgatttagggttagggtttacgcggctcgcggaagccgtcgccgcggggaggaggcgcacgacgagaagagagagaggagaggagatcgggttcgagtcggactcgggcccatcaccacggcccggtgcgcgagtggcgtgcgggcccacatgtcagccagggaaggagaaccgcttgcctggctggtcctacctgcggtctgaccgacatgtgggcccggtatttgatgtggtggactcctacgcggtttattactgattcgtgtatacgagggcgattcgtataggcggtttatattggccctggatatctggaagcctcacctgaatacctgattttgatcttgttctattgatttgtcgtgtgttcttcgaattccatcggaagaagaagaggggatttgactaactcgatcggcagccaattaatttagtcgctgacttcatcagttcatcttaataatggtatgtcagtcaattgctctgaaatctttttaatccaagttgttgttttatccccttctcttccatcttttcgattctttggagcgcaaccaatctgtcattgttcttgcatatattaccatgctaattatgttcttgattcatgcatatactggagttgtttaggataccggttctgaacttctaatctaattgctggttcgttgaatgcgttgtgcaggatttcgaggagtatctcaacttgcaatcggcgacgttcgcgcagctgtaccgctgcttgccgatctcgcttctcaagaaggagaacgccgacgatggcaacaggggtaagttgctaattaacctgttattaatagtcagtagtcaatctatttttttttctaactgaatattacgaagttttgcttatgtttaatttgtttgcagtcttcatgcctgtatctgctcttgatcggctcggtaagttcctaacatcttcagtaaaaaaacgatctttccgtacatacttgatcatctggtaataaattagttggttaaattactgatgttattgcttgtggttaatttactttcaagggtatctgcacatcgagtacccgatgcagtttcagattcagaacgccaccacgctgcagacctcgtactgcggcgtgctcgagttcaccgccgacgagggcttcatccacatcccgaccatggttagtatactcttcatagaagaacatcaaattaactttgcccaaatacaaatttaatttaaacaactcttcagagcattaacataaactgatgctgatttatattttgttcctgaatattttcagatgatggagcacttgggcctgcgagagaacgatctcgtgctgctgcgaagcacgtcgatccccaaggccaccttcatcaagctgcagcctcacacctctgacttccacaagctttctgaaccaagatacctgtaagtaattctatcgaaagaagttttttttttctttagaaattaatctaaattgttcaccttttctaattcagattttttttactggaactaaaactcatagaacaacagttaggatcatcttctactgatggtaatattgacaaaataactttcaatactgactgaatacgatcattatgactaaattattgaaatttccgttcgaattttttgaaatttcaggccctctcggcaccgaactatttcgtccgaaattttcaattttttaatcaaaatttgatcaaattccataaaagttctgatcgaaatttcgatgccccgtcgtagatatgaacaacgaaattactaagcctggttattctttcctactataaagttaacttactaaattctaaagcttaacgtacagatatatcacattatcatccactaacaattattacatttaattatcataataaacattgctatattatctattattttattcgacattggttgacatatgttgtgttgatgtgcgtgtaggctggagtacaacttccgcaactacttctgccttacgaccggcgagacgatcgccgtggcggcgggggacaggttctactacctcgacgtcgtggagacgaggccggccgacgctgtctgcgtcatcgagaccgactgcgaggtcgagttcgaccaggccctcgaccaagcggagcccgccgccgccgccgccatgcaggtcgacggcgtcggcgccggcgagccggagccggcccggttcaccggcttcaggatgcggatggacggcaagccggtggaggaggagaagaagacgatgccgccgccggcgacggcggcggcgccgcccaaaagggggcttcggtttggctcgtcggctcctgccgccggtggtggcgtcaaggaggccaagtccggcgagaaagacgatgggaatcggttcaccggcaagaagtattctctgcagttttaaaagaacaaaaaatgggatttcttggtgcatcgatatttgaaaacgagagaatttgcatcgatgttgacgaattcgctgatattcgcgttcgcgaaaaaaaattcgctgatattcatacgatctcttttttttttttccttgtaagttttcgtaacgaggatcaaatatatgtgcatgtgtttgtgatgaaataggtacctgctcagtgacgtggctttcagattttgtttgctaatggtagagcagagtattgtgtccaactttccatggctatgttgttacttactatttctcttatcttatagcatcaatatgaatatgagaaatgctagaataaattgtatagtaaaattgagggagtatttgctactacacctaggaggaactccaggattttatattccactggcaaaagtgcccgtgcgttgcaacgggaagtgtatagaccagaaaataaaggaaaagttaagaaaaatttacattatgtagaaaggttatattccctcccttgtgtaaaaaattaatttacaagtaaagcaagtataataaataaaatgacaggttaaatttaattttattaaattctccatatttaattaagctctttagaattttattggaattttcagagcttaattgctaattttaataatacaaacctcatttaacaattatttaattggaaaaaggaatcaaaatcctccctttcaggtttgggccgaatatagaaagtttatattctctcccttacgtctattctatgtatctggcttgtttcctttctctgttaagtccattgcatcctcttgatatcgaccacacggtccattcggtggcccaataggccggcggcccgacgcgggagcagctggagctgtccgatcgaatggacggcccagattaatcctaacctaaataactacacccaaaacctaaccctaggattcattctcaccccctccccctcctttaccactctccctcccccgagcggcggcggctgcggcagcgcctctcgcccctcccttaagcggcggcgacggcgcctctccccgagcagcccccctccccgagcgacggcggcgccgcccgagcagcggcggcagtggcggcgcctctccccccgagcgacggcggcggcggtgccctccccctagcgacagcgccgctgcccgagcagtggcggcggtggcggtgcctctccccccgagtggtggcggtgtcagcgtcctcccccgcgagcggcgacggtggctctcccaccactggcagcgcggctgcgtcctccctcaccaccggcagcgcggctgcgtccttccccaccaccggcagcgcggcggcgtcctcccctaccaccggtggcagtggcggcgcccttccccatcaccagcaggcggcaacggtggcggcgcccaacccaatcccaagcaacggcgacggactcgatgtatttggagtttttggtcgatatatttggtgtttttgggtgttgaagtttgggtttctattttttttttcaattttttcgatcattcacaaaatcgaaatcagattaggatttgatggagggacgaaaaatacgaatcttttaattagttaagatagagaagagatatttacggactata

SEQ ID NO: 58357 - DNA, 3480 bp, Oryza sativa
  unsure (1)..(3480): unsure at all n locations
ggacgaaggaaacgtctcttattttttaagtagtagtagaagaagtagaggtagatagatagataccggtcaaaaacgaacgaatttaaaacccgatccatacacggatgacgtaccaaagtaccgacaaaaatatcctcaatttttcgagaagtctttttcgagggagtcggactttttttaaggagtcggacgttttttttcttttttaggtagaagtttttttcctttttttgtcgcctttattttctccacagggagtcggatttttaagagtcgaacgcctttttttttgcgacagattttttttctcttctttttttgtttttttctctcctttttattttccaccgggggagtcagacttttaggagtcggacttctttttttttcgtttttttatttaaacggtgttttttctcggacttttttttttccttttaacggatccgatctttttttttcaggggaatcggactctttttgttttgtttttttttcgctttttttatttattaaacggacgaaggaaacgtttcttttttttaagtagtagtagattataaaaagaacagctaggaagaactctgttgtcaaaatttgcttagcatatgtagtactccctccgatcattgacgcacaatgtttttacactaaaattagtattaaaaatctcatatattaatgacgagacagagtgacaccttactactctgcatagtaaaaaaaaaaccatccacaatgcaaatagcaaaaatttgaaatccgtgcaatttcatgccattgaaatcttgaatgaaatgatatgatagcacccttagggtccctttaaatcgcatgattgaaaaaacataataatagaaaaaacatagaattttgataggaatgtatatataaaacagatattgcaaaaacgcagggaaaacataagaagggtagtttgattgaactgaaaaaaaaaacgcaggaattgaataagagagatagacccaaagaaaagttaccaagatgttgaagctctttctaaatttcctccaaattctctataggattgtccatttcataggaatttcaaaggattagataggattcaatcatttgtttcaaagggcttcatagaaaattttttcataggatttaaatcctccaaaattcctatgttttccctctaaatcaaaggggctcttaatatcaaaataagttcattttttattcatccacccatactaattagaaaagactttctcaaatcccaaagcaattatttttctctttatttatttattctcaatacatttattttataattttacaaatttcgatgcaacgatcactttaaaaataaatttatttttgataaacaagaagaaccaaaaataaacatttattctggatagagagagtatgtgcctcatgttgaattacgagtagaatgcagggggttttgcgttaatatccctctcctcttctcccctccccctctcaaagcaccgcgagctcgcgacgaggacgacgcagcgagacgagacgacaaaatttaccaaagtgcccctcaaacccctcaccccctccgcctccgcctccggcgagcccgtcgccgccggccggcatgccgtcggggtaccgcccggaccgggagaccgacttcgccggcttcccgagcaccacccccatcgtcatcgacaacggcgcctccaccttccgcatcgggtacgacctcccacccgccgccgcccggaaactccccccccccccaaaccctaaccctagcagggcttccgttccgtacgtggattctgtgaagtgacgtggtggtttggtgccgtgcaggtgggccggcgaggcggagccccgcgtcgccttccgcaacatcgtgcagcggccgcgccaccgcagctctggtacgccgcattgcgcgctttggaaagcttggctgtgatatctgtttggtgattggggtttttctttggatatactgcgagaagtttgatttctgcttcttccgttaatccttagcgtgcgttttcagaatgttcagtgaataggtatggcgtttcgttggtaattgggtgctgtttgtgtaatttgttttgttttgatgcacagaaattgggtgctgcattttaattatgtctatcagcagccacttattaggcccattttgaaactctactcaattcaagtgggagttgaactgttacttgtcagattccaatgggctttatttatttttatcgtttgcgatgttttgatacaacttgattcattttcttcgtaagtgatactagtaattctgaaaacagatcaagttcagatgttttagtgctctctttgtgtttgttcaattacactgtatggttcatgcttgtctgaatataccattactgaactgaacctcttatgggtatggcttgagtcaggctaataataacagagtttgacaaaatatgataattcaactgattggaattcgttttctgtgatgcaggtgaaactgtcacagttgttggggacactgatccagctttgatgaagtatttcgattgcacacgatcagcaattcgctcaccatttgatgatgatgttgtctaccagttcgagtacatggaatatgttagtttgcttagttattcctatgaaaccatcttaactttttttttgtttgagttggtagcaagatctatagatggtttgctatatgtttagcttgaactgatcagtctggtctgtcatctttgattcaggatgcaatcttaatgtgtgtgttaatttttaggctcaccagaataatgcatatgaaacattttaagaataagatacgtgtcttaactgtggttgagatgtatattaactgatattaagaaaagctttatctgaagttagaaattcatattctaacttgcttctatgagtatgctctattctatagctattaatgataatatctttcatagttcacatatcctttatgacattagataccaatacatattgttatgtttcacaaatttagagtgcagcacatgattgcttacttcagagtgttgatatttgcactccaacctttattgcttgtgtaacaaacattttttaagtatttctttgatctggtattattactgtctgggttgcagattcttgactttggttttgatcaactaggtgccacttcagaggtaaattgcactctgccatcatctgtactatgaatatattctgaatgtagttgacttatgtactgtttccttggtttgacagctttgctttaccttgcactagtaaatgtggggtagtccctctcaaataaaaatgatgaaatttgggggttcttttgtatgccagttctatgtataagtgaagtgtgtgcaatgattgggactatgtagtgtttattaaaacttgaatttagcatgnnnnnnnnnnnnnnnnnnnnnnnnnnnnnnnnnnnnnnnnnnnnnnnnnnnnnnnnnnnnnnnnnnn

SEQ ID NO: 58358 - DNA, 1795 bp, Oryza sativa
  unsure (1)..(1795): unsure at all n locations
taccttgcactagtaaatgtggggtagtccctctcaaataaaaatgatgaaatttgggggttcttttgtatgccagttctatgtataagtgaagtgtgtgcaatgattgggactatgtagtgtttattaaaacttgaatttagcatgtgagttctaaaatggtcagttggtttcgggttcagaattaagtttcttatgaatatattgcatagtgacacagttgacgttcacaagttgaacgtaatgcttcaaagtctttgggaaactttagtatcaggctctcagcctctaaaacaggcaagttaaatgacaagtgaatgtcatattcagcatatccatcctagacatatgacagacatggacaattatcttcatcagtgagctttctcctctcaagtgtatggtgggtgacagtgaaaaaataacccaggcatagcaggcatttctgaacagatttttctcattagtatcatatagttctaatagaaagtgttatgtgcctttggttatatagtaatatatttgtatgcatccttttaccttagaattttctggttcccacatgagctatttgtttggtttcatgctgctggaagtaacagtaatgctgggcaggtgggccatcccattcttatgacagagtgtgaatgcaatccatccttttctcgagccagaatgtcagaactactttttgagacatatggcgtgccatccattggtaatgatacttatctttttgtgccattgttatcaattgtgcatggtagttttgaagtaagaattgtcgatgctaaagatgtttcttcctatgtgagtttcagcttttggcattgacgatgtgtttagttacaagtacaatcagaaacttgggaattgtggagaagatggactggccatttcgtgtgaacatggaacatgccatgttgttccagtaagtttggtccttccacatgccttcctcttaactttgtgcaacatacaaatcctttgccattgcatttccattaccttgtcagatgttcggaaaattaatgcattgcatgcttgaagaacacagtattgttgaatgcattgtagattctaaaactctgattggataatctgtagtgggtaatgctatataacatgctcatggaaagagagagagagagaaagagtgcccctattcttagctaaatcattttgctcatggaagtcgggatgtattttcttgatctccagacacagcatgttgttttctttccatctaatctatgatgcttccggacaactacattggtaaaagttgctttgtattttgagccctgtgtgtttgaatttctgcttacttttccatggtaggctgcatactaactcatccaatccaagttagactattcttctctgtagtgtatttttcacaatttgtttattgttgtcatgatcctgaaacaatcaataaacaaaaatattatgttgtactcatcaaagtggttctgtgaaataaaatcttctttctttgtccacatatgcattctgattaatgctttgctgtgtatatgcattcagtttttaaagggagaacctgtgttgggggcatgctgcagaaccaacgttggtggctttcacatcacagattttctgaggcagctcctctctctaaagtatccctatcacaggtaggtgcccgcagcatatttctgaagtgctccatgcatttttttttcctaccatgtctaatcgttgccactttacatnnnnnnnnnnnnnnnnnnnnnnnnnnnnnnnnnnnnnnnnnnnnnnnnnnnnnnnnnnn

SEQ ID NO: 58359 - DNA, 1705 bp, Oryza sativa
  unsure (1)..(1705): unsure at all n locations
ggtcaacgtttgcgagatatggctgctgcaaaaaggtcgcagaagatagcagaacttgaaaaacagctttcttatttggaggaactaatggagcaacttgatggagctgaggaagaagaagcaacagccattttaggtagatctgggtatctttcccagcaggaaatcaaatctgctattttgaaagcaacacaatccttaaggaaggcaaagggggagtccaatggtaacgaagagaaagcagatgcttctggggttgataagtatccacttgtgtctgtccctgatgaaacattgacaccagaacaggtgtgtgtctgtccatttatcatctgtagcaaaggggtttgtttttgcttgtgttttggggagaccttttgcgactgtgtgacatgagcacatatctattataccaagtttagatattttccatgtttcaaatatttactattcttatttcactttcgtatactttcagttaaaagagaagaagaaacagatactacttaaaaccacaacagaaggtcgaatgcgtgccaagcagagacgtgctgaggaggaagcattgagggagaagcaagaagaagagaggcgtttgtaagttgcgatgtccccagtctgaaatttatcattcatacggccgtcataattagtttatctgcattcagcttaagatcctcttttttgaaattttaagtacactgggttagttaaccagttatttcagagccatctttttagtttttgttcttgtgatacgcttcgtgctgatataagccctggaaatcaagcatgcattctgcaattccaaacaatgttcaatttactattctattatcctcatatcaatgaaatatacactctatgaaaagggataaatttttctcgaatctgtcataaatatttgccatgcgctctatacgctgcttttatgatatgttttactttaatatccagggagaacccagagttataccttgaagagctccgtgctcgatactcggaactttctgatagggttgatcagaggaagcgacagaaactcaatggtggtaagaccaatggtaatcataattcatctggtggagtaggccgtggggaacgtcttaatgccgcccagaaagaaaggatgcggttgctcacatctgctgcatttgatcgggggaagggcgaggacacttttggtacgagagatgaagattggttagtctacaaaaagatgagcaaagataatgacgacgacgacgatgggaacgatgatgatgaatcagaacttgctcgaattgcttctaagatccaggtaagatctcacgttcaagcaatcttgcttgtgagccgtgatggccattttgtcttacttagatctcacacctcaatagtttcttttacaatcataaactatttgatgcttccatgtgcaggatatggaccctacatttgtgaacaaagctgaagctgtccaacagactcctgagcctcctaaggtccggactcttacagcagaagattacaggatttccatagggatcgagcggttccggtgccctgaaatattgttccagcctggtatgataggaattgaccaggctggtatcgatgagatggtcagcatctcacttaggcgactaatggaagannnnnnnnnnnnnnnnnnnnnnnnnnnnnnnnnnnnnnnnnnnnnnnnnnnnnnnnnnnnnnnnnnnnn

SEQ ID NO: 58360 - DNA, 1324 bp, Oryza sativa
ggtgaatagccaaagtggtcctgcaagttttatctgaggctcagtttagtccttgatgtttcaatctatccatattagtccttcaagttttcattttagttcaaacttatccttgaaccaacaactctcttcataaatgacacttatacccctcatcattcacatatataagagagaaattgcatgcttgaattttttatagataatacatagtatattatgtaaaacgaaaaaaattatgtactagcaagtgtatacgatagcaattgcttaagtttcatgtgcacatgttgaaataatgggaagtagatctgtaatgttgtttattcatgttggctttctattttctagtgtatagatgtatataaattatgggcaaaaaggacattttctaatagaaatattgactagaaatagccatatggcatattaagtggacccaagaatgatttcaagctaaaacaaatatttgaaggatctatatagacaaaatgaaacgtgaaggatcaaattaagccttcactgaaacttgagggactaaattagctattcaccctaaaaaaattatatatataggcgcgtgcgctcttatactatatatacatgtgtatatactcttatagaggagaaggtgaactagagggtttggaactgaccgcgcgggtgcaaccccgtgcaactgttcacctatcagggtcgtcagtacgggctccattcgacctttctcaccgacacggttggatggtgcacgggttcgtcacaaaatcaaagatatggacatttgcgtggttaatcattcaaaatagggtttggatggcggaccgactagcgacccggggctgacagaagaatggagtttgctcgctatgtcggcacaccgacgagattactatacacctgttggtggaatgcaatgcagatacaccaagaaaatatgggatgccattgccagttggataacctgtgcatccatggcgccggtaagctggacacaatcgaccacggttcatgaatggtgggaatttcttgccacatgccacactgtaccaaaacttggaattatatccttaatcctcctaatctcctgggaaatttggaacgagtgaaaccgacaaatcttccgaaacaaagagttaagcactgcgacctcatcgcaaagataaaggatgaggcaaaagcttgggctacggcgggaagccaaacgctcagcagagatgttgccttagtgcccggtcgccgggggaaatattacttttctccttacatgtaaatattgctcccttctttattcagtgaaatggcaagctctgccgttgttttaaaa

SEQ ID NO: 58361 - DNA, 1328 bp, Oryza sativa
  unsure (1)..(1328): unsure at all n locations
nnnnnnnnnnnnnnnnnnnnnnnnnnnnnnnnnnnnnnnnnnnnnnnnnnnnnnnnnnnnnnnnnnttttaaattcaccactcaaatttaccttgggtttttaagcaaaaaaaaaaactttactgccactaccgtgatacttcctgcatcccaaaatatacatatttctagcacagtacattatttcaaaatgaaactatttcttcacatacgttctcctctcaaccaatcatcactattctcctttacctacttttacttatcaaccaatcacacatttcctccgattattctcacctattttttattaataaccgtaccaacctaaaaaaaatgtctacattttgggataagggaaacaatttggcaaaaagatctatgagcactcatctgtaaaaataaataattcattagggtgtaatttgtaaattgtcttgagtctttacgaacaaatccctatcctgcataccgccatcgtctctttctcgtcgtcgccggcgacgcctcccgccgccgccgaggatgccagtgagggtggtcgacaccgcaaccccatcctcccagcccacctcaggttcgtccacctccttccccactaccttctctatgctatgcacccacccctaattttgctgtgtaatccaagctttagatctgatcatctgatagagtctaatcaggtatcaggtagcttgtggggtttgatatagtgcgattttaaggtttaatctagattggtctgagttgtactgagggtatctgtgttgatccttttggaatatactcaattttttataattttggccactcacgctatgcgttatttggggagagctcggatggttttgtagctaagctgacaactaattgtaatgtattgtatatttttgaggcgttgctatgcttgtggctttgtgtcaagtgttcttctgtttcaggaggccttctatataaaccaattgttgattttgttcacctgcaattgaaatttcattagttattttgtatgtatttctggaaatagatagcccgccgtgccaatgtgccatactgattaaaatgctgcaggtcaagatgcaaatgctgggcatccgtctcctcctagctgttccctcttaagtgctggaagagtaagtctttttgtgctgttatttggaacttgaccaaggatcgaatcttcttatcggtgttgtttatggaactgaccagaccatatgcttgtaccattctttcagtgttatgctggaacccagaatgtctctactatacaaaaagaagaagcttggaaagttaatgtgcggggtaccgagctcgaattcgccctatag

SEQ ID NO: 58362 - DNA, 827 bp, Oryza sativa
aataatatagccaactactatctccaattcatctatagtcaatataatagctcattcatacaatagttacatactacactattaatacttggtctcacctgtcatactcacactgtgtcttggagtccgtgctgcagctggctacaaatctgtagcctgctacccttctctctctacatttatctacttaaaatatgtttgcagctggcttagggcacccacaatagttatctataagctctctacaaaagatccatgtcagcatatttttctacttggaagagattaaatgaagcgagagagcaaagctatctactaacatggagatagtctatagagaaaaacgaggcaatggattagagagctatagatacccatgtagatatactattgaaatggtttactattaatctagtctattgctgagatgtacatattttatagatagcaccttactttactattgcgggtgctcttatagcctgctattgtacctgctctaagagatagaaatgatgttgactaaatggtcaaatgtaatgcgaatccgtgacacgagtttgaccatttggtttcctgggcaggaatgaaatggaaatactgggtgctaatcagttggcataataatccagagagttgcacgatggagcattcgttagtgttaggtacactaaaatttcagatatagctaccaaatttcctgtgttgaccattgacaattttccagacctatttgaccattgactagtaataacatgtactagtagtaagtactttcagcccagtgggttgggccggaaggtaccgagctcgaattcgccctatag

SEQ ID NO: 58363 - DNA, 1174 bp, Oryza sativa
tatatatggacggcatggtactggaccccggacctcctagaacataaagtggtcctaactcatctaaaatggtcatagcacatacctgtaataacaacaaaagtggtcctaactcatctacctggtcgcgggacgtgttgtaacaaaaaaatacggcatggtactggatctcctcgaacagaacaaaaaaaaaagtgagaaagaaatcacattgagcacatggcatcgcggcgccaaatctactcccactgacacagcgggaccagagaccagaggccagaggccctaatcgtccgctagtggaaggaaattgctggtagtagtattgacgacgtctttatcaacgaagcttcgtgccaacccgctcttccttctccagtttgcttcaacccgattatttcccgtcgggcgtcgggccgtcggctacacgttggggacgccatttcaccggcttttttttttttttttgcggggggcatttcaccggcttttgtgtcagttggagcaaattcaacccagaaatcaatgaagcttcattctagaggtgatgcctaggcaaataagacaaaacagtttactaaagaataaaaattaatttataggtaaaatttttactgcctttattctaaaatatgtatagctgtcagttaccgtgtccaatgtttgaccatccgttttatttgaaaaatattgatgattagtatttttattgttattagatgataaaacatgtataatattttatatgtgaccaatttttttaaataagatagacggtcaaatattggacacggaaaccaacaattacgcttatattgggacagaggtagtatatatttatttgtaacaacctaaaactcaacgctaaaggcttggttttaagagctttcttcggatagcactacggctcggacgttcgatatctcaccaaatatcggacgcccagccaaacaccgagcgtatgtgcatgtgcatgttgccgcactttattcttcactcctcaatcatgaagaatcttctcatctgacgtcccatgtcctaaagaaaattggttggtcaaatgttctagttgaccattgagtgaaacatcaaattatatatggtgaaacaaaaaatcagcaactgaaacatttaaaaattttatgaaacatgatgaagatatacgttgaaacat

SEQ ID NO: 58364 - DNA, 3484 bp, Oryza sativa
  unsure (1)..(3484): unsure at all n locations
nnnnnnnnnnnnnnnnnnnnnnnnnnnnnnnnnnnnnnnnnnnnnnnnnnnnncccgttccctcaaaaaaaaaaaaggggcggactaaggcttatttatatgccagtaaatcggtaatatggcgatgcagaggctgaacggtaggcgtgaaaaagtacactcacttgagacaactgtcgctaatccgagtactcgatcaatagggggagaaatagattttgtaaatcaccaatcagaaaaaacaacattccgagtagcaattctaaggcttacggaccttaagaaatgtgtaatacagcttagaaaccataagtttgtgttccttgcaattttatcgaattgtaaagagggatccaaactgcgggtgatgcacaacaaaacatagttctgaacataagttaggaagaacatggtacgaaaagatttcactagtcatcgtccttgattcttttcagcagcctagcggcccaccggcgtagtcttctcttcagtgtgaagcccaccacgacaccgactgcgaagctgacggcgctgatcttcgtgcaagttgatagagagacaacacgaccgcaatcccatatggatcatgaaaaacaaaagcttccacaaatctgttgcaataccacccacagccgcgacggctacgggcaaacggctcgccggcgcaggttggcggcgaggggaagatggcagcggaggacggattccggcgacggtgatcaggttgtgaccgagaaaattttggcgcgccgtttcaattcacgcttcacgcgcgaattgagaggcaagcggatgagttagggcgcagaagctgcgagacagagatacttggagtgggtgggcagggcgaaggcgaagtcgccggcgccatggccgtggccctcggccgccgcagccgcaaatccgcgacccttaccctctcctcctccactaatattactcctactcctatcctacgtggcatgtgtggggtccactcatacaaccaaacattatagtagtaattcaatcagaatcttgattaaacatagatacaaaattcactaaaagaacccttttgacagcggctatcttcccaagggagaacaaggaggcgggccggccgtacggtgcggcgtgcggcgtggacgtacggacgccacaccgtcgccggagcggtagacaccccgccggcagcggcgaggaagtggacgttggattggtgatcacgagtgctccaaaattccaaatactccctaaattagataatttctacaattagttgatttgccttttctatatggacttaaaacttgcatcatcacatgttccatcggtccaagcattgatcaactaacacaacagctagcacagcagcaagcggtggaggaaacgaagtgatcgatttattgtagatatataggcgaggtgatacacaaaagctcgatcagtgacccaaacagcaagaaaggagcattacacaactgaaacaagtaagatcgatatagatacattcgcgccgatctagggagaagctggcgcgggaggcggcgatgtcggtgtagttgaacgaacctaggtgtaattaccagagcagagccgctccggtgaggccgacggcgacgacgagcggcgcgatggaggcgatcatgatcttcttgccgacggcggcacggcgaccgcgtgggtcgtcggagacccagatggccgcgccaacctggcccattccggcgaggaaggaacccacaagagcgaggtggtagtaggtgttaccaccgtaggccggcggtgggtcgcacgcggcggccaggttgatgatcagagagaccgtggcgacgccgaacagccccagcgccgccgcgatcttggaagaagcagcgccgtcgacctccgcttcccggcgagcaatgtcagccatcacctgtgatgtatggatcttcctattattcagaatcaaataaatctaggaaattgagaaggttggagcttggcaattagcagagatgctagaaagatcaagctagagaggagtgttgtgcctgcgtgccttcagttttgccctggtttatatagcggaggggaggtgaggagagatgacgggcatgtggcattctgtcccctgtcgttttctcagtctcatatcttttgactgtcgaatggtctcgctcgtttcttatgtaagaaccggataaaaatttagatactcgtggcacgttttttaaactgttgaacggtacgtttcgtacgaaaactttatatatgaaggttgttctaaaatattaaattaatcaattttttaagtttgtaataattaaaacacaattaatcatacgttatcaacaccttattttatgtgaaacacttaatatttatcttcatttcatcttctatccctacgagcggtttgtttctatctgggaatgatgtcatcggtttgtttctatctgggaatgatgtcattcagatggtacagacttccggacgtttcagatggtttttacataggagatcgtggttagtaccatagaaattgatagcgataggagcaccatattgactgggagactttcctcgaaaaaaggatatcttttataacagcgtgtgatgaattttcacatttcctcaaaaaaaaaaccgcactggactacgattggtgactaatatgttccacatttctctatccccgtcttgatcttttggctaatactccctctatcccaaaatatttgacgccgttgacttttttaaaaatgtttgaccgttcgttttattcaaaaaatttaagtaattattaattctttttctatcatttgatttattgttaaatatacttttatgtatacatatagttttacacatttcacaaaagtttttgaataaaacgaatggtcaaacatgtttaaaaaagtcaacggtgtctaacatttagagaatgagggagtacttccttttatcattttgttgtctttccctatcgccatctttccacctttttctattaattgtccccattgagggacctagctagcgtgtggatcgcttgatacatcccatcgccatctttccatctttttctattaattgtccctattgagggaccttagctagtgtgtggatcgcttgatacatcccagggtcaatttttcatcacaggaatcaaaagtatatgcagttgttgctgtggtgcagtggacctgctaattttgcccgttaaaatttcttcccgtcttcatgtatgatctctcagctgattggtcgagatgaaaaagtgatgacgtcaccaacgtgtcatgctaccagtggtggacgaaacgagttgagagaaccgaagtaaaataaatatagaaaaaaatacccgtgcattgcaacggaaaaaaacatgagaaatttacgtaaaggttaagaaatatttatattatgtaattaatttaaatataaaatcgcaactatnnnnnnnnnnnnnnnnnnnnnnnnnnnnnnnnnnnnnnnnnnnnnnnnnnnnnnn

SEQ ID NO: 58365 - DNA, 1698 bp, Oryza sativa
  unsure (1)..(1698): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttggatgaaccacacttagggttgaaaacggagcagatagtttctgtccgctccggaggaaaacgaaaacggatacctctcggatcggatatttctcggatagttcggatacggatacgaatacggatattttcttccggatgcgaatacaaatatggtatcggggtttccgtcggatacggataataattcggatgtccggtgaacagtgctattcagatatccgcagaagccatgagacatacctcatttctttataactttatgaccttcaatatacctttttacattttaatagtagttcatctcttaaatctagtccacactattaatattatttaaattttaaaaaatatttataaattatactatattttatataaaatgagctaactatatatgttgatatttttttatattagaagttaagttggttttcgtgttccgaaaaaaaattgttttcgtattcgggtccgatcatattcgatacttatttgtattcgagataatccgtatttgtttccgtattcgagctatccgtattcatttccatatccagcaaaaaatatgaaaacgaatatggtatgagcattatccgtccgtatccgctccgttttcatccctaaccacactgggctgcaatgtcaaaaaaggaaaaaccacactggactgcgattggttttttttttaaaaaataataattcacccgggagggggagtttccccacctgtattcatttgaaaagggagagtccaaagggtttagatcgtgaggattgctcccatccagcaggtaccacggtactagcccagttccaaatctcagccattcattcagctcgatcggacggtggaaattatgcggtaactcagtacatatttgcccatgaggtggtaccagaatagttagaggggtggaagggtaatgttgtcttttcacgtagggatgcgttttgagtggtgaaactagggtttttacaatccatctcgattcagctctgatccgtgagaggtggcggcggtgctggacgggagcaacgctcggaggacagcggcgaggtggtccttgggaggtggcggcggctgatccgtaggcggcggcggcgaagtgggcggtggcgacagctgattcgtgggaggcggcgagtaggtggtccatgggaggcggcgaggaggtggtggctggtccgcgggctgcggtggtgaggtggtgttggcggcggtgtccggtgcttgggcccgtgtccgcgaggtggcggcggcgatggcgtcggcagcaggtggttcgtggcgggcatccttcttcaacctctggttattctgtagcactgcccacagctcaagcactcaactgttatgttgagaaaacgaaggcagaagagagaaaatgaagctagagctggaaatggctgaccggctttcagacatggaaaattcattcaagaagttgtccaagcagaaaaaagnnnnnnnnnnnnnnnnnnnnnnnnnnnnnnnnnnnnnnnnnnnnnnnnnnnnnnn

SEQ ID NO: 58366 - DNA, 821 bp, Oryza sativa
catgctagcaatggtgttgtttttttcttgcacaattttcatctcaagtcccaacgactatttatttaattcgttattaaggaaaaaattgatggatgctttatctagacctctatgtacactaatatcaaacaaatctaagctatagataaattagaattagattggcctaatatcaattgggcgtggcaaagacgcgccattatttctagtactcatgttaacctgtgcaaagctgacaaccattatggttgggaataagttcactttaggtccctaaatttgtacctagtctgattttcatcctcagtatagaaaatcggatacaacgcatccctcaacttacaaaaccgtgcagaaaaggtccctcagcagtattatgcccggttttaaacgatgtggcgcctacgtggctccctttgactaggtcctcgtcccacgtggcattgacgtggcgctcatgtggcaattggatcccgggaaaataataaaaaaccgtgggacccacatgtcagccacataaaaacaataagaaaaggtggggcccatgtggtcccacatgtcagccccctctcctctctatccccccccactctctcggtctcgtacagaacggcgagcggtggtgcagaggggagcggtgggcggacgacggcaggcgacggacgaggaaggaggcggcgggtggccaggcgaggagggaggcggcgcggcggccggaagaggaaggaggcgacacgcggcggccggcaaggagggccggtgcgcggcggctgggcatcccgggcggagcggccgacggcgtggagctgccgcgctcg

SEQ ID NO: 58367 - DNA, 3568 bp, Oryza sativa
  unsure (1)..(3568): unsure at all n locations
nnnnnnnnnnnnnnnnnnnnnnnnnnnnnnnnnnnnnnagttcaagtaggaatacaattttgaaaaactgaaattgaaaacaaaaataaaaaattaaaagaacccaaacgatagtagttaaaattcgaaaaataagtaaataaaatctgaaattagaaaaaggaaaataagatttcaactaggaatacaatttatatataactaaaattggtgtaaaaaataaagactattaaaagaaaagaccatctaaaacacatgacgagattaattaagtaacagacttataaaggagtagagtggtggcggttgatgggacatctaaaaactattaataaaacaccaaatagaatactaaagatgattaaaaggaaggacgataggcaggtcatgaaacaatcggtcaaggcggttgccgggacttttagaaagtaaaagaaaaaccaatgataatcatatttgatttttaaaatctcaatgacaataaaaattagaggcaatgggcagatcgtataggagtacaatggcagtgccgtcgatggttggtgggacttctagaaagtaaaaaatgaattccaacgatagttatgttcaactttgacaatcctaatgataataaagagtaggcggcggatgggtcatagaggagtatagtggcagcgtttgacgggatttctcaaattatataaaatgaaacccaacgagacaataaactctaaaaactataatgtccaatttttaaaggttcgagcttctaaaaagtgaaaagataaacaccaacgataatcatttttattttaaaatctcaatgataataacaaagggaggcagcaggcgagtcgcagaggagtacagtgacaaagtcgctgacgttttagcggaacttctaaaaagtaaaaaaaataaacctaaacgataattatgtttgatttttaaaatatcaatgaaaagagaagaggcagtggacgaccatagaggagtataatggtagtatttgacgggacttctagaaattataaaaacgaaaccaaataggacaataaactctaaaaactataagatcaaaattttaaaggttccaagaagaatgaatagaaacagtagtagaccgagcaagcaaataaataaggatatgacagaagtaaggggtagtagttggtgtaactttttaaaactataaaattagaattacaaggatggtaaggtttggtatttcaaaatcttaagacaacgagataactaattaataaattttaagtaaagtcatattaaaaatatatataattttgtatgggtgctagccacgcaattgtatttttatatggactctatactctacttctaatattccttatttttaattctgaatttctattgtttcctaattgtatttctatatggactctatactctacttctaatattccttatttttaattttgaatttcagttatttcctaattgtatttctatatggactctagtctcttcttctaatatttcttatatttttaattccgaatttcaattatttctaaattgtatttctatatgaactctagtggcaagctgcgatactacgccggaaggaaggatgccgaggcgaggaggaaacggaagatttcgccatgttttgcccgcctccgcccacgcgtcccttgttgccacgcactacccgagtactccgcctatttaggccccaccaccaccaccaccccccaactctccccctccgacggcgtccaccacccgaccacctcccgcaccgtataatcgctgatcatggtgaacgttgctcgcttggatcaggccgacggcgcagtcggcgctgcgtccaagatcgccgcggcgcgcgcgctgggggcgttcggcctcgccacagcctctctggccatcaatctggccgcgacacgggggccaccgtcgtgctttggtgacagcgccttactaccacctcgctctcgtgggatccttcctctccggagtggcacaggtggcggccgccgtctgggtcgccgacgaccctcgcggccgccatgccgtcggcaagaaaatcatgtacgcctctattgcacccctcctcgtcgccgccggcctcaccggagcggctctgctctggtaatcccattccaccttggttcatctacacgtaccaacaccgacatcgccgccgccgcctcctaccgcgccagcttctccctggataggcgcgaatgtatcttctcttatatgtatcttacttgtttcagttgtgtgatgctgctttcttgctgtttgctgtttgggtcattattctaccatcaatcgatcacgctgtttccctccatttcctgatgctgttgtgttattgatcagtgctcgtattgatgaatatgagatgaaagtttgagtccccaaatcaaccccaaaaaaatcagctcatttacagaagagtgtatttggaattttggagtaccccgcgaattgcgaagccggcggaggcgcgccgaccggcgattatggtgttcgtgatcaccaattcgacatccacttcgtcgctgccgctggcggggctccggcgacggtgcgcaccgtacggccggcccgccgccgccttgttctcccttgggaagaagtagccgctgtcatgtgatggccaaaaggattctttttgtgatttttctatccagtttttaatcaaagattatgattgaattgtttggattttggaggaaaggtggggcatattaagtggaccccacatgccacataggagggtatgaggattagtggaggaggagacatcacagggtcgcggtctcgcggacttgcgactgcggcggcccgagagggccacggccatggcgacttcgcctttgccctcgccctcgccctgcacactccaaaaaagtctccgtctcgctgctccgtcttcctaactacatccgcttgcctcctctctgcctcaattcgctaaatcttgtcgccggaattttgctcggccacgatccgatcactgtcgccggaagccgtcctccggccaccccctcgccgtgaaactgcgccggcggatcttggccaggatctggtcggcatcgcggatgcggtattaattgcaacagatttgtggatgctatgatggccgtgcgccgttcagctgttgacttgtaagaacaccgcagccacctcttctgatttgagtggttcatacaggtatcgtgacttcctcaaaaattttatgcaaatatgaaaatatttatgtcatgcttaaagaatatttgatgatgaatcaagtcacgataaaataaataataattacataaattttttgaataagacgaatggtcaaacgttggataaaaagttaacggcgtcatacattaaaatatggagggagtatattgaggagcccaacttttgtatatttgccattgtctgtatttttcacatgtgggagactggtgagtatgacagttttcctggcatgtcatgtaataatcggaattcggaagatttgttattaggagagggatgctcaatctcctttctaatattaggcttttacccgtgtttgtgtgcaatcttcagcctt

SEQ ID NO: 58368 - DNA, 4013 bp, Oryza sativa
catgtcatgtaataatcggaattcggaagatttgttattaggagagggatgctcaatctcctttctaatattaggcttttaccgttgtttgtgtgcaatcttcagcctttttcagactagttataaccataccattttgtatatcaaaatttatgactaaattgcactaaatattcgtgatttagtgcattgtgatgctgtgactgaatctgaaaatttggcagcgagaatgaatatcaagtaatgttgtgcatatccccgcagcctggacatgatccaactatcacagtgagctcggcccaactaaacttgggctgacttgggcagctatccatattttcatgggttgacttgggcttacaaatttctcccaaaacgatgcccaaagctttaatgggccataaagtggcgatccagttgagcacgaataaatcgcgtggttgaggttcggagtttaattcgccaacccctgtctatgcaaaacttttccattgtttgtttcaaaaaaaaaaaaaacatttccattgtttggaggcaataagaagagctccatgatacaaatgatttcatctgagcacgtaaggttgcttctacataaggttttgttcccatcacactatctcacgaaagcaaattcaagctgatataaaacttcatttgctgaaaacatctgaaaaatgtaagcgtggtactgcaggtctgcacctgccatcggccatattcgaatgaacgcattgcagttgtaatcctcggcgatgttgttgtatgcatgatctgccgtggtgatattaatggtttcttctaccttatctatgatgttcagcacagcagcagtcaacagttgatgacggagatgatgaagcctcccctagccgtcgccacccactagagctcagctatctcggggccttacaggagagagagaaaactgtggtggcggccgtgttttttttttaccttttccacatgactaatatgagggccctatggtttttctgatttcttcctagaatatataattatcacgtaaacgtcacgtcagtatgtgtgtggaccgagtcaaaatgataagttaaacaaaaccgctcaaaaagaccaccgagagagagttgatttgtactgattttgataattagggaatgcttttatactcagttttgtaattgagggatactaatcgatcacagcatataagtcgagggatgcaaacacacttatgcccatcgttgtggtcatatatattgcgctctcttgatacttaataaacacgttagtttcttaattatttcgttggcaactttttgtgacaagtcgacaaacatgattgtaacatctaaacgtcttgcggtgatatagagtcaccaatcacctcgatttagccaaactttagcagttttcccctatttcatccctaggtgctaaatttaggtgtaaatacatttgtcatgaattataaaacccactaagaacataaatgctcttggaacttgaaagaaagaataccacttggctctttttttcgcccccatgtagttaagctggcaattaatcgtcttttttgttcgtacttcatttgaaataatgtgtaggatcaacaaaacacacatacataagataaattcatttatccagacagtaattgacaacatgacgctgatacacacaccgagactgaatcgacaaacgcaacctgcaggtgctaggcatgcaccgtgaattattgtctgcataatatttggctctggtcgatcgatcgatggccgggcgatgagatatgctatatttatatggggcaactgaatgaacaatctagccagctctgtcgtcaataagccacgcttacctatcaaagcacggcgagcgcgctgacggcgacgacgagcgaggcgacagaggcgtagacgaagaaccagttgccggcggcgccggcacggcgggggtcgtcggagacccagacgaaagcgataacctgggccacgccggcgaggaaggtcaccactgcaagtgcaagtgcaaggtaggagtaataggcagcgccgttattacccaagtcagcttgcagcggcgtggtggtggtagccaaggtgattgccgcggaaatggtggctaagccgagcacccacagcgccgcgtccacgttggcctccgcttcgtcccgccgagtaacagccaccaccatatcttgattaatttcgaagactaatttgagatcgaagctagaattaaggcccaaagaaataaatactagagtttgcttctatcaaatttgctagagtttcccccttcttcaagtattgcatcgatcttcctcgaagagatatgtatatatataatcacgtattactactagctgccatgagttttctgtgggtcgtcgttgcacaaaatcacggtgcgtttgactgactcggtatcggggtgtacccgggctctactcgactcatctgaccgacacggcggggcccaccagacgtgggcccgcttgtcattcggatggtgcataacatacaccgcagcgacaccggcggttgggacatgaagacagctgcgtataggcgtcgtgagtggtgtttctgtggacggggaggggtggaggtttactgtacagctagcatccgctaagggcaggtacgcggcgaaacgcagcctgcagatattttatgtacttcgttgggcagacaggatcgagtaggaccgtatgcagtgacgcagccaaaaagaaccgccttcggccgcgttcagactgctcatctcatatgtatagttggaccggaacggaggctatgtttagattccaatttttttctttaaacttttaacttttctgtcatatcgaacttttctacatacataaattttcaacttttccgttacatcgttccaattttagcgtggaactaaacacagccggagtgtcggagtcaccaattaaccacgtgaagcccataataatttggccacgttagggatcgcaatatacatgttagggtgaatcagggctgcggtccaatatcgcgtgaacagtcgagggttccattttccccaaattctagtggcacgcaggctatatcgtaaattgtaatggtatttatctaaaatgattaacccagacaaaaacatttagttgggctagaatggatctagttgcaaactacgtggaccccataaggaataagttcacttgaggtccattaactttacactgaatttaatttttatccttgaaccgaaaaaccagatataacaggtccctaacttacaaaaccagtgcaaacgagtttcctcggcagtattgtcctcgattttagctgacgcggcgcctacgtggctcttttgactaggtcttcgttccacatgacggtaatgtggcagtatgcacctaaataaaaaaataaaagtgggcccacatgttagttacatcataagattaaaaaatggtgggacccacatgtcaataatacaacgttatcttccacctcccccacactctcccctctgttccccgagagggagaagaagaggagtgcctcgatcgcatccccaccctattagctaggtttctgttccgcctctgcctttgcctctacttctcctcctcctcaccgtcgccgccgcagaatcgatggagtggcaggcgcagctgacaaggagaaggacaacagccggcaatcgacagggagcagcgcgactggcggtaggcaggagctatgtgacggctgtgacgtccgagctcaaccgccgctgggaggtctaggagcctctgctcccacatcgccgctgcgggcctcctccgtttttggacttggacttggaagagctcgtcggcctctcagccctcctcgctgcctcctcgtcccccttgccggcctcccaacctcctccctctctgtgcgtgcttgccggcttccctgccgcctcctctcagcgcgctctcactggcatcctcatcccccagccagtctgcgccattgctccctctctgcgagtgctgagaagatagagagggtgagctg

SEQ ID NO: 58369 - DNA, 2826 bp, Oryza sativa
tgaacttattgcaccccataataattgccgttagggatcgcaacacaggttcgggccagcagagggtgaaccatcgcgtgggccgcagcccaatatatatacaggtcgtgtactcactgggggtggttttcatgggtttgtatttctgtacattagaagagttgttacgagtggcatgggcaaattccattgtaaggtgtttatagttccttgcacgtgcacgatatctagtagttataaattactaatttctatgccaacatttatattaaaccgagttcacaaatttctgttggttgcgctgaaaaatgtactggttgcattgcaaaactgccgatgtgtagcaaaacatccaggagttgatgctttatgctgccgtgatcgattctgaaagcttggcagcaagagatagggtaaatgttgtgcgtattttttcctgcagctgtgtactagtaggctcttaagagttaagttcggggctaatctctaatatcgaattctatgcggattcccgtgcaaatagcacctccacgtggcgcggccagattcacggattcgctcccacgcacagccgtccgattgcatttcaacggtgagagatcgttgtggtggagcctgttgtaatatacgagaatcgaggggttttcttacaaaagcactcaatccccccatcatccgtctcctctccagcgtcaccgccgcctgattcagcacatccgccgcgtcaccgccgctgaccttcgccctgacctcctccccgctgcaccgaagcctctctatcccctgcgcctccacatgtcgcggctacgcgggcatctcgttggatctatcatcggcggcgaggaggcgtggcgatggtgccgaggttcatcggccggtggaggaacatcgtcgacttgaggaccgtgcccaggttccgcatggtccccaactactgccaccccgtgggagccgccgaggggggcaacaactatggctttcagatgatagtttgatcatgcacacaatgcgttcgacgaaatgtccatgggcattcatgggtgtggctggcgccctgatgatgctcaatcctaccttcctcgttggattactttggtgttggtcgaagcattggccgaccaaggaatgtgctgccaggagttacaatggtggactcacgtcttagagggcagttcccttctgactcatatggtgacataccgtggcgtgccgtgaaaacctgagattggcaaatggcttactaagtgtgatgccggcgtgtctttgtcactgaccaattcggattgcttgagctttccctggattaatttggttgttcttctgaaacggtttataggtgcaaaggggtgcgagcaagactacaatggacaaggtgtgtgcaactatgagctgggataatggagatgctttcatggatatgttggtaagtactactttgtcagctcaattaatgtgttaatcttgttcacacttgattaatgaaattgcgatttcacatggaatttaacaaggttgggttttaatcacactccattttttagcaccatccaaaaaatctttaagattgttttagtaatttatctactccgtacataatatcaagataaataggcatagtttatgaacctttgaattctgcacctgttccatactaagaagcaaataagaaagaaacaaataaatactccagttggttagtgtgtttgctcatatatgccattcttaagaaaaacatcagtttatatatttatttatgtcctatttagtttgctgtctatcaactcttcaaaaattatggataaactgtgctacttcaattctttgcttttgatcaaatgacagcccttgctctttccaacaactctattgacaaagatgttaaacatattttgcccaacactacaacttttgctccttagttctggaaatgatattgtatactctataaaccaagctaattcttcatttgacttatggatataccatcatagaaatagtataaggagacagttgcatattattactacacttattttttgaatatatatttcatcattgtacatatatatatttagacagctcaattatatatctttctgacaattgctaacacaatatttattataacaaagtttgcttggaaataacataataaaggatataatgaggcaataagaactgtgcgtggagggccggaagatgatgtctgtcatggccggcaagatggacgagctctggatagggcgtatggagtggtgcgtgctggaatgtaacaagaacgccatcaacttctacgagggaatgggcgagccacgcaggtgtgctcccgtaatggcacatatacagactcactggcgctgcacactggaaagtacaatgggactaagagaagggcaatggggcgaaatagatcggtggttgattcttagttgtccagtctcaagtaataaagaaaccggagatgtgtgatttagggtattggataagttcgtgatgtcttagcttgatgttctttcaaatgtagtacacaatctttgcagaaggttaagggaaaataaacaaattcttaaattataggaaaaggcaaaaaaagataattcaggagagtcacaagccccattgcataacaagcccaaaactgaatgttggagacactctagatcaaaacgttagcaagcggaaatggtatactgttatacctaattttataaaattattttatctctaacctttttacatttcctttttaccttgttgcaattactgacaatcacccaattactggactttgcagatgacatcgaaaaaatcctaggaaacactaac

SEQ ID NO: 58370 - DNA, 2835 bp, Oryza sativa
  unsure (1)..(2835): unsure at all n locations
caccccctagaataggttggcaacttaaccgctccaccagaatttagcccttgtcaccactataactcagaaattggttccctcagggttgccaactttaggatagagtccatttcttgcctgatcagctcctcccaaagctctaggatttggttccattcttgcacaaatcatgaatgaaatcagaaaattgaagcgcgggatcagcaccaaacgaggtgatcaccccgtccaaaatggtaatagatttgtcggtcttggttcttttcttctcatctcaaatttcaccattcctgcatgtttcataatttctcatgacatttcgatcttggaaaatgtatagcttgatcaatgtgttccaaattattcttctggaagtaatgatacagggatgttagtgcctcacctgcctagaaataaagaaatgatcatgcctgattgacatttccctcagcgtctctgaatattgcaggccaaaatccagtcgatgaatgggaggagcaacaacgatactggccttcgccacgggcaccgccggtgagtccgatgggatcgccgcggaccccccaatagatgggcaagtcccatggaagnaaagcctcaagatgtacatacgagaccaaggngctcgcaaaagcaaggccacacgagtcttaaaagaaatggatgcacctgctgcatcacaagaagaagccgcaagaagacatgatgtggaccccccgagcaggacccagtgcagacgacagcaaggagcacaacgatgcagactacggatccccaagcacagctcgacatccccattcctgtatgtctgccagacttcagaatattgcatgcattggacaatctccagttaaatccagtcaagatatcaattatagtataattttgttatgatgaagataatacttgtgttttccatgtaaatcgaagcgtgtgaatcagcatgtcacttaggttttcttggaagcatcatcaaggcagaatcccccactcccgagcccactggcacacaaggagcaaccatacttcaaggtcagcagcaggtttgagtcaggaatgaagggagccaatgaaatgctgagggaatcaaagcagctccgtgtccaccccacccaaccgaaaacnnnnnnnnnnnnnnnnnnnnnnnnnnnnggcatcgcgggcggaaccgcccgccggcgtggagctgccgcgctcgctagaaaagggatggcaggctccggttcctggtgcggagcccgcaatcgtgctcatcttcaacgcctccgctcgtctgccgtcagcgtcctctccgtcttcgccttcgatgtcgagggcgtagatgtccgccttcgacggttgtcatcgttgccgtcaggaggaggaagaggcagaggaaaaggtcgccgtcagcggttgtcgtcgttgccgcgatgtccagccaccgcgtgccgtccctcctcgcccggccgccgcgcgccgcctccctcctcgcccggctgccacgagctgcccctcctcggggcggagctagcacaaaatgaaggggggttccacttgtttgctttactctagtttgaatcaaatttagcttaatacgagtgcctaactttgaactgacagagtatatatatggtgaaaatagacaaactatagctaaaattttgtttgaaccgggttcctgggcacccccctagctatacatagctccgccccctgcctcctcgctcggccttcgcccactgctcccctctacgccgccgctcgccgctctgtacgagactgggagagagagagaggggggggatagagaggagagggggctgacatgtgggaccacatgggccccaccttttcttattgtttttgtgtggctgacatgtgggtcccatggtttactattatttttctgggattcaattgccacataagcaccacgtcaatgccacgtgggacgaggacatagtcaaagggagccacgtaggcgccacgtcatccaaaaccgggcatagtactgccgagggaccttttctgtacggttttgtaagttgaggaatgcgttgtattcggttttttagactgagtatgaaaattagactgggggacaaattgagggacccaaagtgattccttatggttgtgataggctgacagaaatgacgctgtggggaaggccggagaaacccacaacttgaagcccagcattgggccctggacacggccatacagtccacgcaggcccatcgaaaattctagtttcaagtcagtcgcaaccattggttgcgatccaattttatgtgggctgcgacgtctcccggatgcctggcccaagcgagcgcggaatcatttgggtagctttgtgcagttctttttcttccggtgatctgtttgcgtcttgatgcgatattctccacaatctccactactcagtataagctagtttgctctatattttgaattttccatgtttcagcatttcaaatgtgcaatagaataattaaaaatgtttcatcgaatggaagctgttgcctgtgaaattgtcatattgtgcttcatgattatggtttttctgcaatattttttttccggatatgccttatacgtttgcatgggaggagaaaatatgataggtaggcctaccaatttttaaaatataattgttgaatgttgtgcgcaagttatgtaggaccaaaaccactttggattgagagggggtggaggcttatttggtttgagcagttgggtgtgtcaatgtgtcttgtattcaagttcatggcttaattaggtcgatcgcagtagtttaggggttaattcaggcttttctcttataataaaataatatgttgggtgttc

SEQ ID NO: 58371 - DNA, 2780 bp, Oryza sativa
aggttttcttggaagcatcatcaaggcagaattccccactcccgagcccaactgcacacaaggagcaaccatacttcaaggtcagcagcaggtttgagtcagaaatgaaggaagccaatgaaatgctgagggaatcaaagcagctccgtgtcaacacaaccaaaccgaagactgtaacatttgcgccaatcttagaacaggggccagaacctgtaaaaaatgattggcacagcaaagaactgtcagaaacagcaaccgagatattcagtcatgcatatgctatagtctgtgaggcagtcctcaggatggtctctataatccaaggcgcgatgtcatcatataatattgacagaaggcaaatgttagagaagatcgtatcgttcaagagatacatgatgctgaagctggcacctggagaaggtgataaagtactctcagaagtcattactgaggctgtcctcgatatgtttgacgcctggtgtgagaatgttgagaggcctttggtacagagggcaaagaaagtgtattcttggtttctgccagaaaggagagaagagttacctcctgttccactgtccacccatccttgtgtgtatgaaggtaagcttcaccaggtgtgcaagggtagtcctatctgcagaatattattatagggtttagcaataacttgaagcctgtgcaatgcagatgcagaagaattttactcattagagaattgactacggcttgaagcatgagatcaagactctatgaaacaagataagtagagagatgtttaccttacaatgtccgaagaccggaggcgaagacagagtgttcggcccaagtatactttgttcatagaattacatcataccttacaatggctgcatgtgaaaccaaaaggaggtttctgtggctgtgtaccagaaactaatgtacaagatttcaatcttaagtgtctcttcagataaagctcagtatcagatattagattcacaatcagtgaccacaaattccacaatgtaggcagtacagaaatattgaaagaaaacaaaaatcctccaactgcagaactacaattactctggaaagaagtatatatatttctttgaacgagcaactagccctcacattcttgtcttatttattctggacataaccatgccgtgattagcacaaaaagaacacacaggtaggttcaaattagaaattttaccagcttataatcatattacaaagagaataaaatacatcttgctcaaaatcactgttacaaacatgccatctcagctcttttaatgggacgccattcaaaattatgagttcagtacacacattgtgtatattaacatccgcaaatactataatgacaacaggcctgtcagtctctcactgcagctcgtaggatgaaaaggtaaatccagaatctttctcattggtacacttcagttcaagcttctgaaacggactgtaaattgagagagcaggaaatatttatatcacttcaattcctcaatagaatttagttgttacatcgcaataaaaagtgccagcgaaatatacattacctgctgtttggatcataataatacccgctaatggaaccatcgctacatgaaaagcagacatagtagaaaccagctatggtcaacccacagtccactccaacattgacaaagtactgctctttccatctctacatgtagcatcagaataatgctaagttgttatgactttgtatttcaataaatggggcacatacatgaaaggtcagatggtgcagtaccatgaatatgtaagcatagttgctgaagtccacagacttgccaccatctgtctctatctgactctgtggagaaacataagtgagaaatgtatcctaacaaatcgtggcaactaacaacacgaagataggcaacagaataccagaagaggtgtaaatgatgggaacttggaccagtgtctaatatcatcctctgggctgcaaaagcataagcaggaataatgtttgatgagtaagtttggactgttaccctaaactagggcatcaattaataaaacaagtagatgatagtatcaaggataaaacataaatagttaactactcacgatgcctcccacttgccagtgaaaaatgtataatttttagcatccactatctccccctcccagaatgttaccacctatggaaattatttacaaattgctacgcaaatcagataatggtaacaagaagtaaaacatagcattattttacattttatcggaacaaactgtttgcctactaaattagtatacgaatgaacaatttggaacataaagatcagagtcaaagtggaaaaggaagtagtagctcacaggggtatcagctaagggaacattaactgcttccattgttccacataaataaccctgttcaagatcacagtcattgatccgcacattaactttccaagcttcttctttttgtatagtagagacattctgggttccagcataacactgaaagaatggtacaagcatatggtctggtcagttccataaacaacaccgataagaagattcgatccttggtcaagttccaaataacagcacaaaaagacttactcttccagcacttaagagggaacagctaggaggagacggatgcccagcatttgcatcttgacctgcagcattttaatcagtatggcacattggcacggcgggctatctatttccagaaatacatacaaaataactaatgaaatttcaattgcaggtgaacaaaatcaacaattggtttatatagaaggcct

SEQ ID NO: 58372 - DNA, 2160 bp, Oryza sativa
taaaacgtgttcaatagtttaggaaatctggtactcgtagttcttatgatggtagcacacactttttcaccgactcccttcgtctaaaaaaaattatacgttacatccagtgctaaattggtattttatgggacagagggagtaactctgaacatacaaacactaagatatatcaaataaaacatatttctccgcaaaataattatattgaaacttgtagtagcaagaaagtgaaccatttccattttttaataaaaaaataaaacctgaatcatatcagaatggctggaaaaattccttttattttctcctcctttatactaggaaagaacagccgacgtggcgatcaacgattggtcgactgagcaagcaacccacgaacagataagacggataaacacaccgtcgctaaagaagaaacacaaagaaaccaactccgacgaccaccggagtcggagagcatcaagaatcgacgacgatcgatcatggccatccccaccatcctgggcagtctgaagctcacgccatccccaccctccgccacgccggtgcgctcctccgcctcctcctccctgcatttccacctcgccaacgccggcgccgccgcgctcgtcgcggcctcgctcctcgtcgccgacccggccctggcattcaagggaggaggcccgtacgggcagcaggtgacacgggggcaggacctcaccggcaaggacttcagtggccagacgctcatcaggcaggacttcaagacggtactctctttgattgttcccattgcctttctgtttcagttcttgaactcggatatgatcatatttctgtagataaattgtaactgttcttgtgggtgaattactgaattctatgtccagaagagtatctgaattgtcagcaaatgcaattgcaaagcttatgctgttttcttggtatgtttttgttgcagtctatactgaggcaggcgaacttcaaaggcgcgaagctgctcggcgcgagcttctttgatgcagatctgacaggttctgatgctgtgcttgtgaatttgttagatgttccatttatcacagtagttgtagtgattcttccccaatgtgaagttctgaaatggcaaaactgatgttttggttctagttgcattgattattcagagttttctggtgataaattcaggtgctgatctctctgatgctgatcttagaggtgcagatttctcactggcaaatgtatcgaaggtagtactgcatattgctcaaagaaaagcattagcgatagcaagctaattgaaatgctactacattccacattgaccattgcattgttcagaaagcctggattgttttttcctttttactgattagaccagtaataaattgatagcaatttggcattggcatcatagcaatattgaacaagcttgcgttacataatataattggtcattacataagtcctcactttcttcagaaagtcattgaccactttctgattaagttactaccagtttgtcaagcatggatttcacaggtttgcagcacaaatagtttgttactagcttgcataacctagtgacaaactgacaatcgagtgatggtgtgtctcttgaatcatttcacaggtaaatctgacaaatgccaacttggaaggggcacttgccacaggaaacacgacgttcaaaggttccaacatatatggagcaggcaagttactggtcctgtctctctgatggccatgccaaactaaatgactccttttatctgcaaactatcggattgttgacatattaatatgatcaattattattttttcaatctctaaccaacctcttactcatctacaaaatgcttcaacagagttttgattttgtcagaggctgaccaaaattgcattagactgaattgactattgtttgatgggatcatcaaacatctaagtttctctctctctttttttttggccttccagattttacagatgttccactgcgagacgatcagcgtgaatacctctgcaaaattgctgatgggtaagtaaccaatgttgcaatcatgcacacaccaatggctgtccattgcacttattttgtgtctccctgtatgtacattacattgagctcactctagctacaattaactttttgcatcagggtcaatacaaccactgggg

SEQ ID NO: 58373 - DNA, 3363 bp, Oryza sativa
acatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacctcgccgccgctgcttgcttcactcgcctcagatccgcgccgccgccccccgcgaatcccctctcctccccgaaccctagccccgctctcgggggttccccctcctcctccgccgcccgccgcgtccgccacttccatcggaggtattgctgctgctgctgcttctgcttctgctgctgcgttgggggggggggtgttccgatctgtgggctgtagggggatctggattccgcccgtgctgggggtgtgattttgtgtgggcatttgtttgtgatgacgggatgatgatattgttgggtgcgagcaggtgatcgatcgagcgggggtggggggagaggttgggcggcttggattggagagggctcggagtggatgtcgaggaggtcggtgaatccgagccggcgggtggcggatgggggattgccgtctgtcggtggcctgcttcaccccaagtcacgctcgccgcccgtgctcaccatcgccctcgtggtcctggtagttttccatctttctttttgtcaatttagttgttaggatttctcatgtgctcagctgacagaagtgtgcttgtttttttttttgggggtttcagggtgtcattattctgatcgcctacttcaatagcggctcaggtcagcttgaactccacttgaatattcttcttcacctgtttatttttgttccgtttagcttgtattgcaaaatggtgaaaaaaccgtagtgagagtaactcatactaattcactctgttcccttattctgttgattctctgctttctattaaagaaaggtagtagcaacttaaataatagatttggaggtaggggtgggcgtgctagatgccatcactgattgttgctgtcacaattagtgcacagtgacattgctgcagcattgtacctgcattttcttattggtactgcattgttgctgtcatgattttctgaaatatcaaaacaaaatcaacttgggatattcaattgttaactgagattgccctgtagtatgaatatattttgtgattttttaacgttgaattgtcctgctcctagagatagcaaagtggaccagctcatactcgagtgccaaatatcgtggaccagctcatacttctaattgtcatttttctccaatggccaggtgtaacagttactagcagagaagctgtgagcaggtctgaaggtatattattctttgtgtgccaaatcatatgctgctgtcatcttttaacctctcttaatgcattgttgatttatctcttcaatttcttctgatactcgctgcagtaagaaataggtgttgtgcaatccttcatataagcattctggagatactgcatttggttttttattctccatgaatgtttctgtctttttttttctttgttgatgccttcggtgttattcttcattaggccatgaacagtatataaagaattcaactggtatgacatgatcaacatggaccatgtgataattattttttcccctgctgaattttgacactgtcataccaatgtaatttggctgtctgagtgtctgatgtgtggtacaaacagcaacgcagtttactgtattatcctaagcttcatgatactaatagataaccctctaaattttgataaaatatattggaacatgatagttataacttataagaccctctctgggagggtttagtaattgatttttttaggaatctccattgtattccttttcacacgtgttattgggaaaagttttgtgcttctcattatctcaacctttcctttgcatttgcattcaggttcttgtacaccagaagtcatgcaagcacttccttatcttaaaaaggcatatggcaatgagttgcataaggttctccatgttggccctgatagttgtacagtagtttctaacttgttgaaggaagggaaggttgaagcatggggagtggagccttatgatttggaggatactgatagtagctgcaaaagccttgtgcgcaagggctttgttcgtatggctgatatcaagttccctcttccataccgccaagattcctttaaccttgttatcgtatcagatgctttggattatttgaccccaagatatctgaacaaaacacttccagatttagcaaggatttctacagatggtcttgttatctttgccggtatgtatttctttgagttaatcgcatacttgttgatgatcatagttgacacataaacggctatatttgtagatgtacatgatgattccccttcgtttaaatgtcatggtaggttgggcagacctgaaaggatagcatactgaatgttcattttccctagatcttacatttaaaatgaagcttcggttatttgatggttgggtgggcaatcattattggtatttttagggctttttaattggatgcattctaataagcccatagccccatacggagaatggctatagagaaaaaccaggcaatgggttagagagctattaatacccatgtagatatactattgaaatggtttactattaatctagtctattgctgagatgtacatattttatagatagcaccttactttactattgcgggtgctcttatagcctgctattgtacctgctctaagagatagaaatgatgttgactaaatggtcaaatgtaatgcgaatccgtgacacgagtttgaccatttggtttcctgggcaggaatgaaatggaaatactgggtgctaatcagttggcataataatccagagagttgcacgatggagcattcgttagtgttaggtacactaaaatttcagatatagctaccaaatttcctgtgttgaccattgacaattttccagacctatttgaccattgactagtaataacatgtactagtagtaagtactttcagcccagtgggttgggccggaacccaccgggccaggccgacggccagcgaagcaaagaaaagaaaaggaaaaccaaaagaccggtaggtagaccccacctgtcagtgaaagcaggcgacggcgaccgacatcccccaaattcccccatctccccgtctcggaattcgggttgtgctccactaaatccctcgctaatggcgtgctaatcccaccaccacccttgcattgcacgcggccgtataaaatcccgtgccaccgtatcattcactcctcccgtccctatcgcgtcggatcgccacccacct

SEQ ID NO: 58374 - DNA, 1923 bp, Oryza sativa
aattaatttgtcatatgacctctaagaccagtaccgtactgacacaaaaggattgatttgacgcattccatgtccatgatccagaaaggcagcttataaaagttgtagaatggttttatgcttttaataggttaccgatgttctggatattcatgcttagcattttattgatgttgtagcgatgttgcatgtatggtgttcttttcattatacagtagtatatgagtatatcacatcatggaatataatttcaattgcattctgtatgttggcagttacaaatatgctgttgcctattgactagtattgcttagtctgttaggctgtccattaatgctattgatggttacttgtttggagaggaatggaataaccgttgatttgtttgatgttatgcatgcattagtattttctagaacacaatataaataattgagctatatcgaaggctagaagtttggtgacatggactgttttttttcacaggcaaagttgcggagttcttcgtggtggtcgcgatactttatccagactggcttgagagagaatgaagggccattgaagaagtttgagcaggctgcttccaagaacaaatacaaaccagactgtcaaatcttccatcttagctcgtaggcgtgttctgatctaggtgatgtgtatccatgaaacctggatcgttgcctcgccggttttgtaagcaatatcctgtttacccccgttgacttgcgcttcttttacacggaggaattgtcacattaagagccagccagccttgagcataggtagcttatgtagagagatttgccacatgctgctagaaaattcttcctggaaagttaaattatgtgttaccaagaggtgcaaattgaagccctgaggatatatatgtaagaacttcacactgttgtaccctgttattcttcttggtgttacagttattcctggtgaaccagctgcagttccgtgagcagtttgtaatgtactcagttcaagagagagagaaaaaatatatatctaccctttgtctgctactctgacctagtagggtgtcattctcacgacttggatgatgcttaaagtcgacccaattctttctattgggatacctgagaacgatggttcaccagacttcggatttagccttttatcttttttgtcttaattatagggttagttgaggcctcaattgcaagcttcactaacaaacacagaaaaagaagagggaaaacacaacaaactccattacaatatacccttttgaggtcaggtaagatgtcccttgtcttcaaaccacatctgtgcatcattttttccctttttttttgtggctttcccttccttcaagcacaaagccattgatattctttatatgattatataggattggtctccctcccctaacacccagaccagaatcagcagaagctgtcctattttaaacctaattccaatcagaaaccagcagtcaccacaaaacccaattgccccctgatttgttcctgtgtgacaccttaaattccaatagctgtttcatcacaaaaaactaatgcaccttgtgtgtccccctgaagtgtaaacagcatctttgttctgcttacaaaaaatccattttcctatccacaagtccacaggcatgcgtgcatgcatcccatcatcatcttctccaattgatgtggctctctcatttgaccatttccttgtgctagctagctagtagcttagctgagcaaagctaagccagttgttatccactaatcagcattgattagtttagtcaaaaaaaaaatctcaaggctcaccttattatactaatctgcagttgtgcccttaaatacccacacgcctctctttcttcctctttatcctttgcagttgcaccaccaaacagagacagaggtagagagggttcttgctttgcttagc

SEQ ID NO: 58375 - DNA, 1898 bp, Oryza sativa
aatcgatccaggcactacactaaatgttgttttcttctctctattttcttttttttttaaaaaaaaatctattttcctagcttttttatctcgttttctatgtgcacgcttctaaaactggtaaacgatatattttcacgaaaaaattatataagaaagttattttatatactttttttttaaaaaaaaacctaataattaattaatgatgcacgagggattatccaactacaagagccaaacacagcttcagatgttgtatcaaatcatagtgctagaccatttggagaaggagaattaatttcacaagcacaagaaacccatacgcaagttctgttgattttttgtaaaaacgaaatcgttgaaagaggacaggaggcaagtagtgtcagcgacagatgggtcccactaaacggtaggtataagcgtcatccaaaacccctcttcccttttcttatcccctcccctctcctctcttctctccttcgcttcgccaccgcgttcgccatggccttcgtctccgccgccgccgccgccaccgccgccgccgccttcctccccggcgtctcgtccgcgtcccgcgcaggaacacccttgctctcgctgcaacggcagccgctcgcgggttccctgcgcgcggcggcgcaggggtcgagcgcctcttcggggcaggtggtgatggagagcaaggtcaaggcgaagaagaagaaggggtccggcgccgggaacctccccggagccatcgacgcggagatcagggaggcgcaggactacctcgccatcgacgagcaggtgagagtgagacgcgcgctcttctcttgcgcgatactgtactactgtcatcgaaacttgactgatttggcgcgccaaatgagatattattttgtcatattggacagtgattttgtcttgtggggatgatgaatttttggtgaggttttgtcaaattatagtgctgtcttgcgtgaatgctacacgtcgactggtaactggttgataaataatgggcatctctagctaattgaacactacaattgggaaatatatttacgattgctttcacctaaaatagattacttttgcagtctcgttcggcgcttctctcttaatacagatcaattggtgactgatgacgtattgttacttcggtatgctggtggcagttagagaatagagaatttgttcatcttactcatgcatcgatatcttctatttatttattttatcttaagccattagtctaggtgtctgaattctttaagtgatagtttattggcaattgtttattgcaactggcattcagagagttgttaagactttagatttattccctgcgtcagctatgcaatgctcatctggttttcaaggatcctataactttcttgcatctattttgtcatgtttgacctgaatgtctggagagaagtcttatacccttgtgtaagcaaatcgtttcttaagcgttttccttgtttcaaatcattgaaccattctaatgattcttttaaagcggtatgactttggaatagacaaatagtgggactgatgatagagtttgtgatggtttgggttcaatattttgatcaattggaagctccaggcaagggcaatattagaactggcattgaggttgaataatcctttccgcataaccctgaaaagtgaatgaatgaatggacatcaaagctgtaaaattacctctgcaggtgtgacatctagctgtaaaattgacatgctggtttgacatcaaggcatttaacatctgttattgaatattccaaaggtgtttcatcttacccatttatctttcttgcaacaggaacctgttccggaaaacttcccttttgaaatccttgacgaagaagggatgagtgtggttattctgaaaagggactaca

SEQ ID NO: 58376 - DNA, 1744 bp, Oryza sativa
tgcaacaaccggggaaactgccttccctgcaatgtgcgatttctgatgcccagtagtcaatctgaggctattggcacttatgatatcagtgcttattttactagccttttaccgtttcttggtgctgcttatctgaattttgtgtggaattgtgaattgtgatggctgaaatgatattctatgtgaaaagaaattactcgatggatgtctgttcaaaacttaaaccgctactaggaatgcttaaacatgtgaatagaggtagtaatatagtctgataatgacaatgatgattagataatgagcaaagcaagggggtaaagagaaaatccgtaaaagaacaattgaatttattaactatctatactaatggacaacaattcttgattgaatttaattaacggataacgatatttggtagataatcgatttttttttcttcttctccaagaagcaaacaaacatgattgataacagaatggtcctttccatttttttttccatattaaaacaacataaattgtcgtcctcatctccaattctccacagctcgtaaacccccaaaaccctgactaaaaccttcgtcatccgccgctgcaccgtcgccatggcttttttcgccgccgctcgccgggccggcacattcacccttcccctgcttcgcccgctggccgccgcggcggcgcggccgcagccccgctcgatgccgttctcgtcgtcggcccccttgacgaagcccgccttcgacagtgagctcgtcaggatcatcgacaacgcgatcaacgacgccgaggaggagagcgacggcgaccaagaccgggtgcgtgcgcgcgcgagctcctgaatctcactaaatcaaatgctgctattcgatcttctgctctatcatcagagaattatcttttgacatcattgaatcccctttgtttgttttgattttagtcgtattatatattaccatgaaataaacttaagcaatctgtcgccgttaggtacttcatatgttgtttgcgttatgttctatgttgctatagtagggattgggattagttatttaactttgtttttaaagaaaaggagtaattttcatactgtaattggtagcataatcatgtttacagcattgcaattgctttgctgagattgaggtaatatttggtacaatgatgtggagtatttgctattccactttttcatgctcatattaacttcaacttctcttgattatagtagattttggtgttatttatttgcagttactgcactattttagtgcttgatcattgttgttgtgccttgtttaattcttgtgtaaggttttgtgcgttcctcataagaattcaatatgccttgctattgtgccttatgaattgtagtacttttttgtctcctgtattcttgttctattagtgctgatgtctaaagtcgtttattttgaaatttttctccgcttagaactctgctggtaagttttaatcattctatctagttcctgtacctttctctgcgattatgcataaccagattgttttcctgaactatacattcatgccagtttgattactctgcgcaattatatatgatatataagttcaatgctttgaacaattttcatgctctccttgagagcaatgtgctgtgactgtctgactgagggcctcattttcattgtcatactgatacaggccaaggagatccctaataactccccctttaaaatctttaaattctttaaaatcaattatgg

SEQ ID NO: 58377 - DNA, 2606 bp, Oryza sativa
ctagatgtgtatatatatcacttcattttcttaagcaaataatgaagtttagaagacttagctagctgttagtctttgttatttttgctcatcacgatggtgtcagctccttcccatgtggtacgtaggtgtatatcatttctttttcattagcaaataataaagtctatattgattctcttaaaagattcatattgacgtaattgttagattcatattgatgttcctgtagcccatccgaaaatattttctcgccatcatccaccattctgccaggcttgagtcgttgatcgtcggcggcaagaagccaatgccaatccatccttgcatcagcgcccatactcgtctagtgaagtcgcattttacaaatagatgcaagcagctttcttcctcccgttggcagagggagcagagatcttcgtgcggccagcctctcttttcaaaaaatggtttcatgacaacaaactttggtttctcccgctaaagcctagtaaaaaatggtttcatgacaatacaccattgaatgatttcaatccgtttaaaaactgattgaatggtttcgacggcctcacgctacacaagctgctcgtctggggagccttcctgtttaactacccggtgatctcctacaccatcggcctgatgcagtcctcgtccatccagaacgaactgttcgtcgtctgggcctgcttcctcctcctcctcctcggcagcgccgacaccatgacggcgttcagcttcaatgacagcagccagcagacgaggtccatgatgaaccagaccctccacgtcgtgtacctcctcttcctcatcctctactacaaaggccagctccgcggcaccttcctcgtcagcctcttcctcctctggtgcttgagcgtggtgcggctgggcttgagggtcaaggcgtacctatgaacgaaccgctcccatgggctcatcagggagaaccaggtggtgtacgagtacatgaagtacgagccgctcaacagcgctggcattcaaggtggctcctcggagtacatctatctcgtcgacggtgaggaggtggagaaggtggacaatggggaggtcataaaagtgtcgtacaaggttccagagacggtggacgtcgaaaagtgtccacaagtgaggttaaggttcgcagccgatcatgtcggtcatatcaacttccctttacagtacgacaagtgccgagactttgtcgtcaaggggctcctcgccaatgacgaagacctcggcagggcattccgggtgatcgaggctgagcttgggttcctctttgacttcttttacgctcggtacccctcaatcaaggacaccctggctcctgaccttgctgtgtacatcgtgatcctggcgactagcttgttcaccctcttctctccagaccttctccgatacaggtcccattggcagcaacgctgccaacaacatccttatccatggctttaatctcgacctccttgtcacccgcttggtcattgtctggtacatcttcctcgagtcgtaccaattccttgcctttatcttctccgactggcacaaggtgaagatgttgtgccgatatgtacgcaatgagtcatggcaatggaggtcccgctaaaggtgttgtgccatttcactgtcaccaggtactggaaggggaccatcggccaatacttcatcctcgacaacatccaacctcactgggtcaagaccttcctctcatggttctctctcgaggcccaggcccttgattcatcattgatgactcgctccgtccgcttgatgccggtggtgctccgtgagctcaacaactgcgatggcaagatcaccgacgggaggatgtggatgtaccggacaggcattatcgacttgaacctcgatcgtgatgtcttgcacggtacatactgacatggcacatcgccacaagcatatgtgactatgggcttagcatggacaccactgctggtggcattccagccggagctggtcccggacagcacgtacacgagcacttcgatggcccgtggcacactgcagaatgcctgcgacttcctcgccaaatgcgagtccgccagtgacaagtatgataagctgatggatctggggcgcttggaccacacggagcacaatgttcggttcctatctgagggcgcaaggatcgccgtgtacctcgttgagcggatcgaggatgccgggaagcggtggaaggtgcttgccgccttctgggcaaacatgatgttgtacatcgccccgtcggatagggcggtcgcacacgccacgaggatggccactggcggggagtttgtaacgatcatttgggctctgctgtcacatgcccatgtagtagacaagcttcaacatcgtggcggtgccccgggattgcctattctacttgaagaagaggaagataaaagggcacaagcagggccggccctgatctgatggaacttgttagatccttgattctccgttggcaacttggcttgcatggaggaatgctaatcatatagtataatgacaattgtgggcagatcagatgcatatgcttggctcattggaggattctgatgcatatacctggctcactggatgatttgagaaggttctttcacaaatca

SEQ ID NO: 58378 - DNA, 1189 bp, Oryza sativa
ccgatcgccggaagcgatacagcctccgccgggagcaaagccaacatactgccattctcgtgcgcagcactatcgccgccgtcgggcccagcagcagccgtccgcttccaggaacttgcttccgtcagtctctctagcgatataagttcttgagtattaaaagcctgagcccgtgataatatataactactgcatgtttgcatcagacttgtttgatgattcaggcttcatccgcttcaataacaatggatacaagcaataattaagttaattaacaagtctaattctctacaaacacttgtgaatcggtacatatgttttttttataaaattcttcttcacttttttaaaattgctgttgtcgcatgccgccgcggggcttccctgccctgctgctgctgcatgccgcactgctgcttcggccacctgccggctgcccttgccgctgcgagctgccgcagctgcgcgccggcagcggctgctttgactggacgcctatcgaccggatctaactgagaaaatgcgaatttacaaaattaccccctatataaatagatgaaaagacaaatataccctattcaattttatactgcaggataattaggaagaagatcagattaatttacaccgttagatcaaatataatggcagtatatacttgcagtacaatgtaccataaaaatcctaaaaagaggaaaagagctaagtagtattctttctttcaagtttcaagagcatatatgctcttagtgggttttatttaattcataacaaatgattaaaaaactaatatgtttattaagtatcaagtgcgcgatatggcaacaactattggcataagtgtttgcgtccctcaacctataagctgagatcgattagtatccctcaattataaaactaggtataacacactaattatcaaaatcagtgcaaattaactctctctcggtggttcttttgagcggtctcatttaacttattattttgactttgtctacacacatactatgtgacgtttatgtagcaatcatatattctaataaaaaatcagaaaaaccatactccttttttctttgctcctaggggttgtattttctcctactctattaagtgaaaaggcatctagtgctgttttccgttaaaaaaaaaaagaaaaacagtagggctctcatattagtcatgtggaaaa

SEQ ID NO: 58379 - DNA, 2076 bp, Oryza sativa
agaaattatgaaacatgcaggaatggtgaaatttgagatgagaagaaaagaaccaagatcgacaaatctattaccattttggacggggtgatcacctcgtttggtggtgctgtttcatggaggtcttgcaaacagaccattttgacgaggtcaaccatggaagcaaagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactcaggagttataacgttggattacatccaaacagcgagaaatctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggttttaattagcgaagatgttgtcctgcagagcattcttgaaagaactcacctttgtgagcttgactgttggtcgcagtctataaagattttgggtgaatcttctaggaagcttactaaagacctaggagtatgacttatacgctccacccgaggggtagtctacagacggtctagtaccaggtaagactttgagtgaaacttgcttgcacaagacttgcaattcaaggcgtagtccattgttcaagttgtgagtaagtgtagcttggagttctaggtggatgctcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacacgcgcgcgctcgctcgcctcgcctggccgggcaggcggcgcgcgtgcacgacgtacgcgtcgaatggtccgaaaaattggctcctcacccttacgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcaggcgccctgatcaagcgacccttctctatataaaccgacctgccgtcttcacgcaacacacgcgaaatcaatctagggtttgcctcctactctgtactgcgccgtcgctcgtagactactccatcccgcttgccggcgtgcaccggcgatcgggagagcaggtctctggaacctctgccttcgacgtcctgcaccgggagaaggcggcaataaggtttttgggaagcgcttcgcgcgactgctccttgttcgttcgcgacggctcgccttcctcttcgctcgcgtgtttcgtgccttcgtagacacctgcgaaaagtttcgaccaagcagccggtctttccgtcacctcggtacgtgttcaatatgttgcgcatatttgatctgttcttgttatactgtgtagtttacatgtgtagatctaatggtgcgttcatgctagttttcatctgtaatgtcatgatttatttatggaatagattaaatcattatatgtctataatctcaacaatccaaaaaccttattataggtactgtgattttactatggctggttttgccgatgcactgaggc

SEQ ID NO: 58380 - DNA, 2866 bp, Oryza sativa
  unsure (1)..(2866): unsure at all n locations
nnnnnnnnnnnnnnnnnnnnnnnnnnnnnnnnncatgtgtagatctaatggtgtgttcatgctagttttcatctgtaatgtcatgatttatttatggaatagattaaatcattatatgtctataatctcaacagaagaaaccattaatatcaccacggcagatcatacatacaacaacatcgccgaggattacaactgcaatgtgttcattcgaatatggccgatggcaggtgcagacctgcagtaccacgcttacatttttcagatgttttcagcaaatgaagttttatatcaacttgaatttgctttcgtgagatatagtgtgatggtaacacaaaaccttatgtagaagcaaccttacgtgctcagatgaaatcatttgtatcatgcgaagtgagtatagctcaactggttaggttccttgtggtggaaccagcccacctgggttcaaatcctagatttgacacgggtgctcgcatttacggctaattattctttcagtggtagacgacgtacccgtcgacagcctcctagttaggcgacgtacccgtcgacagcctcctagatttgacacgggtgctcgctgtggtgacttcgtcaatctcaagatatgccggcacgttgtgagcgcctgcgtttatactgtgtttctcaaaaaaaaaagaaatcatttgtatcatggagctcttcttattgcctccaaacaatggaaatgttttttttttttgaaacaaacaatggaaatgttttgcatagacaggggtcggagaattaaactccgaacctcaaccacgcgatttattcgtgctcaactggatcgccactttatggtccattaaagctttgggcatcgtttttggagatttttgtaagcccaagtcagcccatgaaaatatggatagctgcccaagtcagcccaagtttagttgggccgagctcactgtgataattggatcatgtccagactgcggggatatgcacaacatgatctatttgtcgggtgatttctttgaaaaaatcacctagattttttctacccttaaatttacatccaacagactacaaaagaaaataaaaatacatatttagttacacaatacttttatcataattacaatgcacttacatgtcatatcaactgaatttacaaatgtaattttagttatataggattgtaattatatatattaaagaaaataacaaatagatatttactcacacaacattgttatcgaaatttcagtgcgcttacatgtcatatcaattgaatttacaaatataattttagttagagtaaagtccatcaccggtccctaaacttgtaccgttgtgtcatcccggttcctaaactcgcaaatcgaccgttcaggtcctcaaacttattcgactgtgtcaccccggtccctaaacttgcagatcactcgtttaggtcctccaacttgttcagttgtgttaccccggtccctaaacttggatttgaatatcatctgggtcaaataagacagtctaaagactttatatttaaaaataattcataactttttcatgtgaactctaatgaagaaaaactttatatcaaacttgtagccctcgactcgatctacaactttgtagttgagtttttttattctaagtcattttttgtcccaaaatgtaattttaaaattaaaatttcaaaatatataaacatgcaacaatattttgggactaaaacagttttaattcaaaaacttttcaactacaaagttgtaagtcacgtcgaaggctacaattttgatataaagtttgtcttcattagagttcatatgaaaaagttataaattattttttgatataaagtttttagaccgtcctgtttagggaccggggtgacacaactgaacaagttggaggacctaaacaagtgatctacaagtttagggaccgggatgacacagtcaaacaagtttgaggacctgaacggtcgatttgcgagtttagggaccgggatgacacaacggtacaagtttagggaccggtgatggactttactcttttggttatataggactgtaattttatattttaaagaaaataacaaatagatatttacttatacaacattgttatcaaaattacagtgcacttacatgtcatatcaactgaatttacaaatataactttagttatataggactgtaattttatatattaaaaataacaaataaatatttacttacacaacattgttataaaaattacagtacgcacttacatgtcatatcaactgaatttacaaatgtaatttttattatataggactgtaattttgtattttatttttattttagtttcaattgagagagaacgagagagaacagcgtgcatatcaattttttagagcgcaaaaaaaaaagaaattagcgcctctaacccgcccgactgaatcctatgcggattcccagcgctatatgtgcacgaatcttgtcacttatcgaacagcctaaaaaagacaaatccaagagaaaaaatcacacgacaaatctatagcaaaatcggcacaacattacttgatattcattctcgctgccaaattttcagattcagtcacagcatcacaatgcactaaatcacgaatatttagtgcaatttagtcataaattttgatatacaaaatggtatggttataactagtctgaaaagggcttatgaatatattgcatagtgacacagttgacgttcacaagttgaacgtaatgcttcaaagtctttgggaaactttagtatcaggctctcagcctctaaaacaggcaagttaaatgacaagtnnnnnnnnnnnnnnnnnnnnnnnnnnnnnnnnnnnnnnnnnnnnnnnnnnnnnnnnnnn

SEQ ID NO: 58381 - DNA, 1413 bp, Oryza sativa
cgtgttcttacaagtcaacggctgaacggcgcacggccatcatagcatccacaaatctgtttgcaataccacagccgcgatgccgaccagatcctggccgaggtccgccggcgcaggttcacggcgagggggtggccggaggacggcttccggcgacagtgatcggatcgtggccgagcaaaatttggcgcgccgtcgtttcctcaccgctgcacaagatctagcgaattgaggcagagaggaggtaagaggatgtagttaggaagccggagcagcgagatagagactttttgggcgagggcgagggcgaaggcgaggtcgccatggccgtggccctctcggccgccgcagccgcaagtctccgcggggcttttaaatatttgccactcttaccagtggagcttaacaatttactattagacccacatatcatagacacataagagtctacatgtgatagataggatgtggcaaatcgttaattgtgagagttacaaatagttaaatttcccagtctcggggaccctgtgatgtctcctctctttctccagtaatctcctactattagtagtactctcctatggccatgtggggtccacttatggcccacctttcagccaaaatcgaaacaattggatcagaatcttgattaaaaaactggatagaaaaatcaccaaaaagaacccttttggccatcacatgacagcggcaaggggcaagggaggacaaggcggcggcggcgggccggccgtacggtgcgcaccgtcgccggagccccgccagcggcagcgatgaagtggatgttgaattagtgatcacaaacaccataatcgccggtcgccgcgccgccaccggcttcacaattcgcggggtactccaacattccaaatacactcttctgcaaattagctgatttttttgtttgatttgagtataccgtagtgactcaaaatttgcatcacatattcatcaatccaagcattgatcaacaacacaacaacagcaggcagtggagggaaacagcgtgattgattgatggtagatactagatactcgaggtgatacacaaaagcacgatcgatgacccaaacagcaaacatcaagaaagcaacatcacacaaatcaaacaggtaagatactgttaaggtcctggctgggctgccaaatgggccagtccatcaactctcctaatgttggcccaggccagtccaaggtgaagctacaaaacaacaggacaactcttaccaggggaatcgaacagatcaggaatcggcggcttcggccacggcggcggcggcggcttggttcggttgaacctcgtcgatctctatccttctctctctccatggtcctcctcactgccacttctagaagcatcctctacttcttctccttcaattactcttctatttt

SEQ ID NO: 58382 - DNA, 1418 bp, Oryza sativa
  unsure (1)..(1418): unsure at all n locations
tcgttaaaaacctttctaggtaaaaacacacacctcgtgagaaaccctagaaagaaaaagagtacagcccatagctaaaatgttcatatcaattacaatcatccagttcaagggtttacatcaatttcatcatcaagatacatattctcataagcattttgaagctccacattctcagtagtatgctgactttttgcatctgctagctcccagtccttgatcactgccagaatttccaccagcctatggtttagacgccgccgacggtcctcgatgatcctgccagttaagctaaaagtagactcggacgatatagtagaaacagggaaggcagtttccccggttgttgcattgcttcgcataattctagtaatccttgttacatatgcaggtatgctaaaaggctaagctaccaaaaatcctgccaaattgctcggcaatttctcattgccggacgaagtccttcagcttggtcatccacccgacgtactccttggtttgcttggtcaccatgtaatcgtgcatgtagttggtggtcggcagagtgatccctctttgctccaggtacttgaataggcccttctgcacattcaccggtagctcgctgtagtagaaagaagcgattcgatgaggattatgagtagagatggtgctcaagaaggattgagaaatggagattgaaaccggtgttcttacgtgaattcagggccctcgtaagggaatttctcatctccttctgtggctgcattctccactattaacatgtcgtcgatggtgatctcctcacgaaaggctgtgcaggtgaactcaagtttgggcccagagcccttggagactgtcacctttagagacacgctgctatctccagcgctctcgtcttcctcttcatcttcatcatccttgctagcattcttgccctcaccctcggcttcttcgtcgtcaaactcagggcccccttctaaatttggcatgctgacaatgacctcaatcttctcatctttgtagtcccttttcagaataaccacactcatcccttcttcgtcaaggatttcaaaagggaagttttccggaacaggttcctgttgcaagaaagataaatgggtaagatgaaacacctttggaatattcaataacagatgttaaatgccttgatgtcaaaccagcatgtcaattttacagctagatgtcacacctgcagaggtaattttacagctttgatgtccattcattcattcacttttcagggttatgcggaaaggattattcaacctcaatgccagttctaatattgcccttgcctggagcttccaattgatcaaaatattgaacccaaaccatcacaaactctatcatcagtcccactnnnnnnnnnnnnnnnnnnnnnnnnnnnnnnnnnnnnnnnnnnnnnnnnnnnnnnn

SEQ ID NO: 58383 - DNA, 1289 bp, Oryza sativa
  unsure (1)..(1289): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcgctgactatccaacccatgcgtccatcagtcttatctcccgtgagtcatgcgggttttcggggcggtgcctactataatcgctagttttttttctcgtgttgagttggatgattttctctaatttttttttagaaatgatagttttttttctcatgttaagttagacggttttctcgaactgtttttagaaatagcgatttttttctcgtgttgaatccaattgttttttttactcgttttttataaacggtgttttttctgatagtttttccagagcgggttgttttttatgaatggtgtagtagatggaaaaaaaatcaatggatcctatccaactcaagcgtacatgaatttagcatttttctgacagtttttccaaagcagcttgtttttttatatatagacggtgttttttcttgcgcagttttttcaaaccattttttagaaatggcgcatttttttctgataattttttcctcgcatgttttttttaaaaaaatttacggacgatggaaatattttttctcgcatgtttttttattttttacgaaagatgggaaaccttttatagcgtgttttttttccttttttctaacttttttctcacgcgtttttattctctcgtgcactttttgtttttagttgtacgataaaaacttctccttttaaatagttaggttagattaaagatagagaagagatacatacggaaatgaatacaaattggacttttttcccgtctttttatttttttttctcacgcgttttttttattttatacgaacttttttctctactttcttagggaatcggacggactttttttatttttttttgggttttttttgcctttataggaatattttccctctttttaaaggaatccgatctagcctttttcttgccacttttttttgtttttcgccttctttaggaatcggattttttccagttcggatctacggatatttttcgccacttaggtgaaacagactgtcagggttatggataccacatacctaatagtagttgactaaatctcggcaggacccaccacataccatgtcttatacggaaacaaccttcgaatataggaggagttccgcataaggaatgatgaatagagttatacatggaaacgacaaggactacttggattatattcatattggtttccctagttctacttgg

SEQ ID NO: 58384 - DNA, 6321 bp, Oryza sativa
ccataccatgtaaataccggaatcgcgacatcaaacgtcgacacagacctcttttatttttgttgttttcttcgctattttttctcagattttttccccattttaagggggaattggatctacgtttttttcgccactttctaagtagtagagatagagatttactttttaagatttagaaattatagatctactttttaagtagtagagatagagatttatgttttgaacctactttttaagtagtagagatagaaattgttgacactttttttatggccaacacaagatcacctaacgatttgtgatttaatcgacggagtcgtcaaaatcgatagatcaaaactagccgactaaaccgattttgagattaattcactttcgtataatcacacggctaatttaagagcaaattagcaaagaaggtaaatatcgtacttatgtgacgacgaactactaatttccgagcaaactagcaaaggataacctcgtctcttttatggaaaagcacgaccatttttcagcacaaaacggcaaatattaaccaaattctagggttactagaactcatccatgaaagtaaaatagaaaataacgaaaaagtaaagaacgagagaaatagtatatccataaattgttcgaggcttttcaattaaccgtacacccgcatatatacgcaggtagcatggtcatcggtccaacacaaaaatagcaaggttcaaacaaaaaggaaacaaactgttaagatggaaaatctatcggctctagtgtttggcttattcggcatattcacaaatgaaaaataattttgtgaataaaacttttatatacgtgttcttagtgatctaaaagcaaatgttgataaataaattttgataaaaaaacattaaaatcagcttcaaattgaaggttaaaaatttaaattttggctgataagtataagcatacgtaaacaagagatgaggccgcatatcttcctagcagctgcacacgctaatcatatcgcatcgtttacaaaccgacgccacaactgcatatccttcacgcagccgcacaccaatgccatgctaatacggctctcgcgcacgcaagcgattaagggagaagtcaagtagattagggaaaaaaatgccatgctaatatggcgcacgcaagcgaataagggaaaagtcaagcagcagcacgcacgtatatgatcatcagccccaaaagctccccaacggcagcaaatttttgccggcaaccaactgcacaggtcttcacctctcaatctacatgcaaatagtaccaacgcaaaaaccttccttaaatgtggttaaacttagctgacccatagcaaaagagtctgtagcctaatggttacaagagcctcagtagcacttaaggtcttagattcgactacccatgagagcgaatttttcaggatttaacagcgttgtgctttcagtggtaagcgacgtacccgtcgacagcggcccagtcttcgaagatactcataggggtagggtttgcgtgcgtgtattcataggagtgagtgcgcgtgcgttataagtgtctgcgttatactgactaattcttgaaaaaaacttagctgacccataatatctctatgtcacaagataaatgctaagcctcccagcaatcacacacatttaaccaaccactcgataaaaaatgaactatcagaaaccaattaggacgatttgttagtttccaaatttgatagcaaattaatagtatttgaatggaaaatgagattttcttatgtcagagaggtcgacactaaaatgattgatggttaggttcagcgcgattgtatttggcgccgatatagggtgcatatacgcaacaagttttctcgcaatctgtttataaaatatgttctttaaaaggactaaatggcaaacatcacgtagatctgcttctctcatcatacgacatcgcaactacctgtgcgagagtgcatcagtagtacgtaaacaaatataaatcaggccgggagatctattacatcaagtacaatgcaaatgcacgcctggaaacacatctcatgcataaagatatacaaagccgagttgacaaacttacgagcctttggatacgacaaatggtccaaatggattgttagaccaacacaatgcaagcctgcaagggacaccagatcaaggtcatcaccacctgattggcgaaaaacttcaggaatactgttgcatactgttgagagcgctatcacgattggtaaagggacattagaaagcatcacatcaatgttaccccatcacaaagagatcgatcagaataatggtcgttgtcaaacaagcttcaatttcacacccaggtcagctagcagagcacaaatatgggttgacaaaataagtaaaacatcaatttttattcctagttcattttgtatacagtactcgcgtttgtttagtgagaagagtatagaataaggccaaattggaccatttgatactcatgtgtcccaatgccccttgttatgtcggttcaatgacttttaataccaccaccaacaactcaccacaaaaaactactcctacattacttatcggttatcacaagcataatgcttgtcaggtttgcacaccccgagcacaagttgacatgattaacaaatttcacaactctttgctgccaagctttcagaatcggtcacaccagcacaaaatgcactaagggtgtgtttagtacgttgggtgtaaagttttttatatacggacacaaatttgaagtattaaacgtagactaataacaaaaaaaaattacagattctgcatgtaaactgtgagacgaatttattaagcctaattaattcatcattaacaaatgtttattgtagcatcacattgtcaaatcatggcgtaattaagctcaaaagattcgtctcgcaatttacatgcaaactgtgcaattggttttttccaacatttaatgccccatgcatgtgtccaaatatttaatgtgacgtttatggcaaaaaaaaaattagtatctaaacaaggcctaattctaggatgttctatcagctcattgttttctgcccaaccaacacaaattgtgaaccttaatcacaaattttgtcgtagaaaacagaactgttataactacgttcactcaaggaactacaaaagccttacaagggaatttgcctatgcctctcctaaacaactcttctgattacatgatgcagaacatttggtatgcacaccaatctccacatgtataaaaattacagaccctggcaattatatgtcaggtttgattcttcaatatgccagtgatccacaattaccagaggatagaaaacaccaatttctgagtattgtacaataactcaaatgtgtatgaattttcaccaaacatatcaaattgctctatcaaatcctggtaggctgcagtgatatgaaagtcttctgagcaccggttgtgttccagacttccagggttcaacaacagaacctacaccagactatcatcttatgccagcagaagggcatgtaagagcaagtgactagcaacccccataacagcctgtgggcatcaaaacagacagatctcctggcaaagttatgtctaacaaggctatgaaacatttccttcgctgctctttgagtctttgacaggttaatatacaggcctctcaaatcagaacagatggctctggtcttcttacaagtcaacgttccccctatggaaaagcagaaccacatactatccgttaataaagaactgttcctgatggtaaaaatacacaattaaaaatctgttgttcagtacatgaaacagataggcacaaggatgatgattctttaagaagtatgttaaaatttaccaactctttctgttatacttacactttaaaggcacctgctattcctattcattttgaccaaaaaaaaagagacgagaacaagcaaaagatttgcttgtcttttgtacaagtagagaatgatttataatctgcacttccatcactcagaagaacagcattaccacctattacacagtacaaattttaaaagttgaatgttttttccgagacgcattatggtatttcgaaggtaccaaatgccctttatatttctcctaacacctcctctgctctggttctgctatttctttgtttgctcctaaagtcctaagtttgtaggaatgcctctaggccctagttcctgccttgggttgccatgccgctattcatcgagacaaaaaaaggtcatcttgaacaattcaacattacgagatgttctcaagcgttcagcaataagtcaaaacgtggacactaactactatcaaccacagcatatcacaacaaaatatacagctgaatacacagcttttttacatcaaaacaaaaacaattatagatgtaatacaacagtagggagataagcctattcttagaagtttaacaattagagtatagtgtgtggattgacatgtatgagttatcacgtgttgccccgaggccatttcacatcaaaataaacacatacagttcacatttcataaacctatcaggcaaacagataaccatattcatgtacgaaatatggctgcagtgctgcatcattgggtatagaattttagttgatctcaatgtcttgtaaaaatggattttcaaaagtctattggttcagatagacagagcgcaagcacatagcatgagcgtagctacctacaaaacccagacttattataagagtaagagaatagatgagttccaaaattttttttgcaattacttaagtttcagttatggaacaatggaaattagcacagcagagaaaccatcatttcaattttgtttgcataagggttgttgaaagaagcaatgtgtttctagcacaactcccattcagctctagttacatgaattgccaatagcagcatgtaacagaacacaaatcatgtatgacaatgccagaaatttaataacgttatagcaaatcaaacaaatactcataacaggatataacagccataaacaatagcttaccttagcgaactaattggattgtactgtggcacaagcttgctgaaatgcatctcttttttctttacattaaaccccttttttttcacttatacattaaaagagaacaaatcatcttgaaccactcaacataacaagatgctcaatggttcggcaatttaactaaaaagacatcttggaactaaatatgcaccgatcgtaaagatcaactggtgcgatgaacaagaagcacatcacatactgccaaataccaatatcagtctataccttttcttttttagtctaaacataagggattatatgtaactgacagcacagagaaaaacttactctcagcattttgacaaggtatcaaagacaatatcaagggacctaatgtgcgatacaaatgattatatgtctccctgagtgcagttttcatgaccggaatgcgcacttgtgaagtacatagcgtgctaccaaacaagtctagtataatctgcgggctcgaaaagcatcggcaggcaatgtaggattttatgggaatagcaactgaagatgtggatactgacggaatcagcataactcaattagcagtaactcaaaaacacatcaacgattctgtcctccaaacccaagtgcccccaaaacctaccacaagcgatcccgatcagatccttgccgaggacgggcggcgcaggttcgcgcggcgaggggctggccggagaagacgaatcccggcgacggcgaccggaaatccatggacgagcggaatctcgcgcgccgcacgggctaccgcctcgatcaaccaccgccggaaacgcgatagcacagtggagatagcgttgggggatcaaccaggcgtagatgcggaggcggaggcgccggcgaagcagccgacctcaccggcaaatggccgcgcgagatctccatggccgtaataaccgccgccggcaacgcaaggtcaaaggatatcatgcggcatttgggccccacttctatggcccatgtagcagttcagcattgagagagaaaatcaccccccaaaaaaacaaaaaaaaaaagtaaagtgcattggcggtacttaaacttgtaggttgtgtcatataaattcataaactctcaaaatgcatatccaggttccagaacttgtcaaaatgtatcatctaggtcccaaattgacacattccctctatgatcctatgtggcgctgatgtggcaatgccacatggacgtgacttgtctttttttttcttctttcctttttctttttcattttcttttcattcttgtttttttcctttcttttgcacggatcacagaga

SEQ ID NO: 58385 - DNA, 1025 bp, Oryza sativa
gggttgtcggccacccagattgaagcgccgaccagggcgaccccgccaaggaaggccccggtgagcgtgaggcggtagaaggtgtcggcgacgaggctacccggcggcggctcgagcgctgcggccagagcggcggtggccgcggagacggtggcgatgccgactgcccccaacgtggcctccggttcccggcgatcagcacccgccggaagctgtggcgccatctctttcgctaatccctccccaaaatggacaatctcccgaccggttcctagctgatcaatgattcgatcctctccttaatggatctagctatgaattagagggatctgcggtgaatcagggacgggacggggtgggctagcttccgagttcccaactatgaacgtggaagtatatatattgtgcgatgcgcgccccctgcggcttccagcttcctgtgtgtacgcgggatgcgcgcaaataatttcatggaagttctccgttctgaactttgacgaagggttaagattaaatggatgatggataatgaatggttaggatttaaaaatgggtgggaaattatttcccttagacatttgccaaacactgccaaagcgtcggtgacgtcaccctccatttatgtccctccctctattcgtggtatgtgtcgttactgctgtgattatgatggtgatgtttaatactataatatctaatctaatgttctttgtgtatgatccatggtggtttcgtgtaatctactgttttttcatgtattcatgtccctgtgatgtttaataaattaggcgggtcgttaaagtatgcagtagtactcctggttcctgtgattgccacaacgaagggcctgtaattaatttcttttctaattcaggattctggattgtcgcgggcatggtttccaagttccaagctcctaaacaatgtgttttgtgtaaaattaattggtaaagaaacattagaaacatcacatcaaagatgcaggtcatcagcacaaatgggttgacaaagaatcatcatttagt

SEQ ID NO: 58386 - DNA, 7946 bp, Oryza sativa
  unsure (1)..(7946): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtcatagtgtttggtttgaataaatactttttggtcttgacaaagaaaaataattttagcttcttttcagggccagaagattcagatagaggcaagctgtttaacatgccagaataaaatagtaaacacaaacaggaacagaacatagaaataatgagaattgcttatgtacaattaattaacaggaggtgttcaattgtacataattattcgagagtattattcaaacaaaattgcatagaatctggcaaaaacattaaacttctcatacatgcaaccagatatgacttgcttattaattttttttcacgtgtcaatattcaccacacatccgctcctgcctaacagacatcggacaccgatacctctcaccatatctcgcaggcccacagcgctgggtaagtgtcaatgttggctgtgccaaggccattcgatgataacaatgcatgggccaagacgttataggaagcagttgatctgcctgcatcatcagcgcagaggcaagggatgcagcgaaactgggcaaaccaacagcgtgctggcggttctggtcttggtgggggacaacaccagatcaactcaactcttttttaagacacgtcatggaactgcctaaaatcaaaaacccaagtacagaggcctctagtggtcgccggtggcgaggtacgccatcatggttgacagatttggtggtggaattgttgtacgtgagcaggagggaagtagatatagaagattggaacgagatatgttcggtggggaaggagtaactacactatacttcgctcctttgttctttttttttttactttattcgagtaattagggtattgtaataaggaataataatatattgacatgtggttagaggagtgcatggcaggcgggcagcaagggatcctttgtgaatgaaactcatggtgtgaactcaatattgggcataaatgtaattcttgatcagttgaggaatcctgtttttagctttgttaagtctagcaaaggctaccgaaaaatactatcttcaactcacaaaaaggtttgctgatggttcacctacaggcgcaggcagacaaccaaggattgccggctggcagatcaaccagtgcttttaattgaaacaacacagctcgaaactaagggtaggtttatatcttattatcagttcgcatcacatatccagcacaaattggcccagcaatgccatagctcaaagaaactaagcacaacatttggctttgtagcctagcatgcatcaactgtcacacagaagtgccttatgtccttcaagctgggcaagctttcctgggcagttataggcaagctttcccacagaagtaagatttttattgtcgttagcaaactgctgtccttgctaagctaggataagatttctcttgcctaggatccaaacataccctaaaagatgtatgctcgaacttagttctagtaccacaaactagcacatcatgggcagatatagatacagcaagataagaggtgtcatgtggcatgcatgaaccgatgacaaagaactaagcacctattatttttctcgtgcaatgaatatattgcatgctaattctaaaattcatttttttcagaaaaagaaaaataggaacaggaacaggaacaggaacaatcaagtaaagctatgagagaaagcaatctctttttttcttgctcagcaccactccctccaccccaatatatagggtgtacctgtattttactcaaatcccacaatataagacggcatctcctcgacagccgtttattcgcatgcaagcatttaagttttgctcgtttccattcatatgcatgcaagcattcaagacatcacctcctcggcttccgtttacaagcatgcattattgctgattagtttgcttagggcacccacaatggttatctataggctctctataagagatccatgtcagcatattttcctacttagaagagattaaatgaagagagagagcaaagctatctactaacctggagatagtctatagagaaaaacgaggcaatgtattagagagctatagatacccatgtagacatactattgagatggtttactattattctagtctattgctgagatgtacatgttttatagatagcaccttactttaccattgcgggtgctcttagagcaagtttaatagtatagccaactactagctccaaatcatctatagtcaatttaatagccaattcgtacaatagttacatactacactattaatatatggtcctacttgtcatacacactgcgtcttggagtccgtgctacagctggctacaaatctgtagctcgctgctcttctctctcctcttttatctccttaaaatatgtttatagctggcttatagcctgctattgtacctgctcttagttaaaaggcctctctctcccagcaatacgtgggcgtggcctgctgggatacacactgtgaagatcaaggtccacggatgaagcaaaacttcacgtatcggggcgaacggaacagttgaaaatccttggtctgtgcgtctagagcaggtacgccctatataatgggatggagggagtatatgcttacggtgtaaacttgatttattctatggtaggtaggtaactaccaagataccttcatttccatttttatggtgatacatgtgtaataatatggaggctttacaaaaaacatggaggcacttaaatgtggacagtaacagaagcaattaatggctataactcacaacaaaaagatcagtttccacttttggtttctatttttgatgcaccaacaaccgttagctagggtgagcatccatacatacagaattaatctcgattaacctagcagctagagagcagagcagagagacacacatcagcataacactagcaaatatcgtgagttcgcgaccaaaccctagaagccccaatttatccccccctaaccctacaagtcccgattcccctttggaagtctgtgggcgaggagggattcgaacccccgacaccgtggtctcgtagccacgtgctctaatcctctgagctacaggcccgccggaaatctccaccggatctctacccgtggaagacgaagctcgataagcaatccccataaactcacctacgcagtaccaatcgcaataatcccaaccccaatcgacgaaaccgtttcatgataaggcgacctgttcgctcgaaaccctagaaattgaatcagacccccccccccccaaccccactccacgaaaccaccaccacaccgaaattgcctagcggaacgaggacaaggaaacgagtagcgaaccaacctgatggcagcctcagcgccaccccgggatacggcggccgggctgtacggacccccaccctccccgcgcaaaatccctctcgcttcggggttaggaggcagatcgagacggaggagagacctcaggacctcaagccctacctccgccgcgcgccgccgccgcgccgtagccgcgcttcccccttctcttcgccggcgagagaggcggtggtggtggtggggaaggggaaaaaaaaaagaggagtgcgtggttgtggtggctagggttttaacgcgacggggtcggaactcggaagaggaaagaggaagcccttgacccggtccggctcgaaccgtctggctggctggctccgcggggtgctcgggacgctgacgcgcggggcccacatgggggttgcgggggagaggtgtggggcccacctggcagagggagggtggggggcgcactcgataagcttttctctctctctttctttctttcttccttcccctcccgaagattttgctcgctttctccaacctctcctccgctccgaagcggaggtcggcggcggtggcggcggcggcggcgcgtttccccggcgagtaaggtgaccggctgctcctcccgcacttcctacgcctcgttccgtcgctacagtagcggaggagggcctgcaatctcagatcaggggtacctgtaacccgtttcggttcttggtgggtgggttggtggtggtggttcttgatccatccatccagcggttttggtgcatctgtgcgagttccatggtctaggttttttttttcttttagcatttcgtagtacgtggcccgtggtagatggcttgggggagtgcaatgaaatgctgtgggaaattagcgtgcgtttagcacatagcatctgttcttagtactgttttttttctggatatgttgtggccttgagggtatagattgttgttaatttcgatcactgaatgtgtggcagcgattaatagagtgccatgggataaactttcatggaagtagagtggttcctttttttttctcttttcattgtgctggagcatcatgatggggctaagatcggatgtttttctggttgtggttatgcttgaatgtgcgggtcttctcttggtttttcaatggtctgaaaatgtgggctttgtgctggactgtttgagattttgtgtgctatctttacacggtgatttttcataaggctgaagctgtaaagccgaatgtcgattcttatgatcggcaatataatttatagggtgcactagatctaggagagatggagacaattgtttatactggttcagaccctcgacgtgagataataccctagtccagatgagtggattagatctgtattggagtgcgcagcacggcgtaggaatagcacgtggcgcttatggaagaatgagggtttcccggtgctccttatataggtgcggaggcaaccggctagatatggtagtgtagccttcataatccgggtacctaccatctatttacaagggataggattggccaacttatcccttatctctttcttagtttacaagttaaccatgtgggcctagggcactcggcccacctcatgccgcatggcccaaaacgccttgctatgggtatctgggtaccatgtaccccacactgaactgaactgaaatccatacacacttaataacaactggagctatttttttaaagtgtatcctggaacatttattgaaaataaatagttagaatatttttttctaatttatttgctggatagctagacagatattaggatgagaagggattagcattggtagatctcaactatcaattacttaggggtaaaattcataagccaatgactctgtcaaaacctctctgccactgtttacatttcttaataaaataataagagtacaatactgaagaatgtaaaaaggaaacactagaaatggatgatatttgtttttcctgctttcctttttttacccctttccttgtgttaagcgatcgaccttactatatactcttgcattttgtcattattacatggaaatatcaccataatgtagtatgatttagtgcatggcttcctattttactacatgatcttcatttgccgacagttgaggtacatagaactgccctcacatgctattttttcaagcatcacggcatcccccttttttctttgatgtgagcatcacgacattcttatccaccagactaccactagcatttatttactattagaacaggctgaacagaagccaccatattctctatcaagggctagaaattacaacgttatcaaataaaaggagaaatatcgtcactgttcatcaggatgagctcagattataatggtgaagatttattggatatattttagagctttctttactatacctgtatgaaagttacaattgtgtttctagaaataaacctaagagttatatagcaaatgcatttctactttcaatagactataatctagccctgcaaattgcatgaagaatccggctatctctttattacaagagatactgcacacttttgtgtggttagttcttatatccagctattagattggcagtaagcagaaaaataattcaacagactacctgaattcgtttgctcttgactctctttgtgctgacaactatcattatcttagcaaaatatagtaaaaaattgaacttgtcaaaataattggtcataaatggtgtgcgtgaatttacttatcatcagctatcactgatatcgtaaacaagtatgagagagcacttttttgtttttgcttcattatttatggactttgttgttctggttgtgttgatagttccttttttacacactgttttattaagtattatccacacaagttacaactgccctttttctttttttccttttttgtttaacaatggaccaagcatcatagaacaattaccttattgtccctcttatgttttccaggagaaatggaccttgcatctcaaggtgtggtaacacaacaacaaaaaccaagtggacggagaccggttggaagctcacaaatctggacggtatgtagctgcttctccctttgttttcacttggccatcgtgaacaaaattacatgcagacactcaattttccacagcgatatggtgttctgcttcccagccagcagacacggaagctaaaagaatgggttctaactgacgaacagcaacaactagttaatgctagtggtcttggacatcttgccctcaccacaggatttactattgatcgttctttgcttacagccttttgtgagagatggaacaatgaaacaaatactgcacatttcatgggatttgaaatggccccatcactccgtgatgtttcatatattcttggaattccagtgactggtcatgtggtgactgctgagccaattggtgatgaagctgtgaggcggatgtgtttgcatttcttagagagagccctggaaatggagagcaactgtgtggcttaatcagattgacatggttgtacaggaaatttcatcaattgccagaaaatccaactatcaacgagattgcttacagcacccgggcataccttctttaccttgttggctccaccttatttcctgacacgatgaggggatttgtatcaccaagatatttacctcttctggctgattttagaaagatacgtgaatatgcctggggatctgcagcccttgctcatttgtacagaggactatctgttgctgtaacaccgaatgctactacccagtttctcggcagtgcaactttgctcatggtactgttcttgtttgaataaatttgaatgattgtcgatgatatttggtatctttgttaatgagatttattttgttctctcaaggcttggatttatgaatatcttccattaactcaaccccaacaaaagaatcagaacaccttgctgccccgggcctgtcgatggaactttggaggagcaacgcgtggacagagaaagaaagtcatggaatggagaaaagttttcgatgagcttcaattttctgatgcaagtgcaagtctacctattttatagatttataacaaagattttaactgctgttgtgttattttatattaattaattatattttcaggtcaactggaatccttacaaggacatgaatcctgcaattattccagaatattgcattgcagcagataacatctgctattctcggacatggctaatcagctttaacataaaagaggtgtatgtacctgatcggttttctaggcagtttgggagggaacaaggtcgcctccatggggtgcccatgtgggcaagaagaacttggagcaagtggaaggactggagggttgagtatgctcgtgaaatcgaggagttccatcaattggttggctgtcgtttcactcctgc

SEQ ID NO: 58387 - DNA, 1243 bp, Oryza sativa
ttcctctgatcatccatggtttatgtacaaagtagcagaaaaacttgggctgctgacagttaactggtttatgtagcgtcgtagactttttgctggtagcgccttgccattcactgcgcagagcttgcaagctttatctccttgttaatactatctctctctagtctctaccatgtagttgggcaaaatgtagatgatgccaccaagacccttttaactgtgttgctcgtgaactggattgtgccctctcccgtttaatctgcagctcttgcaacatggtgaattggtgattttataatgatgctaagctttgactgcttgtagaatgatccaagtagagatgtagagagcctactgtgctatcacatcaattcatcagccttgtacgcttggattgtttgttgcaccagctactcctgctgctgttgatcctaaaaccagcttattgatatgctggcagtgcaccattgaaggctcctatagccatatttggcgaggcagtggctagccgaggacagtgttaccatgtgatcagtgatcattctacatgggaaagctaccagtgatgagagcgccacgtttcgccctagcagcgacctctggcacggggggccccacacgtcagcggtggaggcaaggcaaccacgaaggcaatcgccatcgcctgccctttcattgcccaaccaacgctcgcctgcatagaagaagctcttcgccttctttgctgtgctcttgttgcctctcgctcgctgctgcggctactcattgatcctggttagtttgctctctcttttctatcactctcatcgtgtgatatgatatgccagtatttttttttccttgcatctccttcgttcatggtgaatcccggatcgctttgtttgctcctgcattttggtattctttcatcatttcatccttgtgcttatgactgggaatcgcctgtgtggggtgtgtgtttctgttttcctgctgaatttttcaactgctatggatggtctccagcttctgtgtaagggttccatctcatctatggtcttcagttttttttttctcctttcccctttgttttctgtcccgatttccatatttgtggttgggttttagaggatagcggtcaattttattttgctcttcctagtcagttttagaaggaaatggatggttatcggatgtatttcttcgatattttgttccccctcttttgtgtgatgttttctatgattaaaatggtataccatct

SEQ ID NO: 58388 - DNA, 1064 bp, Oryza sativa
tatagcttgagcccgtaggaagatttttatttcactttgtttatttgcccatcaatccttccgttgattttatttacaaccttatccaaaattgtgctgttagcacccttaattagacaaaataatttataaaaacctctaaaataaaaataatccacattcttactagtcattcttgctcccctattccatcatctttggccaccctagctcgttgtcgctggctcctcctcctcgcctccatcatatctacgcaccactattccaccaccacttccccgtctacggtcgttgtcgctttcccctcttattaggcagcaaattggatggacaagcttcgtggctgcacaaatcaggagtagcttgggtcgacaagctctgccgagttgggggcaactacagctaatggatttggcgttgttatagattggaagcggttcggactaacaagctccacggttggagggagttacgaccaatgggatttagcaatggcttgggccaacgagctccacaaaggcttcaaccaatgatgtctttggcggcaagggccagtggcggagccagaatttttccaaacctagggctcaattagttgaatgtatataattttgcctttatcttctagcttttgaagttttaaaatggaatttcaatgaatacttaggatcaggagtagggctgcagccctagctgccctactcttgtctccgcccctagcaagggccaaatatagttcttagatcttggcattgcctatccacaaatcgccaccgtctttagcaagcttgggcacttgcgacgtcgtcctattggtggcgacaacctcttctcaacagcgacggtggtcggcggaccttcctaatcatacgcgcattagaggtggcttattcctagtcttcattctcttctcctccatccctgtttgggacataacttttttcatggaaaacttgtggcttgtagaaggtactcttgttgtcttacactttgtaaacaaacttcaaagtcagtccctttcctccatgatggcatccgagcctacgtgactagtggggttactc

SEQ ID NO: 58389 - DNA, 2300 bp, Oryza sativa
atgacagtttggtaagggataaccgagaagacaatgctaagaggtactgtggcgttgcgactagcgggagctagcttccgagccaacttcggtggcacatgggcgagtggatctggggtggcgcagcatgcgacgaggagcaggacaggtggggtgaggaccaggagctctcaattcagtgtccgggatgatgaggtggccgctgcttgcacatcttgccggtcaccggcgctgcattggtcattgctgctgccaccgctcgcatgcctcgctagtggccctaattccttgtgttgcctctcgcatgccttgctgttgtctcggtggcgaaaggaggtgggagagcgagagatgcagcgtgagagggagaatgggtgccagggactaaatgcaaaaaatggtgagaaaggaggatgtcatctggtgcacatatgttagatctaacggtgaagatgggggttgcgtgtttccacccaaatgagaggttgcatctgaaactttccgcaattacaatggatgccaagtataattttgttttggttagtttagttggtaacatataacatatgaagaaatcacaaatcccagtcattgggagtggaggatgcgcggccagtgcccatataccaccatcaccgtcatcacggttgcatttgctgtggacgttggtggcagccggtacggagctgtgctggtgggtcgatggtgggctacaaaggtagagtacgtgcgagcggcggtgcggctaagcattgagccctacagtttgcggacgtccgcgcagcggtgcagtacctgcctctgcggctctacctagggtgcgggaattgtgtattactttgcatcattcgaccatttcggtaaactgatatagactatcaactgtcctattacctctgttttatagtgttttatatcataagccgctttgatttttttcatagtcaaacttttaagtttgacttagtttattaaaaaaaatatagcaatactttcaatgcaaaacaagcatattatcaaaatatatttaatattgtgtttaataagatatacatgttactaaattttttatatgaacttgtttaaatttaaataaattcaattagaaaaaaattcaactgcgacaatatgaaacagagggagttcagttactgcgagtcgataaccaaacttttttggtctcggtcatttccacgttttggtgtgagtttgtttggttcggttatttttagccagccctatatgtatagagcaatagttaatgaacgcatgcacgtattaaccacaccctaacgttggaaatattaataggcctgatgcatgacaaattgcatgcgcgcacctgtgccggggtcgttgcacgtattctcgcgatcattgccgaacagtcaatgtcaattatatcgacggccggtttgcgttagcgtttgcttaactagtgtactagtactaaatagaagtattgtactactagtatatgtagcgtattcatcgtgaggtaatgatatgatgtcgatcgatcgatcgatctaccgacctgttgatcatcagtgactgaatttaaagctgctttttatttgaaaaccattgctatcttccgtccaagttacgtatgtaccactgccgagcagttattttgcttttttctaagaaaaataaaaaataatatgattttttattgttttagtttctagtaatatgtaaaatttactagctcttctacgtcgtattaaagttgctagtcacattcatagtatgaaaaatttctaaccatgccgatatcattttcaataataaaaagtactttttagaaatttacaaaaatcaccctataagctagaagtttgatgtttcaccccataaattattttgttgaaaatgcctgcccacctacttagttttgtatcaaaaccacctcggtatgcacgtgtttaaccgaatcaacgtgttttcataaattatgagccatcaatgtagtctttaccaaatttaaatacttcaataatatggtcttaatactttttagagattccataaataatgagagcttaaatattgttgaaccaagtttcacaatatgcataaaatagtttaataaaacatgaagaataaatataatgtaagtacttggataagattgactcgattagcatggcgtgtggtatatctatatcaacgataataggctgatttggttaagtacgtgcgtcctaacatgacttttacaccaaaacttagtaaaggtgtgtatttgtaacaaaaataacctatgggatggtttctgtaattttctctttttt

SEQ ID NO: 58390 - DNA, 21896 bp, Oryza sativa
tctccaatagtagaaatcttcacccataaactatacaaaaccatgtaatttgggtccgataatagtatagatgtttgattttgctgacataatatcgtagtcagtaaagtaaacataaaaataatatgtgcgtcccacatgtaactgaagtgagaagaaaaaatattgggcccgcgtgtcagtcccatcacctttcttctcttttcttcctaagcctgggagatggggggcagccgataggacgggagggggggaggaggaggtcggtgagcctgggagggagggagagagaccaaatgcgccggcgggagagcggggagaggaggtcggcgagtctagaagggagagaagaggataggaggttggtgagccttggagggagagagggagagaggcggtcggccgcaccggcgggaaagtggggagagacggtcggcgagcctaggagggagggggaggcaccggtggaagagggaggggagaggtgaccggtgaggttgggagtcatgttcgctgccgctaccgcaatgacgacaaagacgatgacgcacacgcgccactgcgcgcgcccaccgttccaccaccagccccgtgcacgaaggcagcgccgctcagctccagcccgtgcgccatcattgccaaggagacgaaaaccacggagcgcagctcctttccgttaagccactgcatgacgcggtcggcctccatgcccacgctaacattgccacctccccctcccccaggctcgccagctgcctctccccccctctcccactcgctgcatccccctctatcctaggcttgggaagaaaagaggaaagatgatgcggttgatacgcgtgccccacatattttcttctcatttcactaacatgtggacctcacatattatttttattttgctgactaggatgccatgttagcgaaacctagcaaggctagcatccatactactataggaatgagatctaaattgcacggttttatatagtttaaggttgaagatttttggtataggagataagagatgtcaaataaactaaacgtaaagttgagggacggcaaatggacttttttccattttaagcagcggcggtagggttggtaggtaggaagatccggcgccatgtacaaacgtcgccgtcggtcggtatcgttttccatcttcgacgtacacgttgatgttactaatacgtagtactggtaccacatggcagttagacacttaaacttggcgcctggatctggacatgccgacgtagatcggtcatcacacgttcaaaccccaccctgagttttttaaaatgaaaggtagtccctcggtttcacaatgtgactttctagcattgcccatatacatataatgaatctaaacatatatatatatatatatatatatatatatatatatatatatatatatatatatatatatatatatatatgtctagatttattaacatctaaataaatataagcaatactagaaagttttacattgtgaaatagagaaagtaacagacagtgcctacttacttcctccatcatagaaaaaaataatttctgcatatgtttagatacatatatagtcagaagatgattttcttttcttacgaagggtgcatctcacagtgcaacctgtttttatatatatttgttgattggtgagagacaatttcaactccgtacttggtaccttaataggtgtagcggcctattgaaattaagtacacgtatggttttctttatttatgattgttagttggtgtgcaacgtcactatatctgtatcttaagtttgtatgcgcatgatatatatgttcatctaatgaccatcccttttatcaatatccatcgtttatcacgctatatttcatgtctagctttaaaaatgatcttattttcatgggctggcaagtttcaaatttgatccaaaatattctttgatttgctaaccatttttttcaaaaaaaaaatcaaatttctgaactttcaatccatacgtaggtttgtggtttggctttttttttttgattcaaggttccataaccattgccaagagtgccacattatattttgatcttttggccggggtcggaagaggggctttaggtgtgggatatatagaatagatctccatgttcggagggaggtggctaaccaatagcacatgagcatgcttggaagcaagcggtgcagggggatgaggtcggtaacacgtacaacaagaactcaagtggctgggaggtgttggcgtcttggcgagatgtggtgctaagtgttaacaatagtggaggcttagtggatgggaatatcttagctaaagctgcacaaaacatctggtttgaagtggggggataattagtagggaagagggaattgagtgagtgagagagagagagaggaggtggctagtgaagcatgtggatgttatcaaggcaggggttgtgtctagaggaggaagggtgacgtcatcgtgttgcaactttggataaacggaggaaagccattgacagagacagctcccaggcaggtcggacaacctcccaagctccaccgctgccatcttctttgcggattgtctttcgacattaaaaaatcacagagaaacattgttagccgtttggatttaacaacggtattggttccgcccctaaagaggacgagtacggtgagggatttttttttccttaaaaaatgaagtacaggtagacactctcatttatttttcttgaccgaaaagtttctccaatatgaatttggatttccctccgacagtagcttctagatcctaacctcgtttggatgggccaaaatcctgacgaggccacgtctatcagtgatgatttccatcggtttttctgaaatgtacagctgcaccgaaatctcggccaaacggaaaacgggagttttcaactttgtgctgaattttgtcaattgcattgtcggttatcgaattgaaactactccgaataaattctgacaattggttagaatggtttgtcaattgcgtttgttcaatatctgcgctaatcgccaaatctcccccaaaatcttacaaagcaggggtcgacgaggcggaaacgagaacgacccggacactcacaacgggcaggagtgggtctcataataagttcatatttcatgtatccgtttaacctaaaaataagttaatttttaacaattattgtattattccatgcttccaaacgtataagacttattccattcttttgtttttttaaaaaatctaagtccaatttatagttactatgtgttaaattaagttgttgattagaacccaaaagccattgagggcggctagggaatgtatcccgtctgaacgggatacttgagattgacatcaatgctgacgtcattatacgtacgcggtaccacgtatgatacctacactactacgaaaacgatttttccgtgtggtccaaaagggttttcgcgtgcggatctcccgcccatctgcattgaagtgtcagcaaaaatccgattttttcgtgcgcacgcgaaaatctaattttcacgtgcgggtggcttatgtcgcaaaaaaaaaaaaaccaaaccctaacccaagccgccgccctcctcgtggtcgccgtcgtcggcggtggcgttgccgccttctgccgctaccggccgccgcggccggctcccagcagcgtcgctgccgcccaccgccgaatctgggcgggagaggggcgccgccgcccactgctggtcccggccacagccagggttttaaatttcaaaatacgattttatgccagtggggggcgaaattaccgaaatttcggaaatttctagccgaaattatttgaaaatttgactgaatttgaataaaatttgaccaaattcacaaaaacttgcaaaaaaccaaaaatttcgggcgagatttgagtatgccggtgggggtgaaaattaccaaaatttttgaaatttctaaccgaaatttcaaaccctggccgcagcccacaagcgaggccgtgctaccgtcgcccgtgagagacgagagagagatagaagaaatgaggataacgatgagtaggtggagaggataagatagaaatttttgaagtggttgagaggggaaaaatacctgaggagggtatttcgcgtgcggtgctcttaagatgcccgcatgcgaaaatttattttcgtgtggtccgcttgcaaaaataggtttattttttgcgtgtggactcttaaaaggcccgcatgtgaaaaccgatttttgtgtgtggtcctcttaagggtccgcacgcaaaaatgggaggacaatttttctagatgcggtcagttatggaccatatggaatctaacgaggggctcgtacaggaaaatcgttttttagcagtgcaattagttccaagacatgatatttgtgtaacaggtcagataccctataggtatcatgtcaaggtacaaaaacatgatacttaagtaacaggttagataccctataggtattacgtcaatgctgatgtcactgtatacgtatacggtaccatatatgatacctattggtatcgaacatgatacatgagtatcaagtatgatactttatgagtaccaagtatgatacctgcatgtaccagccatggtacctgggtaccaagttggtacctgtaggtaccaagtccgatacttatatataccagacttggtacctgggtaccaggtccaatacatataggtaccaaagtattatgatactactaaagtatcatagcacactaagaaccaaaaatcatatcttaccaagacagagctcaattaaaccaacaaagaaaattgattccgggaaaaaaagtcatcatagtggtagaaacacccatagaacatgtagaacaccccaagatcaaacctcaaacccaagccaacgcaaaagctcgggggtcacgagccaagatctaaatatatggatccgcaccacaagaggccttgtcctcgatgatggtgacctcatcgacgatggccacctcctgaaacgtggtgagtagctctgtcttcgtcttgtgcttgggtacctaccccacgataagcttcacgatctcctcctctacttcgcccacacctccagcgacagcagcggcgacaatggtggcggcagcttcctccactcccgacgtgccatcctgaacggccagccgtcatcgtcgcctctttgctggtggtagtcagagagagggagagagagagagagtgaaggggaagagataaaggagaggataagactgaatatgtggttggcgagcgagaggatatttacagtagtagttatcccgtacactgtcccatagtttttctgaaaggcatttgattacttattggttgcatgttcattagtttttctttaggaaactacggcgggtttgaacaccagcctgaactttattcatatggtaaataaactttacaaaggggggaggtacagagggacggggagaagaaactatcattagttttatcacattgtgaatgaattaattacttattagtcttggtgccaaaagaaataggtcttagatgctgacggagcgtggggctcctcaccgggagaccgcgcaggcccctctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttacaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttatctgccgatgacgcgaccggcgtcagaccagtcacagatcggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctacgctgcattaaatgcggcgtggggcgctcgtccaacccgcaataaacgcggttaggtgagcgccgctgtgctcacctaacccacacacgtggcgccaaacccatagggggtcggggcgccccagctctcggggccgaaacgggagcggcccgacccctcggggagacagagggaggggcggccacatcaccctcgggcccgaccccccccccgagggggtcaggccacgtgggtgactgcagctgccccaaacctctagtcaagatacccccggtcccatgtcaccgacagtagcccccggcgttacgccagggcgatcgcccccctcgagggaagcgctcgggcgtgacgccactccttagacctggtgacagatggggccggtctctacaggcagcagaaacccagcggtcgcaaatcgcgcacatcggcaaggaaaaaccgaccgacaataatgagcggctttctttaagaccgctacattacttaagtagcgcgcgaaccgggacgagccagttcgtttcgcctggagatgtgatgacggtgcatcggtcggcgagcgtagttaacgcgcgcacgatatgtcccatctcgactgccacggccgcacatccgcctcgtgcgccgcaaacgggcgagcgggattagtggaggcgtgggcgcgaaagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccatttccggcgccctacccttgccatactcgctcgctctcaagctcctcctccgccggcgtcatggcacggggctccgcaccgctcgagggtagcgtgctgccgccttcccgcatcgtgagcgagaggcaggccgggctgccgcgccgattcatgccggaatctgccaccggccgggaggtggtcgcgctgggcgagggacgcccggcgccgcattacctggggcggtccgtcttcttcctctctttcgcaatggcagggctggtcccgccattctcttctttcttcatggatgttctggagctttatgatctccagatggcgcacctcacccccaacgcggtaatgacgttggccatcttcgcgcacctatgcgagatgttcatcggggtgcgcccatctctccggctgttccggtggttcttcaccgtacagccggtgtcgccaccgtcggtagtcggtggctgctacttccagccgcgggggccggtgctgaaccgctacattccctgcgtccttcgcaagaagtaggacgactggaagagcgactggttctacacccctctcgccgacgaagcgcgcctccgacttccgagccagcccccggcgcaggcctccagctggcgggcgccggtagatctgggagatggctacgacgccgttcttgaccgcctggcgggtctgcgatcccaggggctcacgggggccatggtgttcggcgactaccttcgtcgccggatcgcgccactccagcggcgcgcccggggcgcctgggagtacaccgggtccgaggactacatgaggacccaccaggggggcagatgggactgggcccctgaggatttcaagatggtggtccaacgggtgctgaatctcagctccgtggaggcatccctcatcccccaaggtgtcctctccctctgcagcgatccagagcgcgccaacatcctgaccatcatgcaagcggtcggggcgtcaggggagcgggctcctcgaggccacgatggcgcgggcgggagccgcaggggggaacaatctaccccgggagggggtcgtgcttctgggccccgtgatgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgagggggagcgaaaaaagaagcggctccgcaagatggggggggaccgaaccatgccggggaaacctcatctcccccccaaggtggtcgtttagccgacctcctcgcaggttcgtccccgcgcccactgcggccgtattcattctcccaaggtgagttttcacttacccgttttctttttgtcttctggtttttcttccgctttcagcgagattccgtcgcgcccccctcgccattccaagtccggccagtctgaggccgaggagacagcgaccgcggaggcccggaggcgggaagctgtccggcgagaagccgcggaccgcctccgggaagctgaggaggctgcccaggaagccgtccgggttcgccaggctgaggaggccgctcaggaggaggccagactccgccgggccgggaagtcagcccgggaggcagaggcgacacgcgcacgccaggcggcctgccaagcccccgacccgactccgcccgaggcaacgacgacttccgaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgctccactgaacacagagcccctcctgcaggccctggctgccgcgaacacgacggtgctggacgggttaggtgcctagatggaggtcctgcaagcagagcgggcggagctcgacgcggcgtgggcgcgcgtcgaagaggggcagcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaacacgggagccgggtggcggagctagagaagaaactcgacgccgcccggggagtccttgacgccgccactgcacgggaacggcgggcgacggagaacgaggcggcgtcccggcggcgcgaagtggcccttgaggctcgcgccacggcgctggaagagcgcgcccgcgcgagggagagggacctggcggaccgcgagaccgccatcgctatccgggaggcaacgctggcggcgcacgaggccgcctgcgccgaagaggagtccgcactccgcctccgcgaggatgcgctcaccgagcgggagcgatctctcgaggaggcagaggccgcggcgcagcggctggcggacagcctgtccctccgcgaggcagcgcgggaggagcaggcgcgccgtaatctggaaggcgcccgcgccgagagggccgcactggatcagcgggccgctgagctcgaggcgcgggcgaaggagctggacgcgagggcgcgcagcggcggggcggccgcgggcgacggcgatctagccgcccgcctcacagctgccgaacacaccatcgccgatctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgagcggaccgcgaagtacgccgccaaccagggggggcctcgcccagcgcctctcagagatggccgggactctccagcggctccccgaggagctcgaggagacgatcaagtcatcctcgagagacctcgcccggggggtagtggagtttgtactggcaagctaccaggccagggacccggacttctccccgtgggcagcactggacgagttccctcccggaaccgaggacgacgcgcgcgcgcaggtccgggacgccgccgaccacatcgtccacagcttcgagggtacggcccctcggctcgcgttcgccctcgactccgacgaggagggcggcgacggtggtgtggacgacagcgaccacgaggccggcgacccgggagcctcgaagtgagcccccaggcccccgccaatcttaaaagtttttcctttcttcttccgaggccttcgggcccccttcttgtataaactaatttaatctgcaatcaaataaagaagaaatttctgtgtcaattttatttgttgtgtgtatgagacgaggatggtctgtgccgcggtccttctgtgtcttggcttgaacaagggctcgtgcccaggtcccagcttcaaacggcgggggtcggggctagtgcctggggagatccacgtgtcgagactagccaggccgggagcgtggtgaccgagggttatggggacccgattgtgggcctttgccgattcccccccggagttcaccactccccggggcacggctcggttctgggccccgtttggcgatttccgccggcccgggccaccgagggcagggtcgagcacgagcgtgctaattcaagccaaaactcttcaaaaggaaacaatggcacagacacagtccttaggaaatcgaaaaagcttttattgaaatacggaagagaaaaaagataagtatatgcatatgtggtagcccccggccaaccctgcacgcccgaggggggtgcggggttggcccgagcccgagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttactcagtccagcacgcgtttggacgcggcgtaggacgaggtcgtctacgcagagtgatcgggcccggacgtgacgctgatggtagcgccgcaggctctgctggtagcgcgcggctcgaagggccgcgcgccgccttcgttcttccaagtagtcgaggtcatctctgcaaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctagcagctcctcgatccacgagtcgccgtgcttcttgaggaatttgaaggtcttggttttgaggcccttgaggatttctgcgttggcgcgctccacttggccattgcttctggggtgggtgggagaggcgaagcagagcttaatgcccatgtcttcgcagtagccaccgaagagctcactagtgaactgggtgccgttatccgtaatgatacggttaggcaccccaaaccgagcagtgatacccctgatgaatttaagtgcggagtgcttatcgatcttgatgaccggataagcctcgggccacttagtgaacttgtcgatagcgacatacagatactcgaacccgcccggggcccgtctaaacggacccaggatatcgagcccccagacagcaaacggccatgaaagaggtatggtctgcagggcctgggccggctgatgggtttgcttggcgtggaactggcacgccctgcaccgccggaccaggtcgaccgcatcgttgcgagccgtcggccaatagaaaccctgacgaaaggccttgccaaccaaggtgcgtgaggcagagtgggctccgcactcgccttcatggatatcggcaagaagctcgatgccttgttcccgaggaatgcacttcaggatgactccgttagccgcgtgccgatagagggtcccttccaccagcacgtagtgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgacggctgggcaagcctttcttcaaaggcgcctggtggggtctgggctcgcgaggaagcgagccttgagagttcgtcggcgaccgcgttatcccgtctgggcacgtgccgaagctctatcccgttaaaatggcgctccatacgccgcacctggcgcacgtaagcatccatctgcgggtcagagcactggtactccttggagacctggttaacgaccaactgagagtcgcctaacaccaggaggcggcggatccccagtccaaccgccactctgagtcccgcaaggagtccctcgtactctgccatattgttggttgcccgaaagtcgaggtggaccaggtatttaaggacatctccgctcggcgaggtcaacgtaacccccgcaccggcgccctgaagagatagggagccgtcgaattgcatcacccaataggcggtgtgaggcagctgcgaagggcccgagctgacctcggggatggagacgggctcgggagccggtgtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaggacgtaaccaccgtgacccgatgcgcctggaaataatggcgcatcgaagccatcagaatagcgtaaagcatcttctgggcctgagggtattgggtcttggcgtcccggagggcctcactaacaaagtagacgggccgctgcaccttttgtcggggccgatcctcttcgccaggggccgcatctccagggcgcttttcgtccgagaggccgcgcggggcgcactcggcttctgtgtcgacgacctcggggtcggaaggcgacaggcgcggccttcccgcagtggccccggggccatcctgggggtcgggggctcctggcaccgtcggacaagcgggcagagggccagctccggtcgtcgggggcctcgggccgccgttcggctcgggggcctctcctccctgctctctcccgggtcgagtcgatacagggtgctctttgtccgagaggccgcgcggggcgcactcggcttctgtgccgacgacctcggggtcagagggcgacaggcgcggccttcccgcagtggccttggggccatcctggggtcgggggcgcctggcaccgtcggacaagcgggcagagggccagttccggtcgttgggggcctcgggccaccgttcggctcgggggcctctcctccctgctctctcccgggtcgagtcgacacagggtggggatgcgcggagcgagggtcgtcctcgtcgcgctccacgaccaacgctgcgctgaccacctgcggagttgccgccaggtagagtagcaacggctcatctggctccgggacgaccaggactgggggagaactgaggtacgccttcaactgagtgagggcccattcagcctcctccgtccagataaacggcccagagcgtttgaggagcttaaataggggtagcgccttctctcccagcctcgatatgaaccgacttagggcggccatacagccagtgacgcattgcacatccctaagcttgctgggggggcgcatccgctctatagctcgtatcttctcggggttggcctcaatgcctcgggcagagatcaagaacccgagaagcttgcccgcaggcacgccgaacacgcacttgtcggggttcagctttatgcgggcggtgcggagactttcgaaagtttccgctagatctgagagtaaggtctcctggttgcgtgttttcacaaccaagtcatcaacataggcctcaacattacgtcctatttggctacccaaagaaattcgagtagtacgttgaaaagtaggacctgcattgtttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcggatgaatccggcctccagaagtcgcgccacctcctcgcggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctgcttgatcgggacctcgtcgcacgtgatcatccgctgcctcggggcggctgggacggaggtgctgagcctctcgtcgccacccgcgggcttggatgccgcggcgaggtggtccgcgcgctgctccatgcaagcaagcgcgactttgaggtcgccatggacggtgatggggccaccggggcccggcatcttcatctggagataggcgtagtggaccgccaccatgaacttcaccaacgcgggcctccccaggaccgcgttgtagggcagactgaggtccgccacatcgaagttcacccgctccgtgcggaagttggcggaaccaccgaaggtgaccgggaggtcgatatggcctagcggccaagtgtgccccggcgtcacaccgatgatcggctgggacggccggagcaccatccccggggccttgatggcgtcaaaggcagcgggggaaaggatgttgagggctgcacccccgtcaatgaggacacgccccaacttcacattgcaaacggtgggagaaaccaccatcgcgatctgtcctccccgggcaacgcacggtgggtggtcggtctggtcgaaggtgagggcaacctccgaccaccgtgcccgccgcgtcgcctcatgggtaggggccacggccagaagctctcgcttcatggccttgaggctccggtgagaagcgtgagcacacgctcccccatcaacggtggcgacggtggcctcaggctcctggaaccctaggtcatcgtcggcatcgttgatgtcctcggcgggggccttctgcttggcctcaccacgccggttgccggcgggagccgccggggtattgccctcacggcgctcctgcctcctctcctcctcccacttcctcgtccgctcagccaaacttttgaccgcgcggcagtccacgaggtcgtggagggaggtattgtgcacggtgcaccacctgccggtcgggcgctccctactgggagcgccggcctccttctttttgtcgctcgcaggcctcccctttcgggtggcccacaaagcgccctcgacggcgaggacgtgaccctcgtcgtcggaatgggccgacctcttcttcctcctcctgtcccgccaccctgaccgagcagcggatccgggggcggccgaagctgccacaccggaaccggaggagttccaggtccaggcctcctccttgcgagccacacggtccgcgagctgaaaaagctccgcggtggtctggggctccttggaggcgatcttctcgagcatgcggttgtgccgcacaccccccctgaacgcgtagatcaccgcgtgtgcagggatgcacggtatggtgttgcggacttgacaaaaccgctgaatgtacgagcgaagagactcatcgtcccctcgctgtaccgcgtgcaagtccgcttcttcacttgggcgcggatatgtgccttggaagttcatggtgaactgctggcacaaatcctcccaagagtggaccgacgcgggtggcaagttcattagccaaccccgcgcctgtcctttcagggccatggggaagaaattcgccatgaccctgtcgtcacccccggcggcctcgatcccaatcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacatggggggctggcccccgtgcccggaccgaagtggcgctccggacgaggaagcgccctccgatgcgtgggcagcacggcgatcattgcgccggcgcttgatattgaagcgggcatctggccccctacgcacatcttcttgggttggaggcgttgacgagggaatggcggacgaacggcgggtagcggccgccgctcgccgcgccctccgcctcgacgacacggagccagcagtagcaacgccagtggccttggtggcggaggaccgccagccggcgcctaggcgctgctgcgccgtcatgaccaaattggccacgtcatctagccaacgtcgggttggagtctctggatcagggatgacgggtgggtgacgcaggagtgcgcccgcagcctggagcgcgccctggggcgtgctgccatctccgtagacgaggagacgacgctccccgtctcgccgtccttctccatcgcccgcgtgcggcgaagtcgcggatctttcgacctcctcgagcgcctcctcccgcccaagacttcggcgagagagggacagtggagtacgagctcgacggcgcgggttctgctccccgtcttcaccgctagcgctcggagagagattgtgcgccactgcccgttcggccattgggctgagcgggagaagcttggcgcacacgaaagaggacgagggcttagaaaaacacacgcaccccctacctggcgcgccagatgacggagcgtggggctcctcactgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttccctttctttggtgggcaaggtcctccttttatatctcaagggatactacatgcaccacttctacctacctttcttctgggtggggacctaccctctcttgaccaaaacttggcttgcaccttcgcctggaagctaaatcacaacttgtccttgagtgaggctcagcgccgtctctcgcctgacaccggggatctccctgttaccccctcattaatgggcggagatttgccatggctgctttccaaatgaccatccgacgagatgggtcatacctacctccactccaccggaggcagatgcatcgtgggagcacggttatctgccgatgacgcgaccggcgtcagaccagtcacagatcggtcattcttgtccaccacgtgtcagttcggcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgtggcgtggggcgctcgtccaacccgcaataaacgcggttaggtgagcgccgctgtgctcacctaacccacacatgtggcgccaaacccacagggggtcggggccccccagccctcggggccgaaacgggagcggcccgacccctcggggagacagagggagggacggccacatcaccctcgggcccgaccccccccccccccccgagggggtctggccacgtgggtgactgcagctgccccaaacctctagtcaagatacccccggtcccatgtcaccgacaatccccatgtttctaattatatagttttaaaagtcacaccagttgctaccacttatgtcatctcctcctttacttgcttgctcgatctaccactatttctattcattctctttggaatttttaaaaattggatcttatagttttaaaagtttattgtcacgttgggtttcgtttttttaatttctatatgtcccgtcaaacgttgccattatactcctctatggcctgtccactatctcttctctttattatcattgagattttaaaaatcgaatataattatcgtttgggttcatttttacttctagaagtcctgccaaaccgttagcggctttgccattgtacttctctacagctcgctcgctgcctcacttttttattgtcattgagattttaaaatcgaacatgattatcattgttttttttttactttttagaagttccgaacctttaaaaattagggtttcattttttataatttttagaagtcccgtaaaatgatgccactatgcttctctatggcccgtccgccacctactctttattgtcattgtgattctagaaatcaaacataactatcgttggaatttatttttattttctagaagtcctgtcaaccgttggctgctctgcaactatactcctataaaccccgctcgttgcttctcctttttatagtcattgagattttaaaaatcgaatatgataatcaaatggggtttatttttttttactatctagaagtcctggcaaccgccttgctcgttttcttcatggcctgctggtcgtccctccttttaatcgtcattaggatctatttggtgttttatcaacagtttttatatgttgtatcaaccgtcaccactctactcttttataggtatgttacttaatttatctcgtcatgtgttttagatggtcttttctttcaatagtctttatttttatcacaaattttagttatttataaattttattcctaattgaaatcttatttttatttttccaattttagaatttatttttttttcaaattttaattaatatcatattgtgttcttttaatttttttatttttttattttcaatttcagttgtttcaaaattgtattcctagttgaactctcttttaatttttctaatttcagatattattttattttttattctgaattttcattaatcttgtattaggttcttatatggattcttctttcaatattgcttatttttaattctgaattccagctaattttaaattgtattcctacttgaaactcttcttttatttttttgctaatttcgaatttttattttatttttattcccaattttaattaatctcgtattgggttcttatatggactcttctttttaatattccttatttttaattccgaatttcaacttttttaaaattgtattcctacatgaactatcctttcttttctaattttggattttattttatttttttcaaattttgattaatctcgtattgggttcttacatggaaacttctttaaatattgcttatttttaattccgaatttcagctatttttaaattgtattttttacttagactctccttttttttctaattttggattttattttatttttatttcgaattttgattaatctcgtattgggttcttatatgaaaacttctttcaatattgcttattttaattcctaattttagctatttttaaattgtatttctacttgaactctccttttctttctttttcttttttccgattaatgtgagaatttctagctcccagagtgaacgcagtggctacttttaaagctgttttaataatataatagatagatagattcggcatattttaataaaaaacaagatactaaacatgacatgtgaataacaggaggatgatcaagtgatagtactaaacacaaacatgctaataacaagaataatatcatctagtaacatgttaacactaaagtgaatagagtgatatgcggagaacgctccggattcaaaggcgatggtgttggtgttgtcgctaccgttgccattggcgtctcctccattccattgctagtcgacgtagaggaagaccgttgctgttggcgtcttctcctccattgctgctcgacgtagaggaagaagaacctggcgtagaggaagcagtgtagagagcttattgtctatcggttccgctttctcataaaaacagaaaagacaagaaaacgagcggctggctcgccagccccgttgctccgctccgctaactcggcccggttggctcgactcggcgcacgagcgcgcggtggcagttcgaccaccatcttaaccgctcgacatgtgctctcatttagcaacttacttctcattggttccaaggtgggattaatcttttaacattaattgtgtgcctttgaaattagtatgattaaatcggggctagcccatttaattctaacaataaatatgcagattacaaaatacagaaaaataaaaaacgaatgtttgaatataatgtgtaaaagagtaggaattagaaaaaataagtgcttaaatatactgtatagaaagaaaagtaggaatttgtcgacgggctatacccgcagacgggatttgtagagtatgggaatcgttggaacctgcagacgtgagatcagatcgagcagacaaggaaaaagatttatactgatttggaccctcaaggatagtaataaccctaatctagattatatggatttatggatggaatatcaccaagattacaatgaggaatttcacgactagactaatccgccgactagaaactgtcgaggacggcccgaggagatctactcggcgaatacggctatgacttcctctggattgcttctcaatgtagctttggctatggcttgtaattcgatgcccttccctgaatacgggggtcttgtatatatatagtgtagatcatatttttccctgaataggatttgtcggtgatatgggtccaggggtatcagggccatagagaggaggctgcccccgggaggctgcccccggtagccacatggccctccccctgaggggggtcgggcccgaggcagggtggcgaccgccccctccatgccttggggtcgggttacctcgacacccttcgcacggtgccgcgtgtgctacgataggtgggcgccccca

SEQ ID NO: 58391 - DNA, 3573 bp, Oryza sativa
ccgacccctcgggaagacagagggaggggcggccacatcaccctcgggcctgacccccccgagggggtcaggccacgtgggtgactgcagctgccccaaacctctagtcaagatacccccggtcccatgtcaccgacagatgcgaaagggcctttagcctaatggttacaagaaccacagtggtacctgaggtcctgggttcgactccccataggagcgaattttccaggatttaatggcgtttgtgctttcagtggtaggcgacgtacccgtcgacagcgaggcgcctgtggtgacttcgtcaatctctccagaatttgccgacccagtcttcaaagatgctcataggggtagggtggccagcgaggcgcctgtgggggtagggtttgcatgcttgagttcatagggtacgtcgccagaatttgccgacccagtcttcaaagatgctcataggggtagggtggccagcgaggcgcctgtgggggtagggtttgcatgcttgagttcatagggtacgtcgccagcgaggcgcctgtggtgacttcgtcaatctctccagaatttgccgacccagtcttcgaagatgctcataagggtagggtttatgtgcgtgtgttcataggggtgagtgcgcgtgcgttgtgagtgtttgcgttgtactgtgtaatttaaaaaaaataggtcttagatttttggatgaaaggagtataaaagtagagaataaatatattgaagtataaaatggaaaaaaactatattgagatttgataaaatggaaatattctattatctttttatgctgcattaatatgtgtcatgtgtgatattgaataacgaacttactttaatacggaggagtattttccttgaaccgggatgatgaaatcattgaaaacgcggaggcaagaggacgtgcaacacgtgggatagcgccgacgtcggcgatctgttctaccttctggaaaacaagtctgcaaaaattaatttctgcctgaggcagtgaggctcgcttgtcagtcacccgtatacgtggaaaataaattttctctcgctttctcacgcgggtcgcgaggaactctctctctctctctgtgcacaccccgggaggaggaaccgagggaggaggacaagtcagagcaaggggcctcgacggcggcgaagccctccaactcacaggtgagagaccccccccccctcgcctcctcctcttctctccggcgacagcgacggcgacgagcgagtccgtgtagatctccgaccccgtagatgggttttgggaggggggcggtttaatcggcggcgcggatggcgtccgtaagactccgtaccccgccggggaatccttaggttgctcctctattgctcttggagtacacgccgcagccgctacccgtaggccttagcccgatggacatccatggttgggtggatctgaatggagacggattggagagagcaagtaggatggaagtaatggttatgatgtctagctgatgaatgtactttatacttaactaatagtactaatacgcaaagctttgttacaggaagcccaagattttccccgtgaattcctgtttttctccattgctccatccaaattttgcctattcctatgtctttcaaatgtttgcgataggaggcctcaaagggtctagttagtgtataacactgtactctgtaccgcgaagtagtgcctcaggctgtgaaatgtctgctgttcctttgtcaattgtttggatccctttgaacaatggaaagcatacaatttcatggaaggttattaattacatttccctgttaggttagttctgttatgccatttcagtactaatgaacaaacagtttgtccacctacgtgtcatcacttggcttgatagtgctgcaaccaacctatgtttatgtagaaagctgaggcatatttggattccctttcgtaggtaaaatctgctaaatattgtttgagttttctggcatctgcttcagatatccattcgctaatgactaaccaatttaatcacagaaacaccaatatctaaagcagcttaaattttgaaaccaaaatgcaagttgtattaaaacaattccatgaaaatcttgattatggtaatacatactttctaatttcattttgttggtgcttttgttttcttatgtgacctgtttttgaccaattgttatctcaaaatatatgttccttcctcctggtgaataaacttgaatatatctatctacaggcgccatgtcgatgtcactgttccctgggatggatcttacgaaaatggatgctcctactcttaccctccttggagcagcctgctgtgtaatgctatcgatgcattttacagtacagttggtgtcgcagcatcttttctattggaagaatcccaaggagcagaaggctatacttattatcgttctcatggctcccttatatgctataaattcctttgttggtcttctggatatcaagggaagcaaaacatttttcactttcttggatgctgtcaaagaatgctacgaggcactggtgagtccttttgggttaaccacattcttgcacccaatgccgagattcactaaccttctctctttgtttcactatgtaggctattgctaagtttatggcactgatgtacagctatttgaatatatctattagtaagaacatagttcctgatgagatcaaagggagggtgcttcatcattccttccctgtttcccttttcctggtaatttccttaatccttataccctggttcattctttaaatgtttctataatctgtaattgtgcttgagtgctaagatttctgtttgattacttctttacatagcactatatattgattaagttttgatgacttagcataataccttccctgcttctcttttactggcattttatcccataccatggatcacctttttgtacttgaattttaaatttctatttcattgcttccttatatagcattgtctggaatctggattaattaaaccaagttaccatgagtggtaattttttactataatatcaacagcagttttaatctttctcttaccaaattctcctgtatgcatgcacctaaagcgatgacttaaaaatctgtctgtgcatcacccttctacatttttattattcacctacaatctgcagaggtagtctggagctttcagcacttcagtttatagtttgagtcgatgttgtcctaagaacctgtctttgcatctcccattctcccttttagtgttctatcttgcacatataatctgcacaatctggaagtttattctttcagaacttaagtttgtagttagactttagggtgttctattacttgcttcacttctatctgttcaaaaaggaattaatatatttgtgatgttttgctatggcagccccgcaatgttcgattggagcataaaacactgaagcttctgaagtactggacctggcaatttgttgttgttaggcccatatgcgccattctaatgattactcttcagcttcttggtctgtaccccagttgggtcagctggacattcacaatcatactgaacttttcagtct

SEQ ID NO: 58392 - DNA, 7190 bp, Oryza sativa
  unsure (1)..(7190): unsure at all n locations
gatttaattaggtgctcaagatacaccaccatttctttttgtacatatagttgtttatgaattgaaaaagttcttctgcaacttaagtttttatgaactgccatttgaaagtcagatttggcaatttcctttatgaagtctcataactgaacaactatatgccttgttaccaattagtttagaaagaaagccagagtaagttgttaaacaagtttaattagataataaatcaatactgagcttttcacctttaaggcacaataagctgctatatcatactgcttaaagagacatccccagtggacaccttctaaagagtgcatgtcttcctcttttgccatgggaaacataaaagctggaatagtttttaatagttctcccattctgttcatttcttatgattagtgattgagctactgaatgccattgtctttttgcagggttttgcattagaggttttagctgccgtagggatcattcagtcccaccatttctggttggacgtggagcacatccaggaggcaatccagaatgtcttggtgatcatcgaaatggtcttcttctccgttctccaacaatatgcttaccatgttgctccatacagcggggctgacagggcgaaattcgagaagaagaatgaatgatccaggttttgtactgagtaataccctccagctcttgtatgatatctctctgtatggactcacagtgttataaactcagtgtttcttatgcacacgagtagagtaagtacattacaatcattagaaagctagaggtgcctgaataagtggtggtttcgtcttgttgtacacaatatcatgttggactgaggatcttgtgtgtacactgtacagtgcagcctttggaggcaagcaaatccattatcaataaagctatgtacttccaagtgccaatcaccaactgtagagccctccctcccccaatgcattgagttggtgaatgcaaagttattcagggacatcattaatccggttaactggatacaccgtatttaactagcccggtctggactctggaccacggtcgtgggtaacttttattgttctttcaatttttccatgtgaaaatttgttccagatagtcattgcctctggtcacaagttgtgactctgcaacaatgtcgatcgagaacatgtgttaccctctctttctgcttctgcctctttcaccagctgggcacggtgaaacaagggcgttgcatccagcatcgccgtggcaggattcttgacgcgagagcagtttgtctgcagcgatttgctccgtcgtatcagcggcgacgagaagaaaaggagaaaaagagtgggggaggaaagagatgagtactccagacgtccagtctgtctgcagtgctgtgtgcagtgtagggtaggttgcctgaaatcagaggcgaagtggggcacgggcactagtagcagcagctgtgcactcctaggccgggcctgtagctgctgtgttgtgtgcgtaagcggtgggggccatatgtgcaactcctgtagattcctagtacggcctggcttgccttcccgtgacctatttttgcatcgctttaagctcggccgacttttaaccagggtcagaactcagaactcagaagtgtctcctcttgccttgtcctcctcctagctagcggctgataatagtgtcacacacatcttggtgtcaacttataaataatgatatgccttctgtttataaaacattactagcactgaagaccgaacggatgagtaaattttattttaggctatgtatttttataaattgttacaaggggtttctgttagcacgtccggtttatctctatccacatcaataatgccgactttagtttcaatccttttctttaaacttctaactttttcatcacatcaaaattggaggtttggttgaaattgaaacgatatgacaaaaaagttagagtttgtgtgtgtaggaaagttttgatgtgattaaaaagttgaaagtttgtgtgtagggccgagtttagatccacagaaacttccaacttttcccatcacatcgttctaatttcaaccaaacttctaattttagcgggctagtatgtttcattatcggcgggaacatggatagccgagaaagcttatcagccagcaacggtggtggcgctttgtttaaggctacggtaagaaatgcattctgatgtaacgattccatttttctttacaaagtataaaaatgacaccttcagttttgaagcgaatgttcacatatcgtacgtcataaactataggtccttgaggtggttgtgattatcatcaaatacatgtcaatggaaaaaaaaacaaccatgttctagtcagtgccaaaagaaattgatctttcggtcgtagagctaaattcgatgaggattagaaaatgcaataattaaacatgagcgcatagttgccaaatgtttttgaggaaaaaaagggtatttttccttgctgttgatcgagaatcttgcctaatgtcatggcaagtccatcttttgcggttgcgcgctgtttagatcccaccccaaaattttacaccctatcacattgaacgtttaaacaccggcataaagtattaaataaaggataaaaaaataactaataaatattacacacattgcgactaatttgcgagacggatcttttaagcctaattgcttcatgatttgacaatatggtgctacagtaaacatttgctaatgatggattaattaggcttaataaattcgtctcgcggtttattgatggattttgtaattagttttttattagtgtctaaacaacccatgcgacaccctatagaatatccgatgtgacacaccaaaattttacacccctaggccgagtttagttccaaattttttcttcaaacttccaacttttctatcacatcaaaacttttctacacacacaaacttccaacttttccgtcacttcgttccaatttcaaccaaactttcaattttggcatgaactaacacacctctagctttaaaaaccccagagttctttgccagcagtacagtgtatgcgcgaaaaggaaaactgcgagctgccataccacatcaccctgggcctagtcatgcatcctgactggagaccttgtcactttgtcagcactcagcacgcacccagccggccgaccaccttcatcaagctaggacccaacccaaaagagttgcaggctgcgaggctcatcactgagcctgactgcctgagaaggctgagagagagaggcccgtgtttgatgagggtgtgtttagttcacgtcaaaattaaaagtttggttgaaattgaaacgatgtgacgaaaaagttgaaagtttgtgtatgtagaaaagttttaatgtgatgtaaaagttggaagtttgaggaaaaagtttggaatcaaaatgctgacttgccgtatcgtcgaccaatttagtaggagtagtagccaagtaagttagctatagatatatattattatgcattaatacctagtcctagcaattccttcacaaactttgatagagcatgtagcattatagcttgctatatatttatggtccgcttctcttctctctttttttttcgctaagtcatctacaaatataagtggtaacacctatagactattatattattttatcatacaagctttgatgagtgttgaaaacattttttttctctctcattaggcagcacagctatagtgtagtactgcactgctatttccatcccaaaatataatctcttaggtctttattccccccgagggagggattggaggggatggatgtgaaattaactccctctaaatcccgcacaatctttttataggtgagattaaccgaataaggccttatggagttttcttatagagattaaatagagagatgaagttgaatgagtaatgattgtgattggttgagatgagtttgtaggtggataaattaaataagagatagttgagataattaaggtagtagattgagagaagttaatttgattgctaaaagtagctatattttaaaactaagaaagcagagtattctttgcattccgcaatataagggattatgctatcttttgtaaaaataaaaaacaaagtagcaaaatgacaagtcatggtataaaagatggggttgaggaaataaagtactgtatcatcacaattttttttatttttgaacaaactagacgagaaaaattcaaaagaggtaatactatctttttagccttttctcgtagcaagaaaagagctagattttgtacattttagctttttaaaaacttattttacaaatatacctaacaaaaaaaacttatttcaagaatggacttttttttggcgttgaggttcaatgtctcagcaccaattgcttttaacgccaacaccttcatctcctgtgatatctaagtggctcatgtaaagggattgactagccttgaggacatatttataaaatatttttttaaaaatggttaaaatataattttttatagataggtttttggcgtcatcttcttttgatctgaggacctatttgtaagaaaataatatatacattttaacaattttcataaatttattttagtaggtcctcagtgcgagcctcttaattgacgtcgacctctctatatctcggctgctaaagggatgagggcattaccaatatcattgacgacgccaagacgttggactttggtgcctggatcgctgacgacgagaaaagggtctttgaataaataaattttttaaaagagccaaaatgtgaaaaatacaaaagaaaagagggagggagaactcatcagcggagaagtgatccgatgagtgacagaccggcccagcgggataagtggccgagtgactgacagtccggcccttgcctggcctgcatcggatcacgtgcaggcctaaataccaaggggccaagtgctactccttcgtacagcacaattgtacacactgctaggctgagcctctctactgctgatctacatcacttcgtcggatacgctcataacttcacacatttcaatgataattccaagtctaagtccagttcagcctccgaagacagcactaacttcaaacggacctaacgccttcatgccaactctgatttgggtgatcttggacttcgtggaaagcttaactcgctatctttcaaacgcatccggtctcatatctaaattcatctcgagtcaacgggaatcgccaaaaaaagacagtgttgttgctgaaaccgaacttgggccttgggccttgtaatagactaggcccatctcggaagtgtctccctccacctccacgaattagcacttaaccctagctttattttcctctataaatagctttgtacatcctcaaaaatatttgggttttgtttaattgaattttaccaagtgtcattcaccttgtctctagtcctcgcttgattagtcagtgactattgattcagagcccccaatagttgatgtgttgatttgccgggtcaattagatctaccacttcaatcgcaactattcctttgtacttaatcacctattcgcaatatttagattgcatcttatcttgttcttgcagtgttctctcatttgcattgcagggatcatcaaccgtgcgtcacggttggtacaacatcgtttgtggtgtagcgattgcacggcgtcctggacttgttctggttggtatccacgtcgcaaatgttgcactcgatcaaagcgagagttatcccctcaccagaagatcgggccacgagagagagcgtcatcatttggtatcagagctgggcccttgttaaggggttgggaatgatgaggacatccttccgcgaccgtgtgagcctctgaataatcccaccttgcttagcttgggaggaggaagccaccttaaaagggagagccacccttcctctattggactagtcttttagggagattgggcctatccgctagtgggtgtgcttaagaactgttggggtccgggcaaccttaatttgttgggcctcggccaaccccaattgggccggattgttatcaactccctacagctacagcgatcccctcttgctttcccatatgttctacgtgtacactctctatcgaaaaataagtttattttggtattgtgtataaaacactgctatgaaatccatttttcgtggcggccattttgggttttcgctagcagaatttggagccaccacaaagcaaaggccagtgaaaatcaagatcttcgtagcggttatcgaccactagtgataatttatttttgctggtggtcatcttaagctagctgtcaccaaaaatctattttcactggcggttagattaagacggtcaccagcgaaaaaacatttttgctggtgggttacaccgtgccagccgccagtgaaaatgctagccaagttttttaaaaaaatgacggacagagcaacaccgctctgtccgcctccatcaatgctcgaccattcaaaaatttcacagaaatttacccaagcattcaaaaatccacagaaatttacatcaacaatttacagtaaaaaatttccattcacccaagcattcaagcaacacagaaataaacaaaaatttgaagtcgtcgtcgcggcgctgcccccgtcgacgtcggcggcggcgggggatccggtcacttcagtcgtcgcggcggtggatccggcctcccccgttgttgggacggtcggatccggccggtcccgagcccgcggcggtggtggcgacgacagctggcggcggtggaggagggagtgggagaaggagagcccgctgctggacccgtcgcccgcgccgtcgtcgtcaccgagacacaccgccgagcccgccggatccgtcgcccaggccatcatcatcgccgagcccgctggatgcgtcgcccaccaccggatccaaccccaccctgtcgcccgcggcccgagactccccgcgccgctggatccaccgccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58393 - DNA, 1258 bp, Oryza sativa
cgacgatgaagcttatcccccatcgtctcactggccgaccttggcccctgttatttttgggtcatatctaattcgttatactcaaaatacacctttggtacaaaattaataatctcacaaggatgaaatatcagtaattttctatttactggttgatcccatcttttacggcatcaattccttttttgaacgtacaaaaatttggggagctcagcgtgtctggaagcacgggagaacgttcttttgctgatattattaccagtattcgatactgggttactcataggaaaatcagcctttccctatatcaggcactaatttatttttaacgtctaattagatcagggagttcttccaattaagaagttaagctcgttgctttttgtttcaccagaattggagccaggctctatccatttattcataaaaggaggtccaggcctacttagggaggggttgagccctttttcacttgaggagttctcctgcccctcattattaacaccttctactccaacaaggagatcttgtaatttctcccacaattagctaagcacaagagtagggtataacgcttctcagcggcccgaacctatataaacccctcttgtctcatcgtccttgaggggcctgacccctatgcactgaactatccaccgagcccttgagtctcacctgctgcccctggccgaaccaacaaggggctctcactatcccctgcttgaggagttcaccctccgacaggattctaacacattctattccgataaggtaattttcttctttatctgtcgtatttcgtaatcaaatgatacattgtcgtatataatcaggtatatggtattgcggtattccatgaatccatgtataggaggtatgtcttatccttgacactgacataattaaataaaaaagacagattcaagggaaatttttctaaagttgtagcttttacgaattttcctccaaaatctatgtagtattttccctagaaaaaagatctctgtagtatcgtccattatattagagtttcaatggaaaggagatgatttaattatttgtttcaaatatgcttttaggaattttttttcatataaatttgaaactccctaatttttctgtcttttttctgttcgagcctgattgatcttgaccatgtcgtgaactactgttctccctgctctcaggatacagagagatgttgtgcagggctcattttgagttttcgactgtatatatatcgaggggctgcaggaat

SEQ ID NO: 58394 - DNA, 1271 bp, Oryza sativa
cagcaccatatacctgaaacaaagtgcaaactagacatggaagcaacgtatctgcaagcatgaacttaattgggccaactgcaagctacgggcacatgcaaactagagaagatttgttggtattaacacaagattgagcagctcaatcagataattaaccattaattgaccaattaatcggtccagccagtcgttttaacgtttgtatagcaaaaaaccatacccagttacatgtatgtgatactttcctttccgtgtacatataaacggatgattatacagccggatcataataacacatagtcatgatacagattagtatacctaagctatctagtctagttcctcgttactaataagattctgaccagttttaccaccagaaaatacaaactttccacgaggctggaaaaaaaaaacaagttccggtcaagtggaaggaactgccgtagcatattccctacgcggacatctttttgcaccagatataaaccacaaaatcaaggtatagaactcatggcacgaaccctgccactcagctaacacggagaaattaaaacagatttatctcattaaggcactaaactagcatttcttttgtttccctgccacacactcgaaccgcatacctttcctcgcagatcctgatcgaacaaccaatggcacctaactagccgcgacacccaaattcccccccatgaaatgcggagaaatgcagaatgctacaccgtctcgaagcaccccaacgctcgaaacgcccaatgccgctcgccccgagagcgaaacaagacgccaccgtcgcccctccccacctcctccccccaacacacatcatcgtcccgaaatccgcgagcgtgaaacacgagagagagagggagaggaaggtaaatccgcgaaccaaccctttgtagacgtcgccgaaggagccgcggccgatgaggtcgcggccgctgaaccgcgcctcgatggcggcggccatggacgcggagtccgacatcctaagatctgcacccccgccgccgccgccgcctcctcccgccggggctagggttttgggggggcggaaggcggaggaggaggaggagatcgagggatttggcgtcctcgtcggcggcggttggcgctagggcttggattggattcggggagggtggtggtggcgtggagcttgcgggttacgcgctactctctccgccccatttccgtctcgcgtcgcgcttggtttgctgttgtttgttcatctggggggctggacgcgcgccggggggggg

SEQ ID NO: 58395 - DNA, 2355 bp, Oryza sativa
gcggcggcatctgctgtatgaccatgatcaccaccatctgcagcgttgatcagctgctggaaccgttcgatctctgaagcgtacatcaggctccagtccactgccgggttccacagctgccgctggaacgcggggacatcgttgagcgggcgatgctgttcttgcccaaactggcgagcgaaccggtccggggcgtagatttccttgaggttgaagctgaccagccatgttctggagaagcagaggttatccggagcagcgcaatgcttcggaatggatgcaggatcaacgcccttgtagggctcccagttgacctgaagttgttgttcatatcatcatatggtctcaaatcaaatggcaagggaaaggatgaaatgctgaacacaaaactgtggtgatgactgatgagaatcacaactcagatggatagacttttacatcagaaacttgaagcaggccgaaggctttcctgatgtctgaaacgttcttggccggttgagagatcgtgctccctgtccacttgagtactcgtgggaagatgtgttctggaggatcatacatgtcagggcgcaatgccggaatatactcatatatccagccctacagacagatattcagaatatatcagaacattttcgcaatggacacagtgaaggcacaagtcacaaacttggtctgtaaggtaaaattttgtgagaaacaaaaatggagaattttgttatttcctatcatctttatgccttactatcaattacaattctcatgttgaagttcattaatccttttcagaaaacatgaacagatcataacaatcaaaatagttttttgatagtttcatagaactggaagatcatttcctactcgaaattcaagtgatattttcctatacaatggttttgttaaacataccatgagcaaagccgcgctaccgaatagcctttttctggcagaatgggccacggcgatggagagagccttgtagagatgagcaagagcagcagcaccccaagcatattcctgtaccttgtcaaagtctgacagaagtggcaaatactttggtgagacatagcccctgtccgtctctggaattaaggctgatccaatcaagaacagaagatatgcggtggtgccatacatggtctgatcattggtggggcgttccgggatccggttaaacttggatggcagccaagagagcttcacatggctgcccgtgcagtccatgctatcaggcacttgccccagatactggaagcagaggtcttcgaccgacttgttgagcacagttccggttgtcaccacacggcctgtcaccggaatccccagtatgtaggcggcgtccctgagtgagggtgccatttcaaagccattgagctgagcagtgttggtctccttgctccacagttcgaagaatgccatgagcgcgatgcgatcgatgactaggcctgctgtgtgtatcaggttgccgagcccgcttgcatcgaccaattgttgctgctgctcattcagcttccatgtgtcgagtctctccgtcgtctggcatacggttagttcatgggttccctgtatgtttgagcatcaaaatgttatgatttaggtacaaactatatatcacaagagccaaaggaaggttcagcaaattggtgtcgcttgctcgttgttgataaataataattacctgaatgacgcttttgtttgttggttctgcctctgcggattccatctggttccattaagagaaggaatgttatgtggtaagtgtgcatacaatccaagaattgctcgcagagaaatttcagtttaagcatccaggttaagtacggcaagaatttgcataagtttgataacaacttaacaagtcctcaatgagcggtctattgcttatatgagcaactgaacatgtaattgagactttgttcccctcaaggaaatgaaaaaattaactagcacagaatctggaaactttgacattggtaatcaaaaggactgtatatatcaggcatgatgataataaggctgggaaaaactgtagataccaggtttgattcactaaagttcaccaaaaaactgtagaagtttttaaacagatgacgtgagctctacccttaagaggaagagaactgcaaccacaaagagcaaaagcactaggaacaactgctttaaattttcttcagaataaggagaaagcaaaatgccaggattggccacatacaaggtacaaaaggacagcagcaaccagccaagaaaccatcaaagtttacctgaacaaaaaagatacgttgtgaaacaggaactgaactactcatctaatcaactgtaaaaataaagaaacaaaatctggaggaaaattgaatc

SEQ ID NO: 58396 - DNA, 1826 bp, Oryza sativa
tctgctccccgtcgtcaccgctagcgctcggagagagattgtgcgccactgcccgttcggccatggggctgagcaggagaagcttggcgcacacgaaagaggacgagggcttagaaagacacacgcgccccctacctggcgcgccagatgacggagcgtggagctcctcaccgggagaccgcgcaggcccccctttgccggttcggccgggggcgctaagtgaggttcttcgccctcgatcgatctggagaatgttcgtgagagagcaagtgcacgagacacgggcgatgtagacaggttcgggccgctgagaagcgtaataccctactcctgtgttctggtggatctgtgtgtgaaggagttacagagagccggagagccagagagttcaggctccagaacccctctagcctccttttttcttctttttttctttcctcctcctttttggtgggcaaggtcctccttttatatctcaaggggataccacatgcaccacttctacctacttttcttttgggtggggacctaccctatcttgaccaaaacttggcttgcaccttcgcctggaagttaaatcacaacttgtccttgagtgaggctcagcgccgtcactcgcctgacatcggggatctccatgttactccctcattaatgggcggagatttgccatggctgctttccaaatgaccatccgacgagatgggtcatacctacctccactccaccggaggcagatgcatcgtgggagcacggttgtctgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacatgccaactccaggagttcccacgccggctccggctagggacgagtgcctggaggctctcatcattccgacgggacggggcgaggcgtgtgtcaggccgcctgttgccacctaacccgcgatctgaccggtctgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcgggaagacagagggaggggcggccacatcaccctcgggcccgacccccccgaggggtcaggccacgtgggtgactgcagctgctccaaacctctagtcaagatacccccggtcccatgtcactgacagtagcccccggcgttacgccagggcgatcgcccccccccccccgagggaagcgctcgggcatgacgccactccttagacctggtgacaggtggggccggtctccacaggcggcagaaacccagcggtcgcaaatcgcgcacatcgtcaaggaaaaaaccgaccgataataatgagcggcttccttcaagaccactacattacttaagtagcgcgcgaaccgggacgagccggttcgtttcgtctggagatgtgatgacggtgcatcggtcggcgagcgtagttaacgcgcgcacgattagtcccatctcaactgccacggccgcacatccgcctcgtgcgccgcaaacgggcgagcgggattagtggaggcgcgggcgcgagagacgagggggcgaggtagtgggcgcggggatcgagagccgggcatagcgttggcaagggta

SEQ ID NO: 58397 - DNA, 1265 bp, Oryza sativa
ataaatatatcaggataacaagtgatgctgtatccattatgtacacttcactaccaaaaatacattgcttagttgcttatataaccatttttctccatcctgatgtagagaaaaaaacagtggttcaaaattcatgcatatttggtaactatattaatgcacagaagagggaaatttggcatatctggcataaaaccataggatatgcccaataacccaatacagcacacagagctttgtgttgtctacctttaaacccaatggctgaaaatgcttacaaagtaaatttgccgttcacatgtagtaccagatgaataacataacaaagaaaaggaagaaacataattcaatgtatttttcaataaacactaaccttaaccccgataagatgcacaccaactgctcacgctgcacacatgtccttgcaattgatccaatatttcctaggatatatgatgtacaattataatgcagtgacgaccaatgattctcaagtatgctatctactctttacattgcagaatataaaatataagcatccagtaagctgagttattgactaaatacacaaaaagcatctgtgttccctcctgctgtcataatgagaagaagctggacatcgttagtgttatccaaaatttttctacacacatgaactcctaactttttttccaaactaccaactttctccaaacttctcatcaattttagaaactaaacacagccgaaatggcggttgatatcattctttttctctactcttctttctgttacgtggtgatgccttgccttgtcttctggtaacatgaagccatctttcgcagtagatcttcaaagtgagcttcaaacggttggcgatcaatttttagcaactctccataatctactctactaatatgtatataatatttctacagggaattaatatgcacgatagaatcactaaaatatttgatcaaatatcagtttttaagaactcttttaggatatttaaccagcacaaattatgaccatctaaacttacggggagacacatattaacatgctcagaattttagatagaacattgagaggcattttgtcaagcagttcatgagcagcaaggcattttgtagcattaatacaaaccacacaatgctagcagtgaacatgtacaccatggtgattttcatcatcacaaaattcagaaaagccaccttacaatccgattggatgagtgtcaagcatgcaaggaatgtcaaaagccagaaacattgcaggcatca

SEQ ID NO: 58398 - DNA, 2928 bp, Oryza sativa
cttcatcttttaagcagcaattgctacactacaaccaaaccaagtgataccaaattaaacagaatttgctcacctggcgctgaggggaagtagcacctgtatgctggattggggagaccgtgcactggacggatggccggtggtgccctgaacggaggacccgcgacgccctaaatcatcgatgggacgccaggccctgggtggaggatcgccagcgcgctggatggacggaaggacggaagggaagacggggggaggagggggggtgctgaacggaggggatggcagaggcggcacgagcgaggagatgacgcggaggagaccggcgcagagtagaccgccgaggctgccgacggtgttcttgcggtggagataggggacggcgaggtgggcgacgattcgcggcggtcccgagcgggtggagacggcggagaaagacccgagcgacgaatacggtggtggcggcacgggacagcggtgcgtcggcccggccctgagcagcggaacgatggcggcggtggcgagacggacccgagccgcaagcttcgtggggggcggagacggcgcatggtggctgacgggtcagacggcgaagagagggcgcggtggggtgagggaggtgggagcgacgtgggccgttggattgatacggagggagctgcaggagaggcgcgatctgcgtgggagcaccggtgccatcggatgtaattcatcgggtggttttagatagttggatgtgtcacataatgaatatgaactatatggtagattggatatttcggatctctatattttaccttgagtttagagtatatttattgctcattgatagtttgcatcgctaggagtaatctatttttggttaagtaaattctgaatagcatgaaactaatttcaccttgaccttaaattctgctaaataattttgagcccattatgtatgaagatggatgggtactaaattaactttctataggcaaacgatcaaatcatgcctaatctcacagccacgatgtctcgtccctctcgtcgaactttccgccgcctcatctcacaaccacgacggaggcgtttcgttgtccagcgttttgtgtgttcatgcggtggccgcttgatggctgccatcggcttccatgtgcgttacgcggctatatttgcatgcatgagcggctggtttgaaattcagtttccgatatctttcgctttggttcgacgtcaattatagacggtgatgtgtgtaagttctaatcagtagaatgattggactctaattttgagaatttgtttttcactactagaaaaggcatttttggaggcggccaaaactcatttttgcaggcgagagagaggtccgcctgcaccacgacgactgcgcagttggggcaacggcccgcctgcgaaaataaaaggaacgaacaaaagaaaatcgcgccaggagccgccgccgccgccgccgcccggcccgcgccgccaccgcccggactgcaccgtcgccgctccatgccgccgccgccgcccggacagcgccgtcgccgccgccgccggcctcccccctccctcctccggccagatctgggagggagggggaggggagccgccgccgccgcccggacagcgccgtcaccgccgccgccgctgccgctccacaccgttgccgccaccggcggcctcccccctccctcctccggccagatctgggagggaggggggaggggagccgacgccgccgcccgaacttcggccgcaccgccctcctcggctgcgcctcctcgctgccactgccgggagcacagccaccgcgccgcctcgcctcctccgccgggagcacacgccgccgcctccggccggcggccggggagaggggagaggaggggaggagaggagaggaggagaggtgagggcaggggaggggagaggagaagatgtgaggggacttagaaaaaatttaggcccgcctgtctatttatattaagtctattttcgcgggcgtaccacttaagcggcgcctgtgaagtggtccgcctgcgccgcttaagtggaccgtctgcgaaaatattttcgcagacggacattaaatttcaccccgatttatatttttgtagatagtcatttggctctgagggtcatgtccgccttcgaaaataagatcttctatgttaggaaaaatggtttttatagtagtgtttatatttgaggacgacaaacatatagtgttgtctctgtttttaggtatcgtatttgaggaggacaaacatatataaggtgtgttgcaaccctcactccatagcaagtgaaacgaagaagcgttaagtccatgattaattcagtattagttaaaataaatttgaaagatagtaactttcatatagaatttttttttttaaaaaaataccgtttagcagtttgaaaagcgtgcacgcggtaaacgagaaaggtgagttaggaaagtagaggtgtgttatctttgtatgtctttaggatggtgtttcaattaggtttcttatgatccataagctgtgataagtaataagcgttcgttcaaactacaaacttggtactccctccgtcttaaaataagtgcagccatgagtttttttttccaactttaatcattcgtcttatttattatttttttaaaaaaactaaaaaaaatagtcacgcataaaatactattcatgttttatattctaatatcaataaaaatactaatcataaaaaaatttcaaataagacggacgatcaaagttgagcacaaaaactcatggctgcgtttattttgggacggaggcagtaataacgagttgtagattggatgaaataaaggacacaatgaattctattatctttttttaaaaaaagaagtcaaatcatgtgcttgaacaatgtaacagtgaaaggcaaatgaaaccctggaagaaatgacgtctt

SEQ ID NO: 58399 - DNA, 1819 bp, Oryza sativa
atgtcctccttcctcatctccggcgagtcaacaataatctcgtgcgcgtagctagccaacatcgtcggtctgattcgagagttacattttgttttgattcaatgttctgattggagtgtttcattatgccttgttttcatgtatcatccattgatttcttggtgtagcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgcttgtttacgataaatgactagtagcatgtttaaatagatgataaatagaattacttatcattgatttatgtaccaagatgaaatacaatactatcaaggagctctccttttaatcgaaaagaaaaaaaagtacctctcttttgctgggccccacgaagaaagggagccgcttctgctgcccatggcaatggtggcagtggcgaccggccggcctgcaacccggcggcgtcgtctcgtgctgcgacgcgagatgtatgtatgcatcctccaaagtcttttttcgcggcatgcaatcctgaaaagtaatacctctgtctcacaataaatattcgtgcccaacatttgaccgtccgtcttattagaaaattttgtgaaaaatttgaaaatatttagttacacataaagtactattcatattttatcatctaatagcaataaaaataataattattaaaaaattttaaataagatgaacaatcaaatattaaacgtgaatatataaaactatatttattttgggacggatggagtagtctgttggctcgcgccttgatggcatggcatctttttctctcttgtgctgatgctgaccaagacggcacatgtgctgatgtgcctgcgtgcagtagtttctttggctggctgctggttttggctacatcaggccgtgtaatggcacatcatgcacacgcacgaatctgatggatacagagccgctagtccaagcagtactgctaatagcgggcctatctcccgtgctttcgtagctcctccctcctactactactgtgtaggagtagtgtgtggatggataggatacggatcgatggcactgtgcctgtctgttctgcacgacggaggacaagttgtgggttgcgtttccgcgtcatactccgtctctgccaaaataaatgtagtttttcatatcttacgttttcgtttgaccgtttattttatttgcaatttttttacgattaatatttttattgttatttgatgataaaatataaatagcactttatatgtgactaattattttaattttctcataaaatttttaaataagacggatggtcaaacgttggatacggattcccataactgcacttattttgaaacagagatagtacgtacctagttagagtaagggcagttaggccttgcagtgagcggacattggttttggttcgttgtcataccggagctaggtcaatttatcatacccattcccccgcgaggctcctcatgccttagcaacaagctaagatagaggc

SEQ ID NO: 58400 - DNA, 820 bp, Oryza sativa
ttttatggaacgtttctttttctaaaaattctcacggctccaaaggaggtccttgtagaaaattgaatgtgttgttgcttgttgttggactgggatactatagagctcaaagcctcaaattacgtgcaagacgacgttcctactcctgcgtaccgctcgatgttggttggcctacgatgttttcgtgtcaaacttggtggcgcacgcacacgcacaccaagtcgatctctcgctgtcctacatggtcgatcggatactgtcagttttctttgtcctctacgcacaccaaagtcgcctactgctgcgcgatatacactgccaacgtactgcaaggatcccgaatcgatattggagtatgggctagcagtggcactgtggcagctcccggccggccctagctagcgtatgtcatgtcgttttacaccatataatttccaacttgtcactaagtgccggtgcatgacgtacctgcatgcagaggtttatactgtactgtactattcctatgtacggatccctccgttaaaaaaaaacgaatataggacataactgtattatttagaccttcaactccaaatttcaactttcgtttttcgttagcacactttttaaactgctgagcgatatatattttttaaaaaaatttcatatagaaattgtttaaaaaatcaaataaatttattttttaaggttacaataattaatacttagttaatcatgtgtaagtggtctttcttgttttgcgtgccctgaaaaattttcttcctacccatgaaacgaacgaagcgtaataattaatacattcgccttaaaatatcaa

SEQ ID NO: 58401 - DNA, 1677 bp, Oryza sativa
attcctgcagccccagctggcagcaagatgctggcgcggtggctgtgcgtcgaaggagtgtggttggtggtgttctctatgaccagcagaagatcttgacacgaggaagtaggaagattacaaacgaaagcctagcctctttgagctagcaagggcgacgcttgcgagcgccacttttccccttagggtattattgagtgatctcttttgccccctgatggattcctctaggtgaaatgtcttgaacctaggatggacggtgctggcatctcagtgtcatatcgttcttgaagtcgtcgtttggaaaatccttttccttcgagatgtcgtattactatctcattagtagttcattagtagtgaggtctgattgtaaacgtgtggtgtggttgcttttttttccaggctatagcctcccaaggctatattcttgtttttttttattgttctatccatacgaaatatcgcactatacctatatgtgttgtttaagaaaaattgaaccaagttcacatgaatcaacggtgcttcccaagctataattaacccaactagatttaagtttaatcatccctgcaaaagaaatattaaggtaccatgttaaaacaaaagaaacattaaggttaattacccggactgccttaaggcttaacgttgaaccaaacgcggtttggacgaagtgctatcacctccgtctgatagtaagaggacaaaaagaaatgtttggcacaaaacgtaaagggatatattttgtccgaaagcatgtggcttttcgaaagaaaagtttgacaaaaacaaagcgaacttttcgcatagaaagctcaagcgcatgagcggattcacctatattttcaatccaaagaacatgtcaaatgctagggattatagtatcattattttctgctacacatgcatcgatcaatcttggaaatggagagaaatactagaattacacggatgggatttgtgtccagatccagaccaccggcctatccaaatcgtagtatctttggaacgagtctacgctgctgagtggattgatttcgtaagcgaaatcccccaatggttttgcgcaagtcaagagtcgtcggctcgtcgcccgtcagcagtagttgggggaaagcatgtgacaatgtgattgacgtactatcaacgaacagaatcgcgaacggtattctgggagaaaatttagatgaaatacgggcatgtgtgatcatgcatctaagtttttgaccggtcatttttacatgattcatgagaaggatgtgaatttggtggacaggttttcacaggattcgtctattttctcgggagagtttttcaaatgcccagatttctgcttccagccgccgtccttaactccttacatattgttcaacgttgatagaaatctgaaatgataaacaaaatgagtacaacttccatatgtccaaatgagtaaaacattgatactccctccgtttcgaaatgtttgacactgttgacttttaagcacatatatgaccgttcgtcttattcaaaaacttttgtgaaatatgtaaaattatatgcctacataaaaatatatttaacaatgaatcaaatgataggaaaagaattaataattacttaaattttttgaataagacgaacggtcaaacatgtgctaaaaagtcaacggcgttaaacatttcgaaa

SEQ ID NO: 58402 - DNA, 8279 bp, Oryza sativa
tataacaggattggatcggcctatttatgtattggtcagaaagaatcgctgcgagaattggggatgatcttgacgtcaagaacagaagagaaaacagcagcagccagtgggtaaccgatagacgacaacaagatgagccggagagttggatcatctgatgaaggcgtgccttcttgcccctctttggtcgacctgaagctgtggggacttcggcctcgtcacctgcttggttgatctgtgtgcgaaacaacgagttcacgtttgtgagatgaaacggaaaggtcgatgacattgtaggcaaaaatcttggccgtttctgctcttacctctggggacgaaatggtctgtcaaacttcgggagaggccgtgcttgtggcaccaaggtcctcctgagctgcttcaacgctttctcttcctcaatcttcacatgaaaagatcacagcaagttagttgccagaacagatgaaaatgcatccaacaatgtagggattttgagaagaaggcataagaaaataataaccttttgtgcgaattcattttcctctcgcaatctcttgtaagttatttccttttccttcacctgcacgacaacgaattgctcagtaaattcagccaatttggcaggctcctccaaaccagataatagaacaagcttgctttgctgaccatattgtcaaattctgatctttggaccgccctttcatcaacatgtaacttaagtggttgaacttcagtgagaggcttcctctctttctctggaagaggaatgggatccctgcaacaaaattaacagtattaatatgcatcttataagggaaaccaggaactgttgggacaagagaaaccgtaatgtgaaggcttactctttcattatggggtgtgccttcactactctcctctgggcctcttccctctccatcctctctctttcttccattatcctctgttgctccatctcatgcctcaccaaactctctaactgaaagccttctggcctcgtgcatggttttggttcaggcttcggtggtatctgaagagagagaaaatgttaaggctagcagaatatgagatggtcagcaaccaggacatgtaatattcggtatgttactttgcacgtaccactggatagtcagttgtgtagggataaggattagccttcggaatcctggctttctcttcctgtaattgcttttgcagcagttgtgcagctagctgcctctctttctcatgccctctttcctgtaacatggataacaaagttatttgcctgcaacagataggtaaatgcaatgtgttgggaaaacaaataactttcatactgcttacatctgtatgtaaattgaaggggtttggtattgtcaatctgggcacatctttcttgctatgatatgaagattctgagcaaagagagagctacaaaatagaaaaggacttagaagaaaggtttctggaaaaaaaataatgagcttactagcatgacttagaaccctcaccttatcaaatagatccacaactgcaggaggacccaagcgatcatcggtagagaaatggaattccttgggggctgttggttgagcctttagatgtggaaacacaccaatatcacccttgctctcgagaatctgcaagaaatgatgttcagactggatgttttgaagcacaatgcaatcaatgtatcaaatgtacaagcttcaagaagataaggagacctttttgttcagtggctttgccttgaacttgggagccttttctaattcttctagttccaattcctgagaacttttcaccctgcagaaagatgatgttagagtaatcgaaaataatcaataacataaaatggcttgttttctgaatgatgcaagtggcaaagggaaaccttggtggtctagctcgtaatgctgtctcaagttggggtggttttggcgctgtcaaggtcagtggcttactgctctgactctgcaagatttgattaaactttcagtaatgccaagaattttaatttttaggagactaagaagaagaagaatttacatactgatattagcaaccaggttaagtgaagggagcttaccctgatagtccccacggaagaagcttcggaacaggtgtctgcatgtcgtgtagctctctccatcgttttaagatgaaactcctgtaggtgttggaaaggaataactgaatcagccaaacaaagctgtggagctcataaatttctgaatcagccaaacaagacgtacattaaattcaggaagctgtggagctttccttggaagaggaggaaatgaaggggcctccgcaatctgaaaggagaagcaaacaaatagttagtcttcagatcctggattgagtagttagtataatcaaaaccaaagcaaacaaatttctcacttttttgttaaacggccgtgctctgaacttcggaattttggctagcatctcctcctctagctcagcagagcttttcactctgacagcacggaccctgtgggaggtctggaactcaggttcctttggccttgttagcatcagctttgttcttctttgtaatgcggttgctgcatcctcctgcattgtgcacaaattgcaatatgtcaaaattcttagtaccaataatgatttcgtcgtcaacggttcagatgtaataactgtgcaatatttgatatgcagatatcagtatcacaaaaaggacatcggtctttgtatggaaccaaatacccacaacaagactgagaagacatgtatattaataaaattggagaaatgcacacaatttaaaattaataataaagggcacatgagtgctaacatgagaaagcgatctgttgtgagggatggccaactctctagtcccagactcgaacttctttaccatctctgctgccgatatatagtgagtcacttcctgcacatggcagaaacaaaagttgctaagtgccaagctcacaataacaaaatcacattatacttgcattctcacaagaaacattacaattaagtctatcatttaagagtcagaagagcaacttgggagctaccttgagagagtgtgaatcgtcacggtgcttcctcatggccgacaggctcatctcggtgcttcctgctagaccacctcctctccccttgtgaggcagggtccttgtcttcacgttcagtatctaaccacgacggcaaacacaatgtttctcagaaatctcgcgcaacgcaaacacatgtatttgaagtgccatctttaatctcatcccagtattacctgtcttgtcctcccatcatcaagcttctgtctcttgacagcttgattttcttgtgcgatttcattcgcagcagtagcggccttcccagccagcaactcacgagggcatctgaaaaaccaacaattcagacattagtaagaaaataatctccagattaatatatttttttatgagtgagcatgactcttacttgatcacactcctcttgacgctcatcgactgcttcaaagcagatggatgtgcccttgagccagtcaagggtgcaagacctctggaggagttcgttgcctgcaccttcggagtgaaggcttctgtcttcactgtcagcttgggacaggtaggcaccgtagtgacagctttgacgggtggaggcctctgaatcttcggtgtgctagaagcaacatctgctgctaaagccatgcaacattgatatcaaaatccagggatcagagttcttccccactgccattgctcatatataactagcaacttacattttgcattggaagggacaaactcgaaggattttggcgattccttctcatcctcctctgctggtggcgactccaacattgcatcactgcccaaaacaaccaattagtcattcacatgccaaaaccagcaagaaacggaatgaaccaacaaattgaggtcttgaaatgcacctttcttggtgcttatgatcgccgtcagtgacacaattttcactgggatttgcttcatggacctgaagaattcaggatgtgagctgctagaaacccaacactagtacttactgaaactgagaacatagaaaacatgaaaacatcaagaaatcacgtacaagtttgatggagccgtccttattctgttgcacattcctgaacatccaaaagtgaagatgaaaaacacacgagaaatcgattaacttcatcagatcacaacgaatcatcataaacaatttctttagttctccaactcttacccatcagaattctgcgagggattggcggcgcttcctgctgcctcctccactgctacctcctatcatgacgaacgcagaggccaacggacaataagaaggggggagatttacagaaattagggcaaaattggggggttattcccgcagctttctgcttcgtaccttcggaatcggctccgcgtcggtgaagtcgcagaggctctcgatcttgacctccgccctcgactccttgatcctcggagcgaacgctgcaagcaggtaaaagaagaagagccctaatcagcgcaaaaaaagcaaaacacgggagagggggggatgatcgaggcggcggggtggggattggggagcgtacgggaaggggcgtggctggcggagcctcgaaccagcgctcggcggcgcggatttcctcctccgtctcgtcgcagacgaagtcgaagaacttgggcgcgcagaactcgtagccctcgtccaccagtaactgcggcggcggcgccgccgcctccgggttcgcgtccgtcgccatcggtgcttggctggatagcgggcgaggcttagggtttctctctctctctctctctctctctctctcaagtgcgtggtgatggcgtcgagcggaagaggaggagaagaaggtggtggtggttggatcgggggaagaggagacgaacgttggggggatagagggggaggaggctctaacggtcgggagagttttaaacggtttaacaaagggaggtgtgcggcgcttgtgtgtgaacgggtcggcggctcggagccggcgcggggtcgcaacggctatttttgtggggtgtgactgacatgctaggcccagggagattagtgccactgtgggggagaggcgagtcttactaattactactcctacctgtcatgttctacattatctcaaactggagtcagctcacattctcatttcggtaaaaacattctcaatcaaatcaaatattattcttatagctgagaagaagaatcttaagtttggtctgtttaaataaattatctcctcttcgtcctaatataagtgcggcctaacataaatgtgacattcaaagacaacgaatgtgccatatatctacttaattgtacaaaaatacattagattcatctttctatctcttctatatgataaaagttttacattggagaataaaaatcttacatgccttatattttaggagagggagtaacaagttaaattggaaaaagtttaaataatttctttttggaggaataatagttttcaaagcgtgacacaaatattccggttcttgccagcctgttgcctattaaacagggccgaacagatataggaggccagattaattcataaattctcgggcatcagaaaatggaaaaaaattgatgtgttattaatgttcctcaggtgatatacaggtacagtgggtgcaaagttacattataaaatgggtagaaaatgtgttattcaccgcgaacacaaacaaatgaaacaaccggtagcagcacaagctgctgagaacagctagcaacaaagagatttctaaccatagcgttatgtacactcaaaattaattatacattgaatcatgacgggtttttttttttttgtattgtcttcagacggagttaagatcttgggaaacttggttttgccacctgcaccaatggcatcaactcactctttgttgtgggaaagcaataataagaaaagggaaacaatttctctaaacaaaccttgtaagaaggaacctcgccaaagggcttacggtaggggcagccaaggaaggtgtattagccattttcttgttacttggaggttcagagggaggttcagatttctttgcgaaaactgatgtcgccgtctcttgaagactttgcagcgaggactccttcgagctgcaaacaaggaggtatcatgagctacaagctgagcacagaggtaaggtaagcagaggagagcacaggggtaaggtaagcagaggagcgcataagagagaacacaagtgaaactcagacctccctagccgatggagcattctgccaatcagcacctcacaagatccaggtagctctttttcgagatgcatcaaggaatcaaggaatgtatgaacaactggtccgttaaacttgtcaccagtagcctgcagcatgtcatcaatacagtgaagagtttggcatgtctcgagttgtacaaagatcaaactgataaaatgtggtgatgacacaactcattcgagattggattatccaatattaaggttaaggcttcattcgtttcagaatgttggctgaaactttcccccgttcactgtgcgcatgcttctcaaattgctaaatgaagtatatagaagtttctttaaaaaaatcatattaatccatctttcaagtttgaaataattaatgctcaattaatcatgtgctaatggtttatctcgttttacatgcagctgagtagctaagcacaaatgtccttcaaattcaacctaattcttataaaaaaatgttaagagcgtaaataaatgtgttttggggcttataaagaattttcaagaaacaaatgtataatgagtagtgtcaatgtagcaactaatagcaaacacagtagattgaaaagggaatgagttaaatatactgtacctcttttagagaaggaattatcaatgacgagagtgcaggtgaagatacagaaccagaagcttgaggagctgattgtccatcatgtatctggcgtggtttgcgacctttttccatgtcagcattctcactaggataaaaaaaaaagaatctgttaagaagcgttacaagaaatggacagaaaagtttcccgagtacaaaacaaaactaaaaccaaacttgcaataccttggggcatcatgactgtttactgccgaaattctgggttcatgtgattccttttcatgtttgctgataacatgtctttcacgagcattaccctttttaaacgcagcctggagagcagcctttgcctgcattaattacccaaatatatgaataagtatcaaccattaaccacaattgagaaatttgccaacaacattcatgtgcatcacctctgcaaggttagttgcactgtcctccagtgaagcatttggtgacttttcttggattcccagtctcgaccttgaagatcgtggagtttctggttcttcaatttgattccgaacgactgtcccactgatagacgtgtcttcatacgaggagaatctactgggaggctaataaataaaatgtatcagacgctgttgcttactccctctgattccaatattaagtagttttagacttatgccaagaatgaaggaaacagcacagatgacattattgcccttcatttacattacattgaaaagactagtcatttatttgtgagtaccatttatttagcatctgtaaataaagaatctatataactgaaaatgttagtagttgtggtgtccattcccacaccacccctaccactaacatctgagcactacaacaagtcctcccccatttcactattagcttcccctatgtttcaaaatcctacttgttcaataagaaaaataatagtagtacttggactaaataagtgcttataattgatttaataagctagaaactcaatttgttttctgttgcaacgcatggcctctaggctagtaaaagatgaaaaagtgcttaaaagtaccaaaacaacatacatttagaaaagaattgtgaaggctaaaatgacctatattcagaatcggattgggaggacatacttatctgtcttgttttgggggaaaactatgacattcatattaggaatctaaaacacaccttggaactgtggttagtagctgcagggtacacctgagatgctcttggcgagcgcagtacaacagttccagacccacttatagattggtcattctggaagataaccattagttagaaacaacactaacaattagacaaatagcatatctaaaaaaggtcttacatcttctgtagaactctctagtcttccatattcactttgtgcatctctctgcgacgggtttgttgagatcgactct

SEQ ID NO: 58403 - DNA, 1977 bp, Oryza sativa
cattgagaaatcgtagaaaggttataccttcacatctccactttcagtcaggaggatatttgccgctgcaaaatatcacagaatgtgtatattagaatgtgtggtatacttcacaggttcacattagtaaaataggaaagaaaataaatgagtcaaagatcatcaatatatcaggactaatcagtagtcacacaatagtggggtcattcgtttatgttcaatcaaatgctatgaaaatactagcatcaaatgtattggtatgttacttctgtgtagtgaagaacaatttaaatgtgcaacccatacaactgcctgctaactctccattatcttttcatacagactctaatggtagacctatttgaccctatttgacagtgatcttccacatcattgtacctgtggaagtgtggaaaggcattgcagactttccagaactcaatcttatgtttaagattatgcaaggtttgctggggttttgttctccctccatatccaccagcaacactaaacttttcaattcatctagcgccaatactaatgcaatggcaaatgaaggttttcaccagcccttacatcttaatctgccagattttaattaaacaacagcaaatatctaattgttctgtgtatctgaggattcccaagttagtgaaaaagaaacttcactttaataaaaaaacagtgagtgacgatttatcttgatagaaaataataggtgtaagtatgcaacgtaacaatagtggatggggtgagaaagaggtgtcgcctcttgaaccacatcctactaaaccatccaacttaaagatgggataaatcaagaataatagtataatactagtaacatgatataattgacctttatcaacatcttttgagttctgacaataaagataaatgtgcaattggtattaacgcattagttctcaaagaaaggagtgttagccctgtccagaaagcctcctttataatggttttgtggatattgtacttggtggacaggacagtagatatgagggttatctggcccgtagttattaggaacacagcacaaccaaccaggggttgaggtactgcagtcagaatataccagtatgataacaaatgctgtacaaagggaggtatagactgtagagttcttcaggacatgttacatggccccaatttttccagtttgatgacccaaatgctttattaaatgctcatattcaatataaatccagcaataaaaagggaaagggagagaaataatcaagacctttaatgtcacggtgaatctttccttctgaatgaagatattcaactgcatgtaacaagtccctcagaatgcatgcaatagacaattcatctagaggagggccagtttggagctacagatgaaaacagaaatcataccaacttcaaattttgaaccaattgaatgattcttgaaactgaaatgatttattaacttgtatgtagataatataagattttgccgtgtcaaataaaatataaaaaataaacacatactaggtcagcgacagaaccaccagccatatattccattactatccacagtttcgtttgatgaagatatgagccataatagtcagttatatatggacaacggcattgtgacaaaacagatatctcctgcaacatgaaattaatcctattaggaattaggaaataaattatccacattcaatttgatctcatcatatcctgtaattgatacagcgtataaggcgaaagaacaaccttttggatgtcttcaatgtcatcctcactgcatagaattaaaggacatataagtaactaatataaaattctggtagtgtagaaaactatatcaaaagaaccaggcaaatctaaaagagcaaacagaatacaccactttgttactggtacaagaaatatattagcaccagtacacaatacaccttttcttcttgcaataagccaataaaaaaaggatatcatgattgcaaatgg

SEQ ID NO: 58404 - DNA, 1294 bp, Oryza sativa
tgtaatgctcatactgattgtgctggctgagacctagccgggggccaaggcattcatttaggtcagtgcacgccgcctcagtaggtttattccttgtccggtacatatggttgggatgttggatccatttcatttatttctgcaggatgagattgtgaacaatggattatctgttattaggcttgggatgctggtatgatgcaaattcctgtagattattcaagtcaaagttactatagtttttttttactgttggagttctgtttcagtgccaaatattcgctgagcatgatgttgtgttgcagtggtgcctaattgcgatttcaatgggatgttctagacagatgtgtggagtggggtggaggagaagcgtagtcgatgatggtgaaacacagcgtgtttgaggaacaaggtgatcgacttgaagggcgttgccagcaaccaggctgcttctttgaacaccttggttaggtaatatattcaagctatgttagatggaaattacttttatggaaataggtgcatttgtgatagcccatatattatttctttatagttattagtgcaattacaattatttagcatgcaagctaatagtacttctaatgaggctacaaatgcatatcatacttatatatgtttgtccataacgtgttgtttagaacagcttaaacaaaccaagcaggaataatttttatttatgtttcctgatcaattaggaagtatatttacaaacgatggcatatgggataagaggatttcctttctttttgtgctatgaatcccatcaaatttctgctatttttagttcacgcaggagaagcaggagaagagtatacaccgtgcttttgctctcagtattgcgaaccagctcacaaatatattccgtgaccgagagaagtgccaatacaatagttttaggaagttgtgttcgatgatcagttctgagcaactgagccccttgtagagttgtccccattgcagtggataaaattaccaagtgcctaacacacattccatcagaagtacaacttgggttttgaaagacaaaaaaattgctatgtaattaacaatgtataaaaattctatattgttctttttttcaatcaatcttgagtatatatctcattctcaaacatatatctttttctattatttgatttgaattatcaaatactgtcgtagcgttagcacatgcatattactttgctatgtaattaacaatgtataaaaattctatattgttccttttttcaatcaaacttgagtatatatctcattctcaaacatatat

SEQ ID NO: 58405 - DNA, 3182 bp, Oryza sativa
gaaaaaaaagaaataagaaaataggcaatactagctattaaaacataattcaattactctggattttagttattctcatgaaacttcaaattttcagatggaaaatttcacagggtcatctgtcagttctgtcgcatctctgtccacagttgatatatgaaaagaaaaatccatcctgaatagaaaaagaaaaacagaaaaaaaaaccttttgtttttccttttttctcacttgtccctacttgaccagtccttgtccctatctcccctttctcaggtcaaccgattctatccaagatccagtccccctttctccttccttccttcctcgagcctcatttcccccccaatcttcttcccaaaagcagctccatccaaacccaatcaagccccactccccaccaacccccttccctcaattataagcctacaactactgctgattgcttcagactgatccaagaaagggaagtttggttgtggtgcaaagaggtgcagaagggggagggagggctctgaattttcaagaaagggaccatctttctgctgctgctgctgtccgggttggtgcttgttgaatttgaggctcaagaagtccgaattggaggttttgtaagagggaaacaatggctggcaaggaaatctaccacaagatgaaggacaaggtactgagtaatggaggactggaggatggggattcttgtttgttcttcctttggcctccatttccctttcatgtttattgtttttttttatttttttgctattcctgtgctatttttggggtaatatttaggtgcaccgttgtgtcgaatcttttccttttcatattagcttgaggggatcttgaaatggcgaaggctataagtctgaacatgtcttaaaaatcttggaatgatgctaggctatggtgtctatttatttattttgggccaaatctgttgcttaattacgacaatccaatggtttgtggttctataaacataatgagtcccgatgccatgaaactccgtgttgacgttagattcttggagttatcatgtttctcgttcctactagcagaagcaggaaacatgtatcagtggagaaaataactactgaggaaacaaaacataactcgtctagaccagtagagagacaagcatttcaatatgttggttatgggaatctggtccatttcaccataaaacttcaagaacacgatctccggcttttgccggttaagcatgaattttattttatgcttagatttttttggatattcttttttatgaaagcttttggaactcaagaactcgtttgattgacgttgttccttgggagttttagagtttgcagcctggaaactagaagttatcttgaaatgttatactctactcaatgtagaatacacacatcactaaatccagactaaattcattttggtagactaccttatgcaccttctttgtgtttattcttgctgtgatgcaaccaatgtcaaaaaagcgaaaactgtttttttgctccattgtgctggatgttttccgcaagcttatatatttgctttgcttagtgttgtactattagcaacttaacatgcttgacgaacgattatgttttgtttaacaggtgaaagatgcttttagttcgtcaggaccagaaacagggaaaggaaaaacaaaattgtcaggcaagcgtgtcaagcatggttaccatcttgtgaagggaaaatcaaatcatccgatggaggactatctagtggcagagtacaggcaagaaggagagcatgatctggggctgtttgcaatatttgatgggcatttgggccacactgttccagacttcctgcgctcacatctctttgataatatcttaaagcaggtaatatttcaaattcaatgtcctgttaataggcttagcctcaatacttgctgcattgcctacatgctcagatagtaagattgttttgtcatcatgcgtcaattgttccaatattgtatttttactagctacatgtcctttgatttactatggataaaaatgaaccatccaagttctaatgctgttcacaataaatagttgtgtcattcattttttttgtcgttttaaggagcatctgacagtgtctgtacttacagtaaaaataacccattcgctatgtacttttatgtgttaaattctgagtttagaaggtttaaaaaatggaattagaatatatggaatgaagattgcataatattaaagaaatgtaggaagcattttgagaaaagaaaaacaaggcggagttagtggggtggcgatttaccaccagcatcactactctttttcttttaggtattatacttatcctcaaaaacacagaaagagcaagtcaatctataatgcatatggtaaactataaacagggtaagaagagttgtacttctgttacgcttacaagtgttatctgtgcttgttctacaatctacttgcaagaaccatgctaggaataactatggagtgacctaaatatatagataatgtctatgcaattgaagatagtcaactgaattcacaactgtgctgattatttattgactccttcaacctcagccagaattcttgagcaacccacaagctgcaattcgaaatgcatatcaacttacggatgcaaaaatattggaaagcgcagctgagttgggcagaggaggctccactgctgttactgccatattaataagcagtgaaaattctgtgaacctagtagttgcaaatgttggagattcacgagcagttattagcaagagtggtgtagcaaaacagctttcggttgatcatgaaccaaacaaggagcggcattcaatcgagaaaaaaggtggctttgtttcaaacttaccaggtaaatgaccatttcttgtcaactctttttcctttttttttttttttgggggggggtttagtcattgtaattaacagtttaaagttatagatgttttttactgaggtttttttgtttgctaatctagtgtatctaatgtttagttccacactgctttcttatttggatttatgtccttgtatgactatatactagccatgtggccctcaatactgcccatctatttgagcccgtttcattggttgacattgcatcagatcctaggtccaggatacaccctaacactaagcatacctatgccaatattgcattagtaattacca

SEQ ID NO: 58406 - DNA, 12136 bp, Oryza sativa
ctgtcacaacatatgagatgcaatctatcgagcttcaattccaaaaattttttacttgcaggagatgtaccgcgtgttgatggtcagcttgcggttgcaagggcatttggagaccggagcctaaagaagcacctcagctcagagccagatgtggtggaggaacctatagacgagaatactgattttctaattcttgcaagtgatggattatggaaggtgatgcctataaagctcataccaaccatccatgatagattacacctaaatttattgttttgcattctatatgcatacctaacctaagctcaacaaactggagaccatgtcctaccttatttaattctatatacacaccaaatctcagaatatgcatacatgcatgcactacattatttaattttgaacatgaggtactggaggttgagttttgtctaacaggtgaaagtgcttattcctacatttcagctacttcctccgtcccaaaatataagcatttttagatatctacacggtcttcgagatgctactttgaccaacaatgtctataaaagtaatatgttttaaataaaaagagttgcatattatgatagtttgtttaatgataaatctagcaatatcaaatttacatgattgatctttttcattattttgctattaatagtcaacatttaaaaagtttgatttggcactattctaaaaatgcttatattttgggatgaatgaagtatgtaatttggcatgcataagcacatcctgactcatgagttgcgaaccttgatttttctattttcttaagctgcatctatgactattgcatgattgtttttttttttgttttagttgagttctttactctttttatgctagttttcccaactcacctcgctcgttttccacgtgcatgcttttcaaactgctaaacggtgtgtttttttgtaaaaaatttctatacgaaagttgttttaaaaaattatattaatccatttttcaaaaaaaaagttaatacataattaattgtgcaatagtacgtgctccgttttgcgtgccggggaggaggggttcccagccttaatgagctgctaagttgcattagcgacgttcttttatcatatgcaacgattataatttcaagatcatacatatccaggtgatgtccaaccaagaggcggtggatgaaatcaaggacttcaaggatgctcaggcagctgcgaagcatctgacggagcaggccgtgaaccggaaaagcaaagacgacatctcctgcatcgttgtaaaattcctctgctagcagaaacagagtctcatacaagtgtacaattgctaccatctgatggtttcagtgttgttacttttgttgaatattctggttagtcttgtcgaacattgccgattgttgaatgccccaatgggacatgttcatatattatccctacaattccagtggatggttcattaattccttttgccctatcactttttctttatcaaaattctctcaacgcgaaaaaaaaataaattgctgaatttttttatctcaattctgaaacaaatgcataacacaaacatgcaacaaaaattgaatggcctgaagaaaaaaaaaatgctcgcatggggaactagctaaggattaccagctgagtctaaatgtaagcacaacgtttggcttaaaacagcaaacaaaaaatattttatgaataggacttatatatgcttttagcaatttaaaagtaaacggtgaaaaataaactataatgaaaaaactaaaaaattcaaatttagagtggctttaaaggctgagttcagcaagggagttagaatccttccccttcaacatataaaacggaactgtgaattagcgcataattaattaattatatgcttaaaatttttcaaaataaattaatatgatttttcaagcaacatttctatagaaaactttttcataaagcacatgtttaataattgaaaaagttaaatcaagagcgctctcggtttcctcctatcgcgcgacgcatcttatagccgtctatccgtgtcttcgtgctgttggagagacacgattgcttcatcaaagtgaggaatctgtatagcgtccagtattgctacaaaggacaccaccaatcatcaaaactaaagattggctacactagcattgttattttagtttagtttgtaccattatgctgtactcaaaatatacgataaaacgagtctaacattgaatatatccaaacattttaaataattacttcctccgtttcatattataagtcttataatatgaaacggaggaagtacttgaatcgtagaagtaacttagctctgcaatagtaactacgagataccctttttggaaagaggcgcgccttcgtacatatgctaattaggagaagagtgagttgcgtgtttaggcaacgaagcgacttcgtgctacgtagtcgcgtccccatttaataatttaggaagcatatgcgtgaaaaaaaagagagtgttgaacccacggtcccacactagtcactagcgtggaaaaaaagggagtatagaagtaggaaaaagtgtaccggaggtccctgaacttgtcaccgagatacgaaaatgtcctccaaccgcaataccagatatggggggtcccctaagtatgcaataccggtcacccgaggtcccagggcaggatttctccccgatttgtctgacgtggcagcggttttgtccaccgtggcgctttgacctcggtcgtcgtcgctgacttagcagcccggtagttaggacaacccgtggcgcactgaaggggcattcacttcacttctccctcctctggaaaccctagatcggcgagggcgacgcagctagcgatgaaggcgattcggagcaggctgcggcggacgggcggagtgtcgtgcaggcgaggcggtgaccggcgtgcctctaccgtcgactacctcgagctcgaggtggatctgggggcggcttaggcgcggcgaccagcagccaccttgggcgacctcgaggttgcatcggcgagtacccctccaattgggaatccgaatctggcaggtattacctttcgtagttaactgtgtgtgcttgcatggtaccagtgggatttgggaagtgaaattttttatattgtgagatgccttttttatctgggatttgatgtaagttgggagttttttatttaggtatgtagttgattagaggttatttaggcttacctctgtgcaaaagtttcgatttggacatggtatgcatgtgtaggtcaattataatataccctaaatcagttttatatgttgtttagcatgaaggggatggacgtgttggacactctcgtggttaggtttcatatgaatggggtttttctgttagatgggagtgagaaaaagtattgcggtggatctgaggctttgtcatatgtagatagggataagatttccttgtcggagttatttggacacctgaaggagcattgcaatatgttgtcagggacaatgctccactggttgtttcctggtagggatttcagacaggtctaagggctctttgtgatgataaggcttgcaaattgatgtgtgattgtactggagaattggaggtggcagatatgtatgttgaagagcccaaaattgtggatttgtgtgataagtctgatgatgagagtgatttatgaggtagagatggaattggaagttgagagtgaagaagatggggaaaaaggggatgtacatgtagatgcatctaaagggaaagaagttgacaagggtaaagcaatagcagaggaggaaactgataggaggatagttttgtaccaatctgaatcagcacctctagttagccatcaaccttttagcagtgctcccaaagctagccatgaaccttcagacagttcacccattccaaatcagccaacatatgacactgaacccatagctaacgatccaccttctgatagtgatgaagatagtgactatattccaggggatgaagctcagtcagatgatgatgaagaggctgctgagatagagaaacattacaagaaggtcaagaggaaggtgaaggcaggacagctagagaacctggatgacttctttctagagaggggacaaccaagtgtgcatggtggtgttgaagatgcagggaatgaaaccccttatgcaaacagcgatgaggaggactcagtagatgagattggtagtgatggggaggtgaggactaagagaagtaaggaaccaaggtacaagaagagtgaaggtgtgcctaagtttgaactagggatgaagttcaactgtaagaagcaattcaagaaggctattacaaaatatgctcttgcagagaagaaagtgattaactttattaaggatgatgggcaaagggtaagggccaagtgtgattggcataactgtccctgggtatgtttgctatccaaaaattctaggtccaacagttggcaaatagtaacatttgaaaatttgcatgcttgtccacctaggagggatagtaggctagttacctctgttagaatagcagagaagtatggaaacttcatagctgctaatccttcttggctacttgctcacatgaaagctattgtacaagaggaaatgtttgcagatgcttctgtggctaagttgaagagagcaaaatggcttgtgcaaaagaaaaagtttgaggctactaaggggcaataccagcagttgtataggtatcaactagagcttcttagaagcaaccctggtagcactgtggttatcaacagagagattggcatggttccaccagtctttaagagaatctacatatgcttggatgcattgaagaaaggtttcatagctggctgtaggaaagttgtgggactggatggatgttttttcaagagggcaaccaatggagagctgctgtgtgcaatgggcagagatgctaacaaccaaatgtaccctattgcttgggcagtggttgccaaagaaaacaatgaggaatgagattggtttcttgatttgctttgtggggacttgaaagtggggacaggggcaagctgggtattcatttcagatcagcagaagataatatcattacaaactgcttttttcacttgtaaatttccatcacatgtcactgaacctttattttttgtatttccatacagggtatcctaaatgctgttgagaagtgggcactggaggctaggggtggaaacgagccgagccaagccttagctcggctcggcttgcaatggctcgcaacaagctaggcttggcttggctcctctcggttagggaaacgagctaaaacatgagctcggcttggctcgtttcttggctcgagccagctcgagctagcttgcaagccttccgttgaagctatataatttgtaatcattaagaaaagcaataacaaatcatcaacatgtaaaattaaaataactttatatattcaattcatcaagatctagacgataaattacatattaacaaataataactccactacaaaataaaatcatccatataaatatatgatggcctaggctcacgagccagctcgggcttggcttgttttagaaacgagctgaaaaggaggcttgggcttggctcgtttggcattcaagccgagccgagctaagcgagctcgagccaagcctgagctgagctcacgagcccgagctttttttccacccctacctgaggctgagcacaggaactgtgctaggcacatttatgccaattggaagaggcattttcctgacaagcaattccagaaaaagttctggaggtgtgcaaaggctccctgcaggatgttattcaatcttgctagggcaaaacttgctcaggtgactcaagctggagctcaagccatactgaacacacaccctgagcattggagtagagcctggttcaggttaggttctaactgtgactcagtaaacaataacatgtgtgaatctttcaacaaatggattttagaatctagattctatccaatcatcacaatgcttgagactattaggagaaaggtcatggttaggattagtgatcagaaatcaaatggtgcaaagtggacaaatgttgtatgccagggattgagaaaaaactaaatgtttacatagctgagtcagccttttgccatgcaatttgcaatggaggtgataattttgaggttaatcaccatgaccataggtttacaatacatttggacaaaaaggaatgctcttgtaggtattggcagctgtcaggactaccatgccctcatgcaatatcttgcatttactatagaaccaacaagctagatgagtacatagcaccttgttactatgtggatgatttcagaagcacacatgtgcactgccttcagccagtagagggaatgagtgcttggccggaggatgatagagaagcactcaatgctcctggatacataaagatgccaggaaggccaagaactaaaaggaggagggagatgcatgaaccacccaagcctaccaaaatgtccaagtatggtactgtcattagatgcactagctgcaagcaaattgggcacaacaaatctacctgtgcaaagcatcatggtgcaagttctagcaacctaggcagttctgagtagcttccatcaccaagtcaacagatggtgttatcaaacacaccaggcagttctgctcaaagcaggaagaggaaagctgtcagccttactacaacaagcaccacagaacattccaagagcaaccaatcaaagagcaaggtaaatggcaacaatttttcactattttcactttcgctaactttacctaattgccatactttcccactacaggcagcaatggatagccaggaagtggtcagggttgctgcaaaggccaaggtttcaacagctcagggtggatctgctagagtagatcttcaagcaatagttccccattcaaacagctctactactgcgtctgtgaggctcacatctggcaaggcaactgtcactgtctcagctcaagagcctacaaaaaacaagccaaagaagagagctggaggattacttattcttctgccctgggaagcaaagaagctttgaatgtgccattgtcagtaatgttagtgcaatatttgaacttcttttgtgatgtaatggcagactatttagccaagtaatctgtgatgccaaaatgtttggctatgtgatctctatgatgccatgctatttggctctcttatcagtgatgtaagacaaattatttatgttgtcatgccagactgttaggctagctatgtcacttattatgtgtatttgaatgtcagacaatgaatgtttgcttatctgttactgctggaagccaaatatggagtcacattttgcattgtcatgaggtttgctgcagaaattggcaggtttcatacactgtttgtatttgtttcatttcctgctgacatggacatttgctgcagaaattgacatgtttcattcactacacaaatggatttttcatacaccgcttgattttgtttccctgaacaaacaccaaaatttgcacaacctgatacacattgcatgctgattttctttcagattccatattgctcttaacacccactcattcacaaatttaattccaactggatagcacaagtgcacaactgatacatacatattttgacacatcaaaggaaagacttgatcacaccattcagtccacatagcatatagacaacacacatctaacaccacacatcagtccacacatcaacatgtctcattccttcccaactaacaccacaaacagcataaaaatacgtgacagcatacagattacaaggatttttttctccttctctaacttttgattcctagccttcaagcttctaattttttcctttttcacagcaaccatagccctcacatcatctatttctctcctctctcgctcccccttagcccgactgtcttcaacttccttatgcaacaattccttctccctcctcaacgaattcaccatgtcccgcaagtcattcaatagctcactgatgaaactggaagtcgggtcgtcacaccatgcccagaaatcacaccccccaacctgaaaccacaaccctacattcaaatcccaaaccgtccaaatccaaattcaacaacagaacaaccaaaagccctcacttaccctagcatgttaacacttgtagtatcggcgcccagggttgtccgtgctccatgagatccacctcgccgctttcgccgggcatcggcatcggcacatcaccgcgggttggtaatccagaggaccaacccggtaaggcacgggagaaggcttccactgatgggaagacgacgagccgtcgctcatcgagctcgacatctccgtaccgccactcgccaagtcgccgccgctctacaaatcgctgccgccgccgccgcccgctcgctagggtttcggtgtttgggggagaagcaaaccgcgccaaacatttccctcgttatatcctaactaccgggctgctgagtcaacaacgacgaccgaggtcaaagcgccacgatggacaaaaccgctgccacgtcggacaaatcggggagaaatcctgccctgggacctcgggtgaccggtattgcatacttaggagaccccccatatctggtattgcggttggaggacgttttagtatcttggtgacaagttcaggacctccggtacactttttccatagagaagaagtatataatacaattttatttttttgaaaaagccatcgattctgtcgatgccgcagtagagcccattgggccaaacctggcccaggactagaatacgcgcgggccaagaaacagggcgccgtgtcgcacgtcgaaaaccctaaaaaaaccaccgccctttctccactcctcccgacgttgccgcctccgcctcctccccctccatcgccggcggccgcttctagccggagagaagaaggcatgccgcggacgagcgtggtcgagagccccggctgcccgccgctccgggccctcaccaccgacatcctcggcctcatcaaaggtagcccgtccccacccttcccgccgccgccgccgccgcggcggcggcgtgctggtttgcctcctccggtgagagggctgatcatgttttgtggtattcatcctcaaccgcgcagtcgtggaggcccgcacgaagccggcgggcgtcgccaaggtcgtcgagacgtggggcgcgcccgacgcgccccgcgccgtcctcgccgcctcgctcgccgaccgcgccgtcgaccccgtgagtgttcgcgacctcccgttattcctccccgcggtaattggtcagagtatgatcctcactgcgttcctcgcttcttctcttcttctacaggttttggccgtggcgcggaagaacggcgtggtgagcaacgcgtttgcatttggagagctgaagcactcgttgagcatttttgtgctggttgtttattgctgtgggttttgtgtgtaggttgagctgctgaatccactgaatggggagactctcgcaggcgtcaacgctgctgctgggcgggcggcaccggctgatagttctgcagaagaggaccccttagccacgctgcatctcttcagaagacatgcgctggactcatccatgtaattttcatttgatgctctttggcaatttattgtgcacactcaatttgccatgtagatatgggttatgaatccacctgcatttgtggtctccatgctttagtgttctttcattttgtagataatggcatacttatgatgtattcattgcatatgtcaggttaggcacatttcttgcttgtacagagaaggggaaagcatatgtcaagtctgtcgcaaaggaaaatgcatcctcggacatggctgttgggccatcaagctcatgggatgtgagcaattcgggtacagtgcaattttcttcagtggatgctggtgaaagctacgcgatgttcggagggtgggtttacaataatctttatattcattatgtagcatctaagtgtactataaaaaaatattgcttctgattactaactactcaattggaaacatgagtagcttttatgaaggttgaggcgctaataataatatttcattttaggaaaggaatagaagtcaatttgtgggatatcacatcttgtagtaagatatggtctgccaagtctgtaagcactcactgactcacaccttttatcctttttctgggtctacttgcacttttatctgatgttatagcagactgccacgcattaactacttcattcttttttttacctgaagcctcgaggcaacagtcttcagatattcactgcaccttggttcactgctggaacttttttgtgcaaggatgaccatcgtaaaattgtagcctgcacaaataatcatcaggtattgctgatatgctaacaaaaaagatccattttcaactagtttggtcaaactgctctgtttctgtattgttgtctcattgaaactgatccaactttataatggcaaagcagaatgattgcaattgattagttttttcatgccagttagttgtcatgctgtatagtttcctcgtataataaatcatgaaaccgatactggattatgctaaataggatgttctcatacatcagttttcatctttcaaaataacactgcattgatgaggttttctcaatatttgtacctgtggtgcttcttctgattgttaggttcgcttatatgacactgcttcccaaagaaggcctgtaatttcagttgattttagggagtcaccaatcaaggcagttgctgaggacccaaatggacatgctgtctacattggtacaggaagaggggaccttgcttcctttgacatgagaacaggtattatatgatagtagctggtgtgtgataattcttgctgatggcacttggaagtcaaaatacattctgaattatatcttcagagttgtagcttagtttgaattttgtatctagtatactatagttcaaataaaaatctcttttcattttcgtactctacagttcactctggcatgtgtatttcattgtactattttttggctaccatgctctgatgcttacataggtggtacaacattggttgtttatttattttcctgatcgattcatagttagttcatcatgtgctatatggatacatttaactgcctggagaagttttatttaaatttaacttaatattctgcaatgagcttatgcatcatgcacttttttggaggaacagagaaaacaaatatgcatctctgtgggtttccaggaacatcaactgtgaatcaaaaccttcggttaatattcttgctaaaaatgcacctcctcaattgattcctgtgtacatccctcaactatagcatgaataaagttgtgctgttatggttcttgtactaacctgagcaaatatgccaacaaattttcaggggatttgagactactaaactatctgtgagtgatattgaaataccagataaattggtttcaattcaggcgttagaaagatatcttgttcatgtcccttatcagatatcaaaagatgtttgattattgtatgcttacaacattctagattatattctatgtaaattccttacactttgcaatcggtattcactttttagttctttttaatgtatctatttacagaattaactttagcttgcacccttttcccaggaaaactacttggttgctttgctggtaaatgcagtggaagtattagatctatagttagacatccagagctacctttgatagcatcttgtggtaaggctgcatattttgaaaaaatatttttccaattatttcatattcatttattttgagcgcaaatttattggttacatgtatttgtcttgcacacctttactagtctaggttattctgtttgcattaactcaggaaaccaatttactattgtaggactggacagttacttacgcatctgggacacaaatacaaggcagctgctctctgcggtacgtttaacagttaatttcatagtattcaaatactatattttccatgcaattaacagatactgtttcagttctgcttttatttgccattgcttcattttgacataccatataagtgaattattgtggtcatgaagacatcatgggctagtcaaacattttagagggctgcaggaatt

SEQ ID NO: 58407 - DNA, 2054 bp, Oryza sativa
tattatcttgaatagaagggctagttaagatagtaatctacatctttcagccctaggaccccaaagcccaagatgtagtgctactcttcaaactttttgaaacgaagttcattgccatatcgaattgattcatgaagaattccacgtgttcatctacttacgctcttgttggatgttcagaactcgaggagactaaatccaagcagccagatccagttggggcagaagttagaaaggaaagaaaggaaaagaagaatagaacgagtgaaatggatgaagacgaaactagaatgctcgaccatgatgacagtgattctgaaatgcacacctcaaagagaaaaaaatctggtgaaaaaagcaaaggaatgaaaaagaaaagcaagaagcagcaagtcgcatagataggacacacaacactggagtcagtgttgaccagttttgactttttgactaaggtgctttgcccttcactcgattttgtacaatgaatatcatttgtattagagtttattcgaactcgaacaatagcacttatctggattctcaattcttcaaatacttgccgggccaattaagtattttactatgccttctgagcaatataaaagaaatggcgtattatcaccccttttttgtgtgctagtccgtcctttcttatcaagctgaagagtttagttttgatcatagtgtttccttactctatataaattgataagagaagtgcacattttgtccaattttggtccatcaactataaaaccgttcattatagttccttgactcttggaacagtccacatttcatcctacatctaaactgggggtacggtaacatggcgcttgagttgggtccacatgagcaaatagtaacggtatgaatatagcaaccataatgaacgacagtgaaacaaaaacttgaacaaatactaaaaccttgcctccttttcctttcccatatctcaaattttttctttttgaacaaatactaaaaccttgcctccttttcctttcccatatctcaaattatttctttttgaaagaagctatatattatttaagaaatttctaattaagattgtcatgtcacacggagccacatcaccaaaagctacgaaagatgaggtggtttgaaagagatcaataatgacgaccctctaaaactcagtattaagaaaacatagagtagaaaaaaaagtaagaatagaatgtcatactcattgaattcctataagattctgaagcataggaaagtttcaaattgtctttgattagcacatagaaaaaacccaaaaattctacatgaaaaggaaagcatgtggtgagacctcatgtttatttttatctaaaattgctctaggatgatccattccataaaaatttcaaaggaatggataggaaacaattttgttttaaagggtttgataggataaaatcagtattactatggtttttcctttgtttcaaattcatgtggttttttctttgtttcaaagatggtctgaagccttgaacgaattcatagtgaaggactaaatttggaccgagcggtcaagggattaaatatggagcttttccaatcgataatggcatggaagtagttagtggagtgaaatgagcttagctgaactggttaagttccttgcggtggaactacccacctaagtatcctatatttgatacgtgtgctcgtatttacggctaattattttttcagtggtagataatgtaattgttgatagcgagacacctctctttcgttgtaaagttgttagtggaaatctgatgcacgccagtttcctactattaatgccaggaaaagaaaattgcccatttccatgagtggtacaaggggaacaaaattaatctttacatagttcccttcaaggcttgaataactttattaacatcgtttccgtatgaacattttgcttatctataaactattaacttatctccatatatatatagcatcttcagaaggatcctggcaatctcctcatcacaacaaccatgtgatcatatgacagccagaacaaaaaacaatggcagtcttct

SEQ ID NO: 58408 - DNA, 1623 bp, Oryza sativa
tatatgtgtagctagattcattagcatctatatgaatgcaatgctagaatgacttacattatgaaacagaggaagtattatttagcagtttgaaaagcatgctaacggaaaccaaggtagaatctacgtactaatcagaagagatttgcttcggtcctggtgcatggttcctcgcggtactaaatcattttcgatcgttaaatctagctaggtagggtggacattgttagatccaacgatcgaaaacgatttagtaccatgaggtactttttattgaactggagcgaatttctgatcagaaaagaacgggaactgtccaaaatgcagagctgttgggggaaaaaagaggaaatggcattacctgcagccttctgcattcggcttcgagcttggctatcttcttgatgctctcaagctgctgcttgctggccgtctctgctgccctcctgttcagctccttctcgatggtcctgagctccacctcctccgacatggccagcagctgaaccttgagagcagagttctccttctccaaggaggccagccttgagctcgcatcagtttcagcgttcaccgagaactcggacttcgcctccagcttcgccttcagctcgactactcgcagctcgaggtcggccttctccgactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgcatatgcagtatatccaggtccaaacagagtcatttcttaaattttttggcccagcgaaaaacaataatttgtttgaatttttgcttcatgtactgaaactgtacgattcagtcatgtttaacatcatacctagaacagcttcctccgcaacttttgaatgctgcttcacaagatcatcttttgcacgtatgtccaaaactgcagatgacagtctctcgctcaacaccttcaccttcacattgtcatcctgcgcttccttcgacgagatctccggtgattgaactgagcttggagaactctttggagtatcctaaccaagaacaaacaggatcaaacattgtcctgactagaaagtgcaaaattaggaggctattcatgcaaaatttcttgtgaacttcagctattagtcatgcaacagtattgcagaacaaagggagtggctgaagta

SEQ ID NO: 58409 - DNA, 2688 bp, Oryza sativa
tgtggctagtatgattgggagctgctatgtggatgtctacgaggatgtcgcaaacgcgcgattttcgcgatatcaccagacaagagaataaacctgctaggatggatgaatcatcaaacagaaagaataattcttgtaccctacatggtacaactaggattggtcaggaagaactgagctgtttttatgcagaggaactctgatcctccatcaaaatctttatctaatgccatcagagcttcaaatcttaaagagttcacatctgcaacatggtggtagattaccaaagcttccagcctctacagatctgaaaccggatgaaacctcacatgtttgccatatcagatggacccttattttctctgtactgcacatgttacatgatctgttcaatggaaggagcgtagggctcacaaagtcaattgacaatcatcaattcgtttgagcatgcttgcacaacactcctagacactagacaggtattatcattcttcaacatttgagcctcttttactgttacccagttactttttcctgctccttggacccattggtagtttgagaaatgtgagataaacatgcggaaatgaccgcgatttcggaaaaaaaatatgaactttattttccgagaacacgcagaaaagctgcgtgtctttggattggtaggaaaagattactgcccaattatcgtgatattctaatattgcaagtagtacctactgtttgactttaaattgtgcaaatatgtataaacttctgaaatgtgaatgcagtatacagggagaagaagaaagagagtgacttgttttttttttctcacctgttcatcagacagcctctcggatggagaagaaaccgagctctcggtctcggccgggctcttctccgtcgatctccgccgccatagccagctccggcgatccatccctggagctctctacaccattcggctcaatgccgatgcttctgcgcctcaatctctctgcttatctcactgtcttcctattcagcaatccaaattcgatgagttcatttttttttctgaagaaaaaggaaagaaattttgcctcttatattaataaagcaggaattcgatgagttcatggtcgcacaagaaaccaaacacacagaaaggaaaaaaaggagttgcagcttttgtatttttgtccgtccaagaacacaatcaaaaagccttcaaaaagtcaacttgatacagtccagtgaccgtgagacaaaacctccttgatcgagacatgaaattcagctcaagttcagaagtttatcagtgtgcgacgaactcacccagaaaaaagtttacaaatcctaccaaattaccatcccggcaccaagacctatcactctatcagagattcagagccaaaatttcacccaatgcatccacatctaatcagagaagaaacaaaaacagaaagaaaaaaaaaagaaagaaaccatcctacctgccatccatggagaatgaacagaaaacaaccatcagatggattagctcgtactgggccaatccaagaacaagcattgcatatcgttttcacctcaaaaaccacccaaatcaacccgaaagatttcatcaagaaaaccaaaaatcccagaacacgctcccctccactacaaattaatcaccaagaaatgggagaagcgaaggcagagtccacacgaacaggacatgaatccaagcagagaagaagagcagtggagcagcagcacacgcacctcccggaggaggccgagaagcgtgacgagccgcggccggaaggaagcgaggcggcgcgatacacgagacccgacccgctggattcctcctcctactcttcctcctttacctcgcctatttaaaaccgcgaggtcggagagtacaaaaggagtgtgaaaaataaatacttgaaaaaaaagagagaggaagaaaggtgtggcgtctcaatagggagaagaaagaaatggaggcttcgatgtggcattttcacgcgagataagggtttgatgaaaaaaaactgagaaataggaaaaaaatacagtattttaacaatgataagggcccctttgaatcaaaggaattataaaggaattttatagggttgaaatactataggaaatttttccacgtagccctttgattcaaaggattgaaattttccaaatcctacaaaattcctatggaatggcttgttgcatataggttttagaggaaacttagcaagaggtccaatctcttggtaaaaatcctttgagtctatctctctcatccgattcctgtgtttttcctgtggtccaatcaaacgatcattcctgtgttttgtaatcctctgttttacacttacattcctgtcagaatcctatgtttttcctattcctccgtttttttattcctacgattcaaaggggcccttaatagtgcaaatgttgaaaatataatcataactaactgggtgacccgcgcaattgcgcgggtagcacccaaacaaaatcatatatttttttaatatgattttacttaaaatttattaaatagctatctaattgtcttaaaactttgaaggactaaaccttatcatccctgacggagcgtggagctcctcaccgggagaccgcgcaggcccccctttgccggttcggccgggggcgctaagtgaggttcttcgccctcgatcgatctggagaatgttcgcgaga

SEQ ID NO: 58410 - DNA, 1317 bp, Oryza sativa
tgcctaagcctaacacacatgacacatggacaccgaacacaaccgtagttcactgcaaaggtagcactactggtaggctagtagcaaagctgatgagagcagcggccgcagattcacagcacgatggggtcggacgactgcgagcccttccctcccacgcgcctgaacctcttcgcctgcacgcagctccggctgctccgccgcaccgcgccgccgccgccgcctgatccattcgccgccccgtcctcctcctcccgccgccgccgccgccgccacttctgctcctcctcctcctcctcctcctcatcctgctgctgctgctcatcagaccgctccttcggcggcacggcgtcgtcgtcgtcggcgtcgccgcgcacgatccccggagcctccgcgtcccccgtgccatgcggcgcttcctgctcgcgcggtggcatcacagccaggggagggatcaccgcgatcacctggggctggggctgtggcgcggcgtcgcctcgcttaagcggcggagcaggaggggaggcctcgatgagaccgcggatcctggacagggacgtcgccagctcggcggggaggcggtgttgctccagaaaccgcgcgacggtcgggagctcctccctgacgccctccacctgcatgaaccgatccaatcgatcacaacaacgaaacgcacgatgcaatcacccgaactgaaccgcgatgacacgctcacgtcaatgtgacagcttcctcagcacgagtgttagggagatggattctaatctaatcactcggtgcatgtccacacgtttattatacgttagctatatgactatgatttttttaaaaaaaatgacaagatagattgataacaaacatgccagcaaattcgacttctgtaagttgtaacaatgataacaaagttaattgcgaatatatctatactaattaaaatttaatttgctacttttattacaatttaaataagtaaaatttgagcttgcatatttgtaggataacatattattacatatgaatctaccttgttattttttttttaatttttttataaccatttagttgatagtatgtagcaaaagggtagatgtccacctaagtgattaaaagtgtttcaccgacaggtagttttaccacggatatcaggctgagcccaagggaagctcgcgccatggtcgccggagtgaaaacatctgcggcgggggcggcggcggcatctgctgtatgaccatgatcaccaccatctgcagcgttgatcagctgctggaaccgttcgatctctgaaacggacattaagctccagtccactgccgggtt

SEQ ID NO: 58411 - DNA, 715 bp, Oryza sativa
atgtgaagttctttacttgccataggttcattggttggctaagagctctgctggtaaattgctctttcaaattctgacattgcactccaagttcagaagattgtgctttctctttgtgaatttcctcctcgagcaaacggatcttcctgcgcaattcctccacttccgcctctttgagctcaaaccgactggcgaatttgttcttctgggcttcagaagcatccaatgcagtaatgtaggcagatgacaagttcttctggctttccagcttcttctccaacgaactgacatgatccttcaggcgcatggcttcagcctgtgccaacctgagctgggactccaatcctgcagtcaatggcttgtgcttctcttcagcctcttcaagcatcttaaccttctcattcaggccagcgatttctgagtttgcagattggagctgagatctgagctcatttgtctgcacacccagtgcctctagatcacaagaccgtgtcgcgagtttctcagacagtgccctctcctcctggattttcagttccaagatgctaactttcttctgcagagatgcaatttcctctcgtgccgactccaactcatgctctgtacccttcttcttctcttccagagcttcgattccatggcacctcactgcgagccgggttgaaaacgccttctcctcctccagcttcttctctagaagagtgatcttatcacc

SEQ ID NO: 58412 - DNA, 1072 bp, Oryza sativa
gttccacgaaggaagccaagctatatggctgcaacagaatctgcaaaggcaaagttgcgaggacagaattcaccaagactggattctgattcaccagcagacatgaatggcttcacacgccgccagtctctaccttcttctacaaacagtaagttgaacccacactcacctcatacacaaggaccaatctatttcaaatttgactaagtccatagacaaattagtttcatcaaatcaataattgaatatatttctaaaactaaattagttttatcaaatcaataattgaatatattttcataataaatttgttttgggttgaaaatgttactacttttttctacaaacttggtcaaacttaaagcagtttgactttgaccaaagttaaaacgtcttataacctgaaacggaggaagtaacagttatgaactaaaaagtgataaatccatgttaccagaaaaaaaatgtcgctgttaaacattaagcaaaggtaaccatctgaaaagataagatgatgttctaggctatcagaatgtgacaaattttgagtaatgatagcaaaaatgttcacagggagttcatggtattattctattgatcccagaagaaacacaactgtttattccatgtttaaaatactcccttttttctagtacaacaggggctttttgggtaatattaaatctgagaataaataaaaatggttgcacacattgtatttacattcatattctgaagtattgcatggattataaatctgtcgccttgactatgcatctttctgaagttctgcaactaccatattctacatagtcgcaccgggtggcctattgccacatttgttagcattgtatgtacttgtgttatttaggcttttactgacgttagaatggatctgtttgcatctgatcagtttaaaattcagacttcacagctcatgagccaacattcagtttttccttttcgtttctgaattctgatgtcccattttgcttgtttattttttatttttaccatctatcagacagagcgatcagagctgaatggagacggtggtgaggacaaccaactt

SEQ ID NO: 58413 - DNA, 5148 bp, Oryza sativa
tcggggaaaaattatggtgcatcgttctcatttcaccttcatgtactgttagtggccaccatttatttatcaagttagctaggttcatcttgaacattccaatcatgctagcacaatgcacagtcaacaaattaacaacaaccatctatcaagtcatgaaagatcatccgctgttaagcgacgagtagctcttacacacacgtgtgcagatttattattttcttttttgacgaaaagaaattggggagtactactagctctttcataattgatttctctgcttgtggcaaacccggcgccgttcgtcggatattcgatgcattcatcttcaacgatttctccgttcggtagtagcattgtctttccgtgcagtgttagtttgagaaaagccagtactgaaaggatccaacaaaatataatactgtgcgtctgaccagaaatatccaattgatccgtggatcatgcatgcatgtacttaaaaagctattctggcccgctataatgatcgatgcgtatgattagttagtggccctcaagaaattttttaagtatagccgctccttcttttcgagaaatcatttttaatcgtatcatttcattagctagccctccttttttgtaagtggagtggatgagacaaataaacatgggctaaggatgggagcatgaagacaacaggcaatatttatgcaccaaatctctaccttttcctttcccttcggtgcaatcggaacttttcgctatcataacgctataattaggtcctactatattgctatctcaatatattattccatgcccgctagaaagagaaccggcgatggtatggaaatgagggggaggcatgggccgggcttaattaagtggctaatttattcaagttgtgcactaatatatactccctccgttctataatataagagattttgagtttttgtttgcactgtttgatcactcgtcttattaaaaaaaattataattattatttatttttttttgacttactttattatccaaagtactttaagcacaacttttcgttttttatatttgtacgattttttttaataaaacgagtgatcaaacagtgcaagtaaaaacttaaaatcccttatattatgagacagagggatagtgtagtactactcttatgctagctggagcaatagaaatcactttgaagcgttggtccacatcagtccaatataatcaaactgacagttctgaataacactacaacagaatagcacatcactgatgatctatatcttaccgtccaaaatgtctcgtcccaaacgacctttatctctaacggatccaaataaattccgttgtaaataaggctatgagacatggctcatcacacgtagacatctgtgacatgcctcttgtacatactcggcacaactcacatttaacagattcaaacatagacccgttagaggcgactcttcatctgtgacgggtacagaatatgcacccatcaaagataagtcccatcacacaaaaccagaggaaccatattcttttctatcccccatcaacaacttgagaccagaggccacaatctctcatctctctctctctcttcttttctatcccccaccaacaacttgagaccagaggccacaatctctctctctcacacctcctcaccctcatcgagtgcaccagccgccgagtccaaagcactcgccgtcgtgggctttgccttcgtccccaagcacccacctcctgcatccctgagcactgtctgtcgctgcaacttcaatccccaagccaccgccgtcgtcgcccacgagtatccccgaggtcgggagacgccggatctgactagtcatgacctaatggtggctcgagcttgcgttggttgttacgtgaaattcgtcacacacgaaggcctaggaggactatttaattagttccaatgctggtcctatcaatcgggtttacggtgtgctaattagtttgatcctgcaactaacaagataaatagatagatcatataagatcaaggagccgattggtcaacaggctgatgcgatgtagcaaggccagccaatatcgatggatctcaatcaatcagctataggtttgtagtttttcttgacattgtgttaatatgacaacgatgaacaagaattaaccatttctcacggttaatatatatcagtgacactgtgctaacatgtgaattgaatctctttttgcccccattaagtagctcagtgacaggggtgataatatattgcccgttagagaacaatctcctgtgtaacaggtgaaattttgtggcccgtcacatattatggtcaccacgtaagagtctccactcgtaaaaggtgagaggagtcatcgttaaccactaatatctgacaagggtcaaatccatcaaaagtgacgatttgaacccatcactgataacctgagctggcgtagtgtaaaatcccgatggtgtacggtacggtagaatacgaactttatgaacggcaaagaagttgatttcatcacggtggtgcattgttgggacggaccgacggagccatctacaagcgtacgtcgccgtcgatcgagaccgcggttggacgagagaggcactcggccccagcgggaaagcgccgctgcctccatatcgccacgcagcggtctccgtcgcgccgcggtgtggccggcgccgccccttatcggtcgacgtggggcatgtgcgcgcgcgcggtcatatcacggctcacccgcgacacccttctgccacacgcgcgtacacgttcgtaccgcggcgagcgacccgtgcgcccatggatcatcgatcatcagtgtcgactgaatgcaaccgggctactgagtgatggatgatttttgatcagctcgtgatcgatcatggacgttcgtgcgttcctgttcatgattaattgatttatctttcgtatgtgtgtgttgataagacgaataatcaggtggatgcatgcatatatgctttggatgctgcacgcatcgatctcggcccctttcaatgggatggcagtcgctagctggtagctactacgtgcttatctcctgtgctctcttttgctcgtgcgcgcgcgctcgtgtggttagttgtccctctcgcgacggtacgaggcaggcaagaaagaggcccaacttgccgctgcgcgatggactgatatggctgatgggtgaatctattgcctgtgcaagtgtgcgccgagctaggcgccgtgagtggcatcgatcgacttgccaatttgatctgtagtgtgaagcactgatggatacacatgtaaatagaattaatctagcaacaggcactgatggtcacgtgcttattatcaacaggctttgtgtgtttttagtatgtatagagttctctgttttctgaaaactttcacaaattaccgatgcactctggaacacggtcatatgttatctgtcttgttcagactgctcaaaagaactcgaggttaggagactgcactacatatcgcagttactctactccgtatttctttgtgatgatcagttccaatcccccttctccaaacgacgatccgtcatcagggcggcatcaggaaggctgcatctgcaggtgcctgctacaacaataatgctgtagatcagtactgtaataagtactacttcgacacggactgtgtctaattcacaccaaaattaaaaatttggttgaaattgaaatggtgtgataaaaaaagttgaaagtttgtttatgtaggaaagttttgatgtgatggaaaagttgaaattttgatgaattattttagaactaaacacggcgtaaatagtggagtactccagtattaagctactccggccgacagtagtagacttgcagtatttgtttaagactgacttgcagttgtattaaagttgctcatccgattcccatgaacgaacagggcaagtggggaacatgccatgtgccgtacgtagtacagtggtactagtatattgtgtacgtacgtactagtactagtatactcctgcggtcctactgatacaggccagaaagcccaagatgagacgaatactcagcccagctaggtaccgtaccgactaccgaccgcctcgatccaccgggcgacacacctcaagctcctcttcggtcctcaccatcacatgacctgtccttcacaccctctgcccgtctctccggtctcaaccggacaacaggtcgcttcgttaggtgtggtcaggagtcgaggactactactagtctgttgccagctcgcccagctgtgcagcgtgatgcatgaactacacgcgctgggatcagatctctactataagctgcgatcggtaacggcgatctgtttaacattatcctttggggctttccgtgacaccaccgctgcatttcgtccaaaaatttgggaacgggtaaagtagaacaggcgctgtggcggtccatttctcgtacgaacgtctcgtgggcagcgacggccggcgaacgcgcacgtcgatctcagcggtagccatacgcccatacgcctcaaattaaggcgacgtcgacatgaaacgacgaaaacgggagggagggaaagccggggagggcaaaaaaggcgacgcggttggtgcgcgacacgtccgtgcgcgcgtgcgtgtgcgcttgcgcacaactgaaaacgaccggtgcacgcaggccgcgtgcgcacgagcggctagccggctacacgttcgcgtgagcgcgctcgtacacacatcgatcagtttttggaacatgaatatgtgccctggcagtctggcacacgaatacgacgagcaaaatcgaacggcggatgccagctacagtacccggtttaggagtctgtacgtacgtggagcacgtcgttggagttagtgatgacatattaatgctggtgcacgtgtgtcgattattaacttaaacgcgacggggtacgatccgagcccgtacgtgcatcgcgatcgatcggggcatgcaattgacaggaaccgaagctggtccgcagcttccgggatgtagcaggattagtaacgtactcacgtacagtacagggagtctggtaggagctattgcccaccttaacaaatcatcatccgcacatgcaacgccacctcgatccgaaccttaatctgcccggtcaaatcgagcaaccaccagcagcggagccg

SEQ ID NO: 58414 - DNA, 1444 bp, Oryza sativa
tcttgcggcgggtggcgtgcgtgcatccgctgcctcgatggacgcaagctggccctgtcctgggtagagagactagagagaggggctcgatcgatcaagtgtactactacatcatagattaatctattcgagatcatagattaatccatccgagatcacgtcgcgcacgcatggcatggccattggccagcgtgtgcactgcacggacgaccgcacggcctcgtttctgtggctcgtggcctcgtgcatcgatgccaactggtgcagctaggagtactacgaccagcggtcgccatgaacagtggagtaacgtgtgtgcgtgcgggcgggctcgctgctcgatcggcctcggcgcgcatgcatgctggtgcatcaacatcacgagttcatcattccagggtacaggtacagcacggagtgaccaaagtggtcagaatcagacggggaacaacgctcggcgcaggggcacgcgtagcggctgcagagggaaaaaggtgccgcggcgcgccatccgttgtactacttctatcctatctggtctcgtacgaagcctcgtactctgacaacctttctcgacgttttttctttttctcctgcggttctccaaagcgatttctggagtagcgaattttaagatcggactacgaggtacagtattacttgaatcgtttcgttttggggtgattcatagcaaatttgttctgggtagggagatattcacagcagagagtgttcagcactttagcggaacgatgcgggcccggatcatcgagctactaaccgcagtaaaacgtcccccgtggctagttgatgggctgcaccgtttgccacagccgtattaggtgggccattaaagcccatgtagtaacttaagagcaggaaagaaataagtctgtattctcttcctcatctcttagtgctgattaaatcgcctcccttaattgcaaaatcaggtataacgtctccaaatctttgaaaacgtgtaaattgactccttcgatggtttggaaagtgatttttgctgacgtggcaagttggctgtggttttgactcgctaagttaacaggtgggatcccacatgttagtgacgtcctcatcttatcttcttcctcacctctccttcctctctctttccaagaaaagctacagaacgatatcccgtcgtcacgggacgattaatgagagcgaatcgttgtctgcctcatatgcaagatgtcgataggctccccacgacccacatgatgaacttgttgggcttttatcgcattgtcttgccgagtgtgaacgtgacttcttcttccattagtcgtaggacacacgcaagaggtgctcacatgctagctgggcctgcaggaaagagccatggtcaattatcttgttttatgttttctttttcttaattatcttgttttaagtatcatatctgatatatatatatataggt

SEQ ID NO: 58415 - DNA, 2765 bp, Oryza sativa
agcttgtgtatgtattgctcaatgcacaccatctgttcgtcgaaacgtcgacatagatcaatcagcaagtagcggatcattccagtgttgattttccaaaatgcctgatcgttccggcatagtggcaatcgaggccagctacaacaagcttgtcagttgtcaccgtcctaattcacgatttcacatggagccggtcagccggatgcaacgggagctctgctgtgcttctcggcgtagacaaaatcggtgatcctctccaggagcacgtcgaagtcgtcctgtgtcttgaggaggttcacccgcgtgtaccgcgagatgatccccgccgccagcagcagcgatctcgcggcagtcgacgtcttcctcccactcgcatttcacccacgcgtaggctgctcatcaggagagaccaaacacaccagacacaacttcagccccgtctccgtccaacaccgtcgccacctcgcatcaccaccacccagccagtcgcctgaacacgccccgcccccgcagcattcatcagcccactcagatcttctcatttaaactctttctccgctgcagtccacgaacttgtaagagtgtgcagccgggcagcattcatcagcccactcagatcttctcatttaaactctatctccgctgcagtccacgaacttgtaagagtgtgcagcccggccacgtatcgtaggtcacctaggtcacattaggccaacttcaccacaggcccaaccgaaaccacaactatatatcctgagtctacacaacccaaaatactagtctgatgaaagagaactgccaccaccttttaagttgtcctcccccaccatcaattattgatgtgggactaaacccaagcaacaatcttccccgtcacatcaacccatgtgaccccgaagacttttacctggcctcccccaccatttgacctttggaaattgtttcggattttaaacctaagttctggtaccacttattagataatcagtccgaaattaccatcagaaaccaaacacggaagaaactccataggagatctaaacatgatgacaacaccgaggcacgatatttgttaacgaggttcagccgaagcctacatccccggggcacagtttatggggtgctactcctcaattcagtatattacagcataccagagttacaactaccctgggccggacgccgctggcagacgctacctctcgctatgctaagtcgtcatatccggttacaacaagtttgtccttctaattaaaaggatactagcatagagtctgactcttactctactccaataactagtacaactacaagtcctaaattgtaaccgactttgtacgcatattcgacacaaactctaatagagtgtggagagtaactccgtcgccactgccatccacaagccgacgcaacctagccgccgctcgcaagccagcgagatgcctgtcaccgccaccgtcgccgttcaccactgtgctcccagcttcggcggcaaacctcagcccatctgcctgggagccgaggaaaaagccccatcaccaccgtccttccactgcgcgcactcccggcagccagctcaagcaggggcgagacgggcggatgcgagcggaggggaagaatcggttgagggaggtattttcggcttgaactggcccgtcaattatatatattctaagaagatagcgagcccattgtttcgcttagaataagccaaatggcatatttgcatacgaaaagtaatttgtgaaaaaaaaatatatacgtgttcttagcttagcgatctaaaagcaaaagctaaaaaataaacttcgatgaaaaaaccttatcagctcgaaatttaagattataaattaaaattttggttgataagcataaaagatgaggatgtgttttgacaaatcaacaacgattttataggagacccgattataagaatgaaaggatggacacatatcttattttagatactaattaatgaataaacagaacggacacaaagcagacaagcaaaactatctactccagggaaagggctctcgcatcgccctctccacgggcgacacgagaggtgacgccgccaccgtcttcttcctcctcctcccctccttctctgcctcgccgccgcctgagcgggcgccggcaaagtcgcgcggccgcagggacggtggcggcggggcttcgcctcagcgcgcgctcggcggcccggggagctggccgggcggcgacggtggcaaaccgtccgaatccgcgcccgcctggccggatccggcggggcagcgcttggcggcggggcggagtggtggcggcggtgactggcggtgcctggtggtggcgtatagggccggcggcggcggaaacccccgcccagatccgcgctattttggccagatttggtggggctgacgccgggcgacggcgggcggcagggaagcaggcgtgctggcagcggggaagaggcggcgacggttgcgcgggcggcgcagctgaggtcgtgggcgacgcggtcaggcgcgtgtgagcgtcaccaacggcggttgaggccgtttgcccgaaggccggtgaggatggcgacgcggggcaagctcacggcggtggcggagcaagctcgcggcggtggcggcaccgcggagctcgcggcgacgtcggcggcggcaacggtgcgggagcacggggcgacggcgacggtggtaacggcgtggattccatggcgatggtggcatcagcggcttgtcggcggcgacagcacggtggctggtcgacggctt

SEQ ID NO: 58416 - DNA, 2645 bp, Oryza sativa
gcgcgagaggcgcgtccggtggaggaggccggttcggcgcggccggcagaggaggaggcgaccctggtgcgaggaggagatgccggtgggcgtggcacgatcttcggcgctcgaaggctggccggcgggggcgccagtgcgggggtcccacatgtaggcagaggttgtgtggtggtggagcatcggtgcgtcagccatggattcgcaggtggtgtgcggcgggtgaaaacccagtccggccttgccgggctgacaacgatggttaattccccctcctgagggcgttgtcgtgctgtctcacccctcagggcgatctcgtctgtgttcttttgttggtttagcggcggccggtccgatgctagcatcctcctggtcgtgtgtgttggcgctgtaggtgtgtggggttgtatatttttttcttttttcctggttatgaccctccagggttataatcttataattttttcctgctctatcaatagaacttcgcaccgtctcgtgcgagtcgttaaaaaaaactatctactccgggattagtcaaggagaaatgcggcgggagaagtgccatggacccgtagtggtttactggtatgtcgttttaagacgaaattaattgatgctatgaacatttaattaaatcggacccggtgacagccttatgatatgatactacacgccaactactcccttggtgtacgtgacaccgttgtcccagatcattaatgaagaagcctggaggacaatggccattttttatttgcgacggggctataaactatcatgggcgtactcctccttccaaaaatagttatctttctatttttttagaacaaattaagatttaacacgcaaagaatatattaccccttatttgaatgaaagtaaaacagtgataaaggtagaataggtagaaatttgaatttgaggtgactgatgtgactagtattactctcaagtgacaagtactgtggaatttaaactttgaaaagacaactattttaggacaaggaactaccatacaatatgacaatgagatctttagtaggtaaaaaaaatatcattaaagatagtaaaagaagatgccactaatactagttcaaaggtaaagataaatagagagaagaaaagaaacaaatataacaaagtagtcatggtattattaacagaacactagaggatatatcgcgtttaatttatggatattggaattagtattagtggcgctaagttatgttgacattttaatctttcataaataaaatgtgaaaaatatatatgctcttacgtgagaaaaatataatgctaaccgcatatcctgctattagctgattcagtggtagtaggtgattctaacttgatgacgatattcagagactactagggcctgtgcatctggtgtagtggtatggtattataggtgtgtttagtccctgaaaaaagttgaaagtttaggaaaagttgggagtttggaaaaaatttaaaagtttatgtgtaggaaagtttttgatgtgatatgatgtgatggaaaattagaagtgtggggtagttggggtgaattaaacacggccatagtacccttccacgataccgagtcaggttctattttccggatgcacattttttttcaatgcaactaagtactatcttagcccgcattttcgtttttgcatgtgctatctctgcccacattttcccttttgctcgcacccatgccatatgcatatcacattaccattttccctgccatgccatatgcatatcttttcttttactaaccggcacataacagtatcaatataattgtatagagtatgattaaaagtatttacaaagagttcgaaaaggaaataattatataagtgtttttatggaaactaaggtaacatattcataagtctttttgctcccgctcgtgcccaagtttttccttctccctttatcttagaggcacatattaatgtttttagagaaacttcaaggatgacgcatgctgatggagtatgcacacaaattagtgttctgccttaagtagtaaatgtaacatgtatgatattcatttaattacatattcaattgttgatcactgaaacacataattgcttgtgtatatctacatcattcgtcaatacacacaaatcaatatctacctgttcgtccaaatattgacggggaacaatcaacgtctagctgatcattccccttgattattgtacccatgaacttacccaagaacaatcagatagtagagctgatcgttccggcacagcgcccatcgaagccagctagacgaagcttggcaccctctcaattcacgatttctcacatggagctggagccaccgggagctctgccgtgctcctcggcatcgacgaattcggtgatcctctccaggagcacgtcgaagtcgtcctgcgccttgaggaggctcatccgcgtgtaccgagcttcggcctcggataaagtgccggaccgcgagatgatccccgccgccagcagcgtctcgtagcagtcgacgtcttcctcccactcgcatttcacccacgcgtaggctgcccatcagggggagaccaaacaagccaacacatgagcacaaagattttggttgacagaaattgattttgagtgttagcgagcgagacaaactg

SEQ ID NO: 58417 - DNA, 2787 bp, Oryza sativa
gaagatgtcctccttgccgtgcaggttggccagtatcacctttaggatcttcagcatccggagctgggtgtcccgggacgcgcccatgatgctctgctctacgtacgaaagtgctcttttcgccaccttctcgtcccttatcagcgcccatctgcgcaacgcacagcacggtatgacgtatatgtagtgtacaagtttttgcgtcgttgtgttcacgtgtcgcttgcaatgtcaggcttaatttgagggcgtgtacccgaatctgctgccggcgtggccggagagcttggaagcggtgaagagcatgacgtcctcgtcggcgggcgccgggatgtgcgtcaggtgaggccagtagtacgcgtggtcgacgatcgccgacgagccggcgaggacgggcttgcgcaacgcggtgtcggggttgttcggcgaggtgacgaactcgatgaagcctttggtggagtttcgcgagccgttgtttgaccacgtagcggtggtgccgtcccatctgtactcccggccgtcaaacatgtcggtttgtgacttgtacgcctacacatatcatcgatcaaagcagttcacttcagcacgacttaattaactgagatcatcgtcaatggcatggttcgcatgcaggttgtcagcgtgtggtggtgtttggaatcacggaccgggtaatacggcacggtggcgacgacgcttgccggcggcgagtcggcgttgccgtcgggggagagcgcgtacaccaacgcgttgatgagctgcatggagccggccccgaagaccaagtacttgtcgtcgacgaccgcgttgccgacggccctgtgcagcagccggatgtggcgatcgagctcgacggaatggaagcggccgccggtggtgatgtagctcaagcggtgccacccggagaacaccacggcgctggctgccgcgtgccgtctccagtacggctccaggaacaacgggttcccgctgcacaaaaccattgcaggattagtgttagggagtacgtgccgtgctacgtaccagcggctgtgctacacattctgtacggaatgatagctcatttgagcatttgcaatgtgggggccccaaaccagagagaagaataaaagaccgactctacacattgtatggaccttttgcatagatacacctaaaggagagaggggaaatgatctcgagtcaaataccaggagaatactagtacacgcgcccggttagacaagaaaaataaaaatgcggcgctgctactgctacatcttcctccctcgttcccatcttaaataatttttattttaaactacttatctgatctataatccgagttgtattcttcgtaattaaatttttacaacaagatatcacatgattatgtatattctaataaaaaaatatatatttcaacctgttaaaatttagtgtttcatacgtgatagcaatatgtttcaatgtgtgttccattagtatgcatatgtggtagagtttaggatccttaagtaaattatatattgtggatgttcttaatctcacacgcgccagttaaaactgatatattgggctggtctgtcagtatttccggtaagacccaggttaaaacagattttacttgagccaggtttgtacggcccaaatattgacatttagtccttgtttagatacggcccagccacatgtgtgggcaacgattgttttgactcgacctgtataatgctagaccgcagagacaaacaaaaaaaaaattaacctgatctctcgatattttccagcgatgacgtaaaatcctacttctagaactagaagtagtcatggaagaagattaatttgggctggaagattaatttaaactattacttaaaaaatatttgtacgttgcaacagaaaatatactaatttgaaattatgccaccatgcatgaataattaatattcggtcacaactgattgtgacgccgacttgtgtacatccatcacccgatcacggaaattgttagtttaagcttcatgataaaaaaaaaatcctaaattgtcacatcacttataatagggaaaataatgacacgaaattataacccactttggttcaaaactgataccatatcatgaaaaatatctagttaaaatttccgatggttctttttagttggaaacattttttctagttgattttattgggttgttatgacttaatttcttgtgctcgtcttctcctcgtgtactttgtggccttgataagctgacgttctgtttctaatatttttctttggagtttggttcggtaacacagggccacaaaatacatgattctgttgattgcttttgttgcgaacagtattggcttccactcaccgtcagttttagaagcgggatcatgtatgcagagatgcgaacagtattggaatcagtagtcgctaggaatcaggatacggggtgattagaggaatcataaacaggattatgtaccaaaacggaagaaacaaataaaatagatcaggactcaaggagcgacggatgaagaggcatgagtacagaaaactctttaattattataataggtaaagactgtagtattaattattgtggtgacaggatggttagatatgtttcatgtgaaattgttggggcaagaaacacctcttgcaaggacattaatttgggcaataacattaacttaaactttgggagtacctatttttttatagaactagtatgcaataaatagtggaactatcaaacagaggtgcactggtagtggttactgcagctggggttggagcttagatcaagttga

SEQ ID NO: 58418 - DNA, 3800 bp, Oryza sativa
aattatttgctgtcccctgatctcaggtacatcaaataatgttcgatactaaatgcaaacaattactacatttgcagcactatataaattgatgaattaaaaaaatcaccggttggatcactttttattgctaaaataaaactttaaaacattcttaaaccaatcttttcactgtgaatcaggtaactttatcatttttaatattggaccacccttcacgcaactctctttactattcatataaaccctttattacagtgaagataaggcgttacatggatagggaagctcactggtatattaaaacatatttgtttgaggttgttaataagtgctgaagaagttatttagggtgatccaaacaaaaaaaatagcaaagttacccgatccaaagtaaaagaattaatttaaatatatctaaagtgaaactttaataataaaagatgacccaaattataattcgctctaaataaaatagtactacatgacacatcatcacagtccgatggttaagaaattaatgcaagcagaccattcacaaagtagcgagagtacgtataagggaaggagtaaatttcgtaaaactaaaataatactttataaaattatgaaactattcatttgttgtgaaatatcatatttaatcaataatattctataggatagatataacaaaggcagtggattgtctcacgtaattttgtgctgtgttacactttacatgacaaacttttagcttccatttcatatatgagttttataaggagagttcgatttaatatataactctttaatatatagtatttctataggcacaattgcatgttgtacacaactacacggttaatctagacccacaatgcattatttttttccattaatttttttacaaataccttatgaaaatattgatgtttaatggcaacattatttccacgaaaccttgtttatctctacataaccattgttggtcataacgaaatacatagaatgaattgaaaattgaccattctgatgtaaattagaactaaacatatatttgcttgagatggatatccttgttatttgcaaacagatcatgttatagaagtaaattctgaccaaacaaaagttgatgaaatgatatattgtgaggtataaaactcatgaaagccttgtgactcatctgtatcaatatatatgtggcaaagcttttgctctttattaaaaaaagatagccttgtgacaaaattagtgctaaatattacgatgataaggtataagtatattggaagtgtaggtgcttgtatgttttttttttaaaaaaaacatacctttctcatcctttatttaaacaaagtcccttctttagactaatagaaaataaattttctgttcatgaaaaaaaacatgcaaaaatactcaagcatataaacgtaaaaataaaaccatataaaataacaaaatcccaactaaaataaacgaaaactacacagtctagcgctacgattttaggcttagtaatatgtaatttgtattttttttaataaattttaaggcatttaaaatccagtagcaaataccaaacatatggtttttaataagcacgattgctaaaactatcatatcgtaatattacaacttaaatatgtatatttgttttatctacaaccaagataataaatagcgtatagtaaattggtagcggattagtgactgggtagcggattgcggatagcgggcgctattgcggacgctaagtttcaatagcaaaattaagaaaaataaccataaatttagattttatatcaagattaacatcaagtttcacttaaaaattaaaatttaaactgcatgcttaattacttctacatttcataacataaaaattatggaataacatattaatatataagataaagaaggcacattgtactaagttattctatccatatgtaaagaacatcattttagcattatagagatccaacaaagtcaataacagactgtatagcggtcgcgaaacgctatagcggctgctaagttccaatacgctatatgtagtccgctactatcgctatttattaccttgtctacaactactttaaaagtacaatcctgctctcttccctagcgtgcgtagcacgagaaaatcctgtaaactgaaccggcccacctctaccccgtatcatcagttaataaccctcctaccctcaccgtttttctcagtttttttcaatttcttttctcctctagatagctgacacattgctttattagtacagtgctcctcaattagaccagaaaaacctgcagcaggctgtttaaccggtcaaaattactttaaatcccatgaaaaatctgccgttgaaatgcacaggtatatcactgtattatatctttatctttacatattataaaatataaaaattgaagatgtttttgtctgtactttgatacgtcatccgtgtatgagtcggtttttaagttcgttcgcttttggaaatatagatcagtatttgagtcgggttttaagttcgttagcttttggaaatatggatggagttgtataagaaatctctacctctactattataaaaaaataaagatgtttttgttggtacttttggtacgccatttgtgtttgaatcggtttttaagttcaatcgcttttggaaatacatatccgtgtttgagtcggtttttaattgtgttcgtttttagaaatacagaaggagtcatatacaaatctctttaaaaaacttacatgctaatttgagacgatcggacccctaattgcggctcatgattttgtaaaaaatatatctaagcgaattcttacggttaatttcactttagctaaaccgtacaacaacaataagattaaaatatccttcacccgttgcaacacacgggcatttttctagtattataaaagtttaagatgtttttggcaagaattttggtacgtcgtccgagtataatgcgatgtgcagtccgataccctccccgtgcatttctttttttgcaattttttgccttatttttcagtccgattccctcccatgcacttttttgcgatttttctaacaaaaaactaaaagaatcgaactctaatccaaccaaataaaatcagaagagagatccacaagagaactcaaatacaccataaaaaaaaatccacgagcagatcaaccaattgctcccaacccctttgcccaaaatcacaaaatcactcaattgcaatcccaaatcaaaatcaagaatcccctacaaaatcaacatcccaaataaaaaaaaaaccaaaccctaaccctagccacctcccacagcagtcctccccgtggtcgccgccgccgccgccgtcgtcgtctgccgctgtggtcgtcatcgccgtcgtcgttgccattgccgttgtccgcatcaccgccttccaccgcgaccagctcccgagcccaccgccgctcctggccgcgtcgccacactaggaatggggccgacaccgccactgccgtcagatccgccacaggagggaggcgaaaggggtcggatggagccgccaccgcctgatccgtcctcagccgccaccattgcggccggatccacctgcggtcgccgtcgccggacccatcacgcgagaggcgtgagagagggcgaggggaatgacggttgggaggaagagagggagatgaagcggcgccgccggtgggtggagggggagcggcgccgctggggaaggggaggaggagcggtggagggggagaggcggcaccaagagagagagagagaggcggctcgcggactcgcggtggggaaggaaa

SEQ ID NO: 58419 - DNA, 14157 bp, Oryza sativa
aaaactcaaccctaataatataatattttatatttggtaaaattttagtttacccgttgcaacgcacggttatttttttgcagtgttatataaaaaaaaatctatgctacaatttcattgttggtccgttctaacggttttctacttcttgttgtttcctatatacgcgcggaaaagtcagctaaaatctgctcttattccacgaaccatcgaagtcgagccaccagtcaccacaaaaatactgctagagggaagagagagagattccactagattcttatattcactagtctattgcgatgagaaaattataaccctgattccccgagattttttgatggactgattccccagttgctatgcggggacagcgtagttgatgattccttgtctctcatcgtgacgtgaggaaattgtacgtaaagctgcaggcttgttgctttccgatccgaatggccgtgaagccgcccttgactagtctctatctctatctctatctctttctactattataaaagataaaaatatttttaacggttttttatgtcatcagtgttgagtcagttgttaagtacgttcgcttttaagatacatatccgtatttaagtcgggttttaaatttgttcgcttttaaaaaatacatgagttatataagaaatttcttaaaaaaacctcatatgctaacttgagatgatcgaactcctaattgcagctcatgattttttcagaaaaatatatattcaagcgaattcttacagtgaatttcgtataacaataataagattaaaatagtcttctatatattatctcacaagacaataattttgagaatataccactcaattagcgcgccttttaggttttaccaactaatcaatgcattgtactccttccttccctaaatgtttgacgccgttaacttttttaaatatgtttgaccattcgtcttattcaaaaacttttatgaaatatgtaaaactatacgtatacataaaaatatatttatcaatgaatcaaatgatagaaaaagaattaataattacttaaattttttaataagacaaacggtcatatatatttaaaaaagtcaacggcgtcaaatttagattttttaataaaacaaacggtcatatatatttaaaaaagtcaacggcgtcaaatttagagagggagggagtataatttaacattagtatttggtagcattttctcaaaaattgctaatgggcgtttgctgtgatcctggtggaacgatgggttttttttcttttcttttctagcctaggctcgcgcaccgcaaccatttcctctttctttactttcaccgttttgctgttagaaattgcttcgaattttgttgttttctcttttttattgttatcggttttgatggaagcaagttagtgcatatctctcttttttttcttttgttgctgacaaagacgtgcatgtactgcataactacatattaaacttttggaaaaagtacgaattaccgtcttgaactatcgcggttggtcgaattaccccctaaacctgaaaatcggacatcgtttaccctgaacttttaataccggacaaattaccccctcgacccaatccagatcgattttgtcctacgtggcgtacacggggcaatccagtcagcgttttctttttttgtttttgttggtggggtccacctgtctctctctctctttccctctctctcgggctctcgggccgtcgggcgcaggtcagcgcacggcgccgcgcgggtgcaggtggtgggcggcggcggcgggtcgatgagctcggccggctccggtagcagcggcgtgttcgctgcaatttcatcgctccatccatgccaccaccgctgctgctttttttttttgcgtggttgttggatccgctggtcctgcgtggtcgcgtgtggtgtgtgttgtcctctcgctggttttgacgaccttttcttcctcgatgccgctgtaggtggccggcggtgagcaggaggaatcatctctagtgttcttgtctctgaggaattttgattctctctgtgaagggatttggtgtgttcctgctgctactggtgctccagatgcttcccaccaacaggaacaggccccagcagaggactgccagatcttggtatttcatgagccagcgggtcgacgagctcggccggctccagtggcagcggcggcggcgtcgggacatggagcaagacggcagcggcgacgacgctgctcgggcagccgccagccaccgcattagcaggagggggctacgtccgtgtccccctgctgtcgcgccgccctcccgcgcatcgatggaaggtgaggccgcgtcggctgctgctcctctgctcccacgacgaagacccgccgtcgcgtggctcgccgccgtcctcggcccccccttcgcgccaccagttggctccgcccccgcgcgccgcagtcctcagctcgtcgtcgtcggttggtaatggaggtgaggggagagaggagggagagagggggattagggaaagagagagaagagaaagggtgagaaaatgacaggtgggcctcactgactggactgccacgcgtatgccacgtagaccaaaaccaccgcggattgggttgagggggtaattcgtccggtttgcatagttgggggtgaataatgtccagttttgttgttcatggggtaattcgttcgaccgcgatagtttaggggcgtaatccgtactttttcctaaacttttctatgcagctaccttcttggcctgttttgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctattttttttttgcgttgagtataagtagttctcttagctctttattctttttgtaaggtttacattcagttgaatgagaaaaacccagaaaaaattgccccatacattcttgcaagaattctttctctgaaacttttcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggagagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtccctgccggaggacttgctgatgcaggtggcaaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgaccgaaggcctacgaggagcgcatgcggaagaagaaggctgccgctggcggggtcaccaccgatgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggtgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcgatgacggaggatgtgccagagcgcgcgtcgtgcggattggtcgtacgcgagcagcgcgtgtggcccaagctgctactggtagacgctggtggacatgctggcgatgtctggttcctggacaatggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacggtgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcggggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgagtacgatgtctggtaatcgctatttttttcttatagttgatgattattcccggtggatgtgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggcggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagttgcaggacaggagccaacggatttcacgatggaggaggagcctggtgagcagctgccgagcccggcaacagcggccggcgtggtaccgtcgtaccaggcaccgtctcctggcaggcgcgccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctacgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacatgggagttggccatgttgccagccgggcaccgagcgattgggctgaaatgggtgtataagctcaagaagaacacgacaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcactgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaagatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgttgtcggggtggcaagcaggttcatggagaggccaaccgtgatgcatttcaaggctgtgaagcaaattctcagatacatcaagggaacgatggattatggtctcgtgtatgctgcaggcactagggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagagtgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgggcggatgcactgacgaaaggattgccggcggcgaagctggcgacggcgagacaccttcttggtgttcgttcactagggccacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgtgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagttttttttgctattgccaacatgtttttggccctttttgatttttttaattcgtttgaaattcatgtatagaaactttttatatctaaattttatatacataaaatttataggccaaagttcatgtgtacaaaatttctacgtataaagtttatacatgtgaagtttgtacgttaaaagttcctacttacaataggatttgaagtcacccaaaaccaataaaaaaaatatgaagcaactagatgtgcttattagggatatgttgggtaacagactgacataaaccaatacaaacaaagtatatctaaaactaaaaagaaaaataagcacgtggatgttcacctgaaaatgcgtcagtggaaaacagaaatattatatttctggtttaaaataatttcctttcttttttggtatatttttactgcacgtgggcccgcgtgctacaggccagcgaggggggcgagctggtcgcgttcagcgatcgaccatgtattacagtattagaagcacccactttctcctccttttctctagttcttggttttcttttccatttcattatttttctcagttttggagacatttttgcccctagctagccccacatatcagatccaaagagagagaagagagaggagatagggtcgatcgatccatccattgtttggcccatgcgttgccgtcccaacaccgagtgtcgccacctaccgccaagcacctgcgcccccaacaccgtgcgttactgcccctgccgttgcgcgcctatgcactcgccatcgggcgcctctgcgtccccactgtcccgactcgggagccatctgcaccctctacgagagcattacaaagtatttacatcatgtacaacgaatcaaaatttgcttatctaccaattgacttcgagagcaatccctgctgctactttgccatcatactctctaccaattgacttcgagagcggtggctcccctcggagttcgctaatgaggtggcgaggggcggcgctcggtggcggtaagggcagtgacaaccgacaaagcggtgtcgggctggggaagcacatagcgacgggaagatggtgctcagcggcaggggcatgcttgatggtggagcggacgacgttgggttgtggctagggatgcaagtaggtagtcccactacccgcataaaaacccgtttactagttcatttcttatatgatagtacaatatttagaagaaaaaatgaactagaagtgagataagcgggctaaaaaaacccgcttgcctaccccgcttgcatccctacatgtggtgatgggcggtggtggggccttggagctcggtggtgcttggtggtgagggtgacaaactgacaaatggatggatcaatggaaatatgtttggcaccattggttgcaatttttttacataagtcgttggtcggctcaccgaaaagtttgtgcgtcgcaaaaacgaaattactcaaaaacattcaaatgtgtttttgtgcatatgagaatgagtttgacaccattctctctttagatctgacatgtgtgatagtagtggagatggagagaatggatggagaacccttcccttttgcctcttatgaactcttttttattcatatgggacgggaaattatatcactaccctggaccttttttatgggggtgacattgctctaagggtgttttagttctttattacagtagttaagataacaccatatgaatagagtttattcacgtgctcggttaggatgaacttggcgcatttaacctcatccgtgatctctattttttgccaacgtcattctttttacgaaacgccaacgacattttgttttactatactaggacttcctcgtcttctgtgaatccgctatgtacgcaacctgccctctctgtgggttatttagtgactcaccgaaggagggtagatcgggaggaggaggtggcagcgaaggccagaggacagattcacgtctccaagtagacggcggcatagcatcgtcataaaagcatgatgcccatcctatcaacttaacaatgaaatctttttgctctgttcaccttcaccacacacaaaaaatggttgtagacctggaagcccaaaattgatttaattaactggtttaccatcagacccagaagaacaatctccatcctatccagattaaacggctgcccgcaaaaaccagaaattttattggcattcctgcacggctggctgcgccactagcaccagtcactcggcaccaccaaccgaagattccactgcccgcggttgcgctcccttgtaaaacacatcatattcaacttgcttcggatcatcccaccttcccgaggccttgaggcaccaagtcgcgttcggtacagaccctacgaatccccgtccgattcctgttatcctgtacgtttcttgcagctgccaaccacctcgatcgtcgactccccggggaagagaagcctctgcgttcgggcgagcgatggagcaggggagcgagacgctggacgagcggctgccgctcccgtgcgcgaacggctgtggcttctccggctctgccaacacccgcggcctctgctccaagtgctaccgcgacagcctccgccagaccgtgatgtcccaggcgccgtcgtcatcgtcgtccacggagcttcacggcgcggtaccgtgccggagggcattcccgtggacgagggggcgatgcctccgccgccgccgccgcgggcgaagacgaagagcaggtgcgctgcgtgcgggaggagagtggggctgatggggttcgagtgccgctgcggcgccgtgttctgcggcgcgcacccgctactcggacaggcacgactgtggctacgattacaggggcgcgccgggcgcgatgccatcgcccgcgccaatcccgtcgtcagtgccgacaaggtcgacaagctctgaaaatgctactactgctggaaactattataatccctcgaggggatgtttcctcgtttgctcaaaaactatctaagtggttatgaaaaattctgaaaaaatttgacaacattcatacaacacatatatataacttcacaaaatcttaagtccaaactcaactcacacgtcgagatataaaaaagacaaattcagcgtatgaatagtagcatactgtttatttttgtttctcgatgtgtagatcgaatttgaacataaattttggtggactagtaggtatcattatactctacattgtcaatttttttcagattttttcacaactatttgcatcgaatttagaagaaaaagatgtacgcggagatatcccctcgagggattagaatccactcccactactgctcagtcttaccaacattgtcatggccgaaccaaatggttgcttctcgtgcatgatagaatcgctactaatcggagtatgcaatatcatatgatatctgtaatctgtagggattgaaaattgattattagagtttacctattgtgctgtttacatctgatagaagtatcattatcatagtactagctcgtagctctgctctagtgcttgacttgtgtggaacataaatcactttcatctcctcacattttcagagcacgacaatgtcgtaggagatgattttattttctggaaattggctgccaattcgccaaatctgaatatattagctcaacaatttgctcgctttaccgtgcaatattatacgagttattactttatactaacatcaagaacatgtttggtaaatttaaatgtaagcgcatctggtgtagtggtatcatagtaccctcccacggtactgaccggggttcgattccccggatgcgcagtttttaaaattattttagcagttctaagtgcctctatctgctttcattttccctttttcccttttgattccaagaatgacgagtgctgaatcagtaacatgtatgatcttcatttatttacatactcaattattagtcactgcaaacataatcacatagtgtccacctaattgattgtgtagatccacataattacacctgtccgtcgaaaggtcgacagcgaacgaatgaacgattaacgcgtagctgatcattccagtcttgattttccacgttgccttgtatttattgcctacaatcagctagcagctgatcgttccggcacagtggccatcgaagccagctagacgaaagcttttgtcccggtcccaattcacgattttcacatggagctggaggcagcgggagctctgccgtgcttctcggcatcgacaaattcggtgatcctctccaggagcatgtcgaagtcgtcctgcgtcttgatgaggctcagccgcgtgtaccgagtgccggcctcgttaacagtgccggtaagcgagttgatccccgccgccagcagcgtctcgtagcagtcgtcgtcttccacccactcgcatttcacccaagcgtaggctgcagatcagggtagaccaaacacgccatcgcatcaccttaaagaattcgattgagaggtagcgagagaaattgaaatgccatgatctgcagagataatgtgccgttttaacctggcgatggttctttgatccggttgaagtaagtgcagtactgcggtggcatcttctgcagcgagatccgggtggaccgcgacacgacggcgttgagccttcgccatcggctgctcatcacgtcgtagccgaaggcgaagatgtcctccttgccgtgcaggttggccagtatcaccttgaggatcttcagcacccggagctgggtctcccgggacgtgcccacggtgctctcctcgatgtaggatatcgccctgctcgcgaccttctcgtcccttaccagcgcccacctgcgtaatgcacggcacggcgtatatcgatcagctttggtgtcgttgtgtacgtgtcttgcttgcaaatggcatgcagctgggaactctgtggcccgtgtgtacccgaatctgctgccggcgtggccggagagcttggacgtggtgaagagcatgacgtcctcgtcggcgggcgccgggatgtgcgtcaggtgaggccagtagtacgcgtggtcgacgatcgccgacgagccggcgaggatgggctcgtgcaacgtgctgtcggggttgttcggcgaggtgacgaactcaatgaaacccctggtggggttccgtgagctgttgttgtttgcccacgcagcggttgtcccgtcccatctgtactcccggccgtcgaacatgacggtctgtgacttgtacatctacatacatatcatcgatcaacacaactagttagtgaagtcgcgtatagatgctcgtaggatgtgtcatcgtgaagtggtgttgggatcacggaccgcgaaatacggcacggtggcgacgacgctggccggcggcgaggcggcgttgccttccggggagagcgcgtacaccagcgcgttgatcaggtgggtggagccggtcccgaagaccaagtacttgtcgtcgacgaccgcgttgccgacggccctgtggagccgccggatctggcgatcgagctcaacggactttaagtggccatcggtggtgatgtagctcaagcgatgccacccggagaacaccacggcgctggccgcggcgtggcgcttccaatacggctccaggaacaacgggtccccgctgcacagagccattgcaacaacaacacaccatcaggacaggacactaatggttgtgaaaaaaaaacggaattgctataaagatggcgacagtttttttcactaatctcagtcggttttcaagtctgttagattcgttcgcatgcaaacgctgcggcaaccgtatccacccgatcttccggttggttttatatacggaattgctatatcttaaccgacagttttcttgcaacgaatatgtcacttttcatattttatacaaatttacacggtagttacacaccacttagatatgtaattagtatgtaattttagaacttacatatgtaattttgagacttacattgtaaatacactaaaattatatatgtaatttaatgacttacaatgtaaaaatataccgactattttttggtgaaaaatatggcgccataaatatagctactcccaaaaaaatctatttttttataacataggacagacaaatagtaacatctatcacttcagcaaaaatcaatttcaagttta

SEQ ID NO: 58420 - DNA, 2645 bp, Oryza sativa
tttttatgatttttttataactatttgagtgatgtaagtgcaaactgtcctcgataccctcgagagttcaaaagtatttcacaccaaagacaaagaggagggaagctgcgtgcatgcaaggcgttgtggagcagcgcgcaagagcacgagcaagcgaggagaggccagtcattacccttgaccgtcggcggcgcagttggggattcggacggagcagtccggaccggagaagcagctgttgcactcgcacccgggccgcccgtcctcgccggtgacgccatccaggaacacgctcccgtggccggagcagtcgacggcggccacgtcctcggcctccttggccgcctgcagtgcccagctcagcccgtcgccgagccgctccggcgttgccggcggtgaggccccgaggaattggtgcgcgatgaagacggcgttgagcagcaacgacgagcagaggaggacgtgcagcccgagccctgcagacgccaggctctgtgacctatgccatcctatcgccattttttctttctgccttcctgtctccggtggccctctccgtccaaagagatgggccactgcactgtgagcctgtgaatttatcgtcattttctacaagcagtgttcgtgtggagcagcttttgttagatttcgcgtcgtgctcaaacaataaaacctgtccaaatcggtgttgtgatcgccggcaggtagtagtaattcttttccagagatattttgacaaatcaataacgatttataggaggcctgattagagtccctatcaatacttcattacaatgagagtcccttatagaacatactagtatgcaagacacgtttttcaaatcttagtattcgcattttaaaaaaccacctcgttcacttctgtttttattaaaataatagtaaagaaatagaacacatttttttatttccattttacaacataaacataaaatcttttgatcaacagatttcttcaatattcactacaaactcaacaatgaacacgcaaatccaatcaatacattcaccgatttgaatgtaaactggaacatggttttgttagtgttacaaaagcaaaaacttgataatgtcacatgctcttacatgcatgagcatcagagtaagagacaattgctacgataaaagagcctaaaggtctgttatacgtggattctaactttataaaataaaagaactgaaaaccacagatattccattatcggatttgaaatttgtgagtatgcttctgccctttagattgctcacttattaaaattttgaattgaaaaaaaatcatatcaaatgatggcttaatcaattcttttaactgctaacaatataaaataaacgacagataattaggtgacactggcacggctgttagtgcagaacatctcagattataccatgcatttcgtcctgtggaacaaattcatattctacagccaaatgataaaatttgaggacatataaataactgctctgaattaccttttagttactgagttcatgaaattcctagagaatcaattcaagaacattaaaaaaagttagggacatcaatataattgagtcacaaattcatgatatcagttgtaggtcatcatcagctctaaaagtagtaatataagataccacaacttggttagttgatatccacggttgcataaatatagaaacaaacaaaaaagtgatagtcattgcttcgttcctaactaaatgtataaaatgtgatggcgggaattaaaaccaagaaagcaatgaaatgaacttcacaagtgcaatgacactgaagtttaattaccttggtgtaagctgtagaaagtcacatgattcccaatgaaaattacctagttggactaagaaggcaatagaatcctaaacatgtcctaggtagtcttctttgcacctagtattccttgttgtgaacagataggctgttggaaaggagttcaacaactgaaattaagtctatgtattagcatttagtaataaggaacacagggatagctaacactcagtaataaaaaattaaacagtgtgatggagtggactggcaggggcattgctccaggcaagtttcttaatgttctattctctttctatctattttatgtacctgataaaacaaacacaaaaaatttgcttcaagtgtaaaaatggagaaatatcccaatatcccatggcacataaaatgtaataagttgttgaaccttctgcaataaaagcttcagatacatggtgtagataattaggagaaattttttagatatcttaaacaaactataatacaacattagtgatgttggtgataaatgtactcccggctccaaaaccaaggtgaccattatgtttttgcaaatttttaaaatttaaatctctagaagtttgtctgaaatttcagatctacggcatgcattataactttatcaagattaaattttctacgggacataattgggagcattttggcaattgcagttaaaaagcattggttctaaagcatcatctcccagaattgtacaaccggcaatagatgtgtagagtgaagactaagatttatgtatagaaaatccttcaaatgcataacagtgatttcctaaatttgtgaacatgagcatgatcaggattaggaagcgaat

SEQ ID NO: 58421 - DNA, 2797 bp, Oryza sativa
ccttgtttgccttgtgatttaataaacctatcgatgccacaatcttagattctgtaagatgtgacgctatacaatgcaagtgtggaatttctgttcaagttttgtggattgatatgtccatatatgataccatggtttgtgtaggatttacataatttccataatacaattgtgtgtcatacctgtgggcttatgaaaaggggcatgtgcgtggaatcacccaaaaaaaatccgcacatatatttcagtctttcctggccatcatttatttagtgatagtgtacaaaactgcaacccttgcagagccattcatgggaaatatgttgtaagttggtttcctttgttttcccatttgtggtcttgtggatgacgatcaaacccaagatgccactcatgtgaactcaatctaatatagtagtatcatcgaaattgtttaactttttgttttttgagttagcatgcacataaggaaaaacatgtagagtccaagcttatttgtgcatctgaggattacaagatgacacatttgttcattcagaaagcaagaaacaggtcctctgatttattgtcgtacttaatatgaatatgcagaatatctctctgcataaatttactgccagtaaccatgcatctcgttttttctgtctttttaggctaataggatgaagtgggttgacgaaggatttgaaatgcttgtcttcacagacaagtcaattggccatgatgaacttaggaaagagctggcacagtgtgatatgctagtcaatgttgcaataacgagtcaggagactgttcagtggcttataaataacagtgaggacattcccaatataatctgctttcaatcatctccaaccttagaaaacaagttaggtggcaggtatgttcaatacactggacgtcaggacatgttttgcaagctaacaaatattggagaaacaggtggcatgaaggaatctgctgaagtccttaaggctgtatctaatgcctgggaaaggcataattcagatgacattagattttgcttacttgttgtggttaatgcgtacataagacctgttgatatgctgcaaaaccttagggcaaaaggtctgtctaccctaagctgtatgataagaaattgtggtcctcagatactgaattgtctgttcgatcccaactgtaggaaagcccttcagtgtttaaattcatgttctccaactgatcaagtttgcaactatcgctgcattgcgtcgtatgagagtccgcatctggaggccttttctttatgtgttttgcagaagaacaattgtcttgatctcaatgccgagatccccagtaagccctctgtacccccactaaccatgttcagagaacaaatgctaagccatgaacttgcagaagacatgtttgttggatggttggacaacttggaatggagttggagagttgtagctggacaaaatccagcatatgatcaattcccatgtcagtatcaattattttacaggggaaaagctaaaggttcattttggtatgagccaatttttcaagtcagaaccctggaaggggaactggtttggaggcgcagaaagtaccgagtaagaagagctctcatccctggtacattttacttcagtgtgctggataatggtgtggtttcaaaggagttttggacaatcgttgatgtttcagatgatttcagctggggtctgttccattatcacggagccgctcaggccgctggactagcatacactggagcagtgctcgttagcccagatggctcttgtccagatttggatgacccaagactggcatctgctttagataagtgtgggatcaagaagtgggagctttatatggttgataactgttcctgcactggtgcacctttgggaactcctggagatgcaaagctgcattatcagattgctcctggaaaagaatcaggtattttgcagacagggtgatgtgttctaacggcacagaaggttcccagatgacttgcacggttgcacctctaagtcaggcagtgtggactgtggtctgtggatactgcggacttgatccagtgcaggaattgcttgcactgttgcacccactagactacaaatatgtaagaataacattcaggtatcgctgaaaagagtaattatgtaaaatgagcggttctttatcttatatagttatcatctaatgtcatgccttttttactgtcaccatgtcttcaagtgctaacaaataaatcggacttaacccttatctaaaagaacaaataagacacggttaaatacttaagtgtatttggttaaatattgctgtacctaagctaaatatttacatgtagtgaccaaggcacttacctaaacctccaaacctcagctgaagttggcagaggcacacctccagtccctgcatatgctgtgccagtctaaaattcccagtcacagactctggaattcccatgttattgttgtatagttgtcttgttattcagaatcctctatttcctaagttgtagcgttattatagtaggttgcaacactctgatttgtgcagagatgtttatatccatgctgatgaaaccaaagatatctgtttttactgtgaagatgtaatcaagacctaaccgtaaaagccttcatctggcagatgatccatgttataaagcatcttattgttttcccatatacggctgctgaagcatctttttgggttcagttagttcagcgcaggactaatgtggagggccatcttagccacaaatcgaagtaagcaacttgcccacgtctggttgacttgcaagaacccaggc

SEQ ID NO: 58422 - DNA, 5626 bp, Oryza sativa
ttgactctgaatctgtcatcttcggtgatctataaattccatccagatccaccccaacaattcgcgctcttcacagtccaggactggagctgtggtccggtggaggttatagagaagaagcagagagcaagaatggctgggctgtatgagagaccgtcggagacgtacaccaagaagcggcctcggtaccctgacgcttggttctccaagctcgccgccctcacagccggccaccaccgcgcctgggacgccggctgcggcaccggccaggcctccatcagcgtaagcgcccaatctctgaaccactctcgccgcttcatcatcttctgaactctgaaaaaaaacgaaaaatttcgccggcgatcgaccgtctttatcatcagtgtttctccgtgtgcgttcagatcgcggagcactacgacagcgtggtcgcgacggacgcgagcgaggggcagatccgccacgccgtcgcgcaccccaaggtgcggtacctgcacaccccggtggacctctccgaggacgacctcgtcgccatggtcggcggcgagggctcgctggacctcgtcgtggtggcgacctccatccactggttcgacatcccgctcttctacgccgtggccaaccgcgtcctcaagaggcccggcggcgtcctcgcggtgtggggctacaactacgagatccacccgttcgaggacaagctgcacggccagctgtacccggccatgcgcccgtatatggacccgaggacgaggctggccatggacaggtaccgcgacctgccgttcccgttcgagcccgtcggcgtgggccgcgagggcgagccggccgacgtcgacatagaggtggacatgacgctggacgacctcgtcgggttcctgaagaccggctccgtcgtgacgacggcgagggagaagggagtagacctggaggcggtgaccaaggacgtgatgaagggggtggaggcggagtggggagacccggcggtggcgaggaagctcgtgttcaaggccttcatgctcgccgggaagcccaaagtgctgaactgaaacgtacgctgaaccgctgattgctgatcattggtcaaccgcgtcttgtttcgttgcgatagattggtgacttcaccagaataaattccggagagacgactgaggccctgtttagatgaaactatttttaagtccctatcatatcggatgtttgaaaattaattataaatattaaacgtagactattaataaaactcatccataatcttggactaatttgcgagacaaatctaatgagcctaattaatccatgattagcctatgtgatgctacagtaaacattctctaattatagattaattaggcttaaaaaatttatcttgtgaattagcttttatttatgtaattagttttgtaagtagtctatatttaatactctaaattagtgtctaaagacagggactaaagttaagtccctggatctaaacaccacctgactgcttcggggttgtgcacggttgtgatgttgctttatgtttgccgctttgtcgcagcccattgcactgcgatgctgggcacccctttttgccgaataagttcgagctggtattggatatactgcacggtatctgcaattctgcattttatatgcctaaaacaagggaattttcgccagcgtcatcagcaaataatatcgtttccggggtttaaattcggcagatgcatcaggcaagtagggcctaaaagattagtgtggtaatgggacggtatagttggcattgccagtttgaaacaaactttgtttcggtcctgctcaccagcttcttcaacctcggcgcgaaaaaaacacactgtttagtaatttgaaaaacatacacgtaaaaaaaatgaagatgagttgaaaaagaaagggaagaacacagtcctaataaagctaaaagagtggaaaaagtacaccgaaggtccctcaacttgtcatctgagttacaaaatcgtcccctaactgtgaaactagatatagcacatccctcaatttataaaaatcgttcactttagatccttcggtggttttgacccgttttcgttacgtagctgagttagtgtgggacccacgtggaccccacatatcagcgtggcacgtcggcctcctctctttcccttattctctcccttcctcctctctctctctcacccttctctcttctctgggcaagccggacggcggctggggcggatgccgctagagtgaggcgggagaggaggtgacggcggcagctgcgatgcaggagaaggcgagggcggcggccggttgcgaatggcgtcgtcgcgctgtgtcgccaccgccggtgaagcggccccgtgcaggcgggcaccgcggtgttgggcgcggaggcggaggcggggccgaacgcccgcggcagtgggcacgaaggtggaggcggggccggctatagttgggttctttcatggcgagcgaagctgagtgttccttgagaaggcgacagaactcgtcctcaagaatgtccaaggcagcgacgaggaggccgccgtccaggtttgcggagggggtcttgaggtgagagagcacctcggcgaggtcggacacgaagcaggggtcggcgaggctgcggtccccgaggtactcggcgaagctgagccactgggaggcgatgccgcagttgtcggagaggaagtggagcacctcctcgaggcgggacaacacgacgaggtatccgaggaggtcgtcggcgacggcggaggccgcgaggaacggcggctcgaggccgcgcacggcgacggccggccccacagcgcggttgatgtactccccagcgccctcgagtgtgtcccgcggggcgtgatcgggcacaacgccgtctccatcaccgggaacctcgcctggatctccccaagcttgggccccgccctgctagtgcgtggttgagcgcccgcgacttctccaccccggctcgcaacgcccgccgcagccgcagccgcctcctgctctcctgcctcgccccggtggcctccgccccagtcgtcggtcggcttgcccagagaagagagaagaatgtgagagagagagaggggaggaggaaaacagagaatgagcccgacgtggccatgctgacatgtggagcccacgtgggttccacgctgactcaactgccacgtagaataaaactgtggtcaaaaccaccgaatgacctaaagtgaatgtttttttgtaaaatgattgatttttgtaaaatgattgatgtgctatatctgcttttgtggttggagcacgattttgtaactcgatgacaagttgagggacctccggtgtactttttcctaaaagaatcgatttacttggacggtccaacccatgtatgtggataacgagcccacctaaacaaacccgcacgtccacttcaacagtaggccttaggattctggcccaaaaaatatgcgacatcgcccatcagaggcccgtttaattcagaaccatggaacagcgaagcagaccgccggagccaccctactaccctcaaggcctcggacgccgggggccagcctcccaagcctcggaaccttctttgtcgtgttgtacgcccaaatatctactagtatcgacaagcacgatgctgcaccatgtaaacagtgagtaaacaaacgaaagcaaatcttatgacgtccgtcgagtatctaccttggaggtttaaaaaaaaatggatttgctatacaactggcgacagttaatagggggtaaaaacttttaaattttaagccgtctaatatgctttgagatttgtgctagtgagggaaaacggtttaaaaaattcagacgcgtgcagtagggattgttcacctaaccaattctcccatcgggtttttttagttacactcgagttatatattagttatatagtagttacatagtagttacaatgtaattacatagtagttatatttaaaagtttttcatcccaaaaactgtcaacagttgtatagctacttaaaaaaaaagagtatctatactcgaggaatcacgttccgttcctggcagccgaggcaacgtcggagccgctcgatccgtacgtgctactttcacaaaaagcaggattgaaagattacgggctcggtgcccccggtgcgcctcgattactccttttccccgtgatcggtatggttcgatcgaagaacacatcgatcggcgaacgcacatacaaaatgatcccagtgcttgagtcacacgcaggagcaccgtggaatacacagcacacgagtgcacgaagatgggttcaaggccatgcttgcgtgcaatctctctgtaaatgtaacacatcttcttcaacattcgaaagtcaagtgatacagaatggagatagctccttttgtggctgctactggagtctcgttttcgccgtatatgatactttttcttagagcaagtttaatagtatagtcaactactagcctccaattcatctatagccaatctaatagctcattcatacaatagttacatactatactataaatatctggtcctacctatcatacacataccgcgtcttggagtccgtgctacagctagctataaatctgtagcccgctgctcctttttctccttatttatctctttaaaatatgtttgcagctggcttatagcctgctattgtaaccaaagtttcgctgtccgtccgtctcctgttctagcagtaatgcattgggaaggggaggaaaggctgcagagctgtagtgcgagaatgcgagcgtttggttgcttctgtttatgctcccacttcgcggcatatagccctattggaaccgggttctctgtcacgtctcggatgagtcgctctcacgaggctatccctgccctgtgcggctcttcctgccgagtgattagttctctttcatttcatcttaaaaaaaaagttagggcatctttaattcgaagaaaaaacataaaaaaatttgaaagatttcaatattataggaaaaaattcctgtgaatgtttttaaacaaatgattggatcatatgttgatcttttaaaattcatatggaatagacaattctatagagattttaaaggaattttagctagagcttcaactgaaaatctcttttatctaattcctgtgatttttctgcagtctaattcttctttttttttgttttgtacttatattcctatcaaaattctatgtttttcttattccctcgtttttccattcctgcgattcagagagacccttaggctctgttcattccagggtgataggggagattaagtctcgttttccgcgcgcacactttttaaactactaaacgatgcgttttttgtaaaaaagttctataggaatgttgctttaaaaaatcatattaatctatttttgaaatttaaaatagttaatatttaattaatcatgagctaatggctcacctcgttttacgtatcttctcaatctcctcaatccccttctcttcgaacacacccttaatctctttcagatatgagataaaaaggaaattatgtgtcaagcacaagtagtatgtgcactcccatgattaaaggtgcaagtggaaagattcgcaaacccatttataattcaaattaatagataacccaaaaggttgtctgtttat

SEQ ID NO: 58423 - DNA, 3798 bp, Oryza sativa
cccagatatcacccggctgctctacaaccccggcgtttgtcacgttgagacttgtacggttccgcgcgtggaaccgatgcggccgaacgcgccgtggccactcgctgcgtcgcgcgtcgcggtccacgtcagtgaagtggtgagcgcttcaggggggggggggggggggataagacgaaggtgaagttagcggtgcagcaggagtattccgcaagaggccgcgaggtgaaaagacagcacgcatgtatgggcacgtatcaccatttaccacggagaaccggtgttgttgatctcaccatccatttcggctgacatgacgaccgctcaattatccgcacattatatgctttgcacagatgctgaattgccagtgggatgacggattttggtgcttttgtttcgcatcatctgcgaatgggagtatagtggtgcatatggcgtcatgctagacgcaaactgtgaaagctgcacaaggccctgtttttgcttatcccttaagtactagctctccgtcgccatcagcccatcgccgatcgatagaacaatgccaatgaggttataaaacgtgaactggcttggtttagttccaatttttcccctaaaaacatcacgtcgaatctttgatacatgcatagagcattaaatatagataaaaactaaaactaattgcacagtttgcatggaaatcgcgagacggatattttaagcctagttagtccatgattagccataaaagtgctacagtaactcgcatgtgctaatgacagtttaattaggctcaaaagattcgtctcgcggtttccagacgagttttgaaattagttttttttattcgtgtccaaaaaccttttccgacatccggtcaaacatctgatgtgacaaccaaaaattttcttttcacgaaataaacagcctctaaaattcggatgcattggattgatttgtagtgcggttatgtcaggttgccaataatgcagctgttggacgaatggggcatctccaaacgaccaacatccatggcctgatctgttcatgctctgctttcatgtgcaagcactagctctctctagagaagatgagtggtgcgtgtactgcaaatggggcagatttagttgcataaattgcactaaagaattttaatcagacgcccggtactagagaacatggtttgtctcccttcagaaaagagggagaaagaggtgccatgatggtttattcccctatcagcagacttgattggattctattgtctcaaactgaccaggtgatgcctcactagaaaaatatgcaaactttcaatatggttcgaaaaatatagagaacaacaaaattgcagtgatgataataggagcagtgggcatgatgaccaccgtcctttgtattgaggaaaacatatgaccactgtctggtacagtgcttcgacctgtcatgccatgaattggtaaacaaatatattccagtacaatttaatgtattatactccttgtttgatggaagacagtgacaccgacttagataataaaatgttaaagaagttggaaacatttctctgtacgtgatccatcgtggcatagcgtttccttcccctgaatcatgtatagtaggtattttgtttcagaacgtaatctagtcaaagcacacacctaataccaacatagagaacagttttgcttaagaaaaatcattgcccacggaatccagaagcaatacgaaccagctatgcttgtaccaaatgtcaatcctagtattgatacagctgaataatctcagacgaggaaagatgagctcctgatctttttacaagtcaatcatggttgagcattgccccattcgatctttcttggttggctagcatgcctgttgtttacgatcttcaagaggattcttcttcgacctgttgtgctctgggccagacaacacgccttcttttacatcatttgtgtaaagtaacaatatgctaccaaccacaagttctgcgtgatcagtattaatatttgagagtgccccatataacagcataactgtagactagctgaagtcacacgtaaaacactagagaaaaatgaagagatgcaggaatgcccaaacaaatttgtgtgaacatggcagttgtttttcctgtgtaagaaagaaaaaaaaaagaagaagaggagaaacttttataacgaaacaaaaactagtgcaatggttatgctggcccagatgaggagtgcacccaaaaggtgagataaagcgaagtaggaagggagatctgcaggcggcagccaggcaagcaacatcaattgccctagctaatccggctgatcgctgtcaagctactggtgaaacagcctccaaaccaagctgctttgcgtggaaaacacgtgcatgcggatttgcttggaaatctctccgcgcatacgctgtgcccatgccatggcagccaccggcccaccgccgtgcatacgcaccgtccatttttttcactcggccatacgctccaagttggaacctgaagaagtgtgaaactcccaccggatgaaatgacgatgcaacaaccgttaagactctagcgacaaatccgtagtattcggataggtaccgaggtagtgtggtacacgaagaatgtaactttgacacgcgcggtggtcggcaaactgcacaaacatgggtgtgtttagttccatgttaaaattgaaagtttgactaaaattaaaagttaaaaaaaaagttgaaagtttgactaaaattgaaagttttgatatgataaaaaagttataagcttaaagaaaaagttgagaactaaaccaagcccatgtcaagatttcagtcacatcgaactaattaaccctggtccgcgatacaggtcacgtacaacggcgacgagacgagcgaagaaagatagctacaggttttttcgcgtcgaaagaagcttcgttcgctgcgaggaagaagagcaagtggtagcggcagcggtagctgtagtacaggagtagggaatccccgtgaccgtgataggaggataaaccgggtctccgtccagttcaagtatagcaatggacgtacggtgcgcagcggggcacagcaccagcacaggtcggcacgaggagaacgcggagcttggtttggtcaccgcgatagctgttcttccagtcaccgagagccagccgggacgacggtggcccaagccggggtggtcaaggcacgggcgggcgccgcgggcgattggtcgcgcgcgtacgtgcaacttggggagagaccacgacacagccaacccacgcgccgcgtggcgccacatcgtgagcctgcacgtcgcggccgtgatccatccaccattccaccgccaccagcggcgctggtacaagtaggggggggtgctttgcttgctgcgggctgcggctctactctagggtccctctaggccagctgccgtgcagtccaagtccaagtccaagtccaagcgctaataaatttgccgttttatagcttcgcaccggactcgataaaaaagggaaccggaaagggaaggcggacggagaagttgccttttgctgtgtgcgctgtgttggtgggctgtgacgagggcgcgaatggccggcgcctcctccacctccgcgtcggcgcgggccacgccaccggctcgctcattgcctccgctcggcgcgtcggggagccagcaggagccggctgccactgcgagccaccacgccgccggcgccggcgcctcgtccaggccgatgcggcgcaagggaaggaagcagaagcaggtgagcgccgcgctagctaaagctcgctcgctctctctctctctctctctct

SEQ ID NO: 58424 - DNA, 5283 bp, Oryza sativa
gagtcgatgccggcgccgtcggctgagctaatggtgcgacgggggaaactacctgaatagatggctgggcatcagtgatcaaaggccgataatttggaaagacacctccttgcaaataaactgggcctgcagcctgatgctcagctattgatccatcggctattgacttcatcatgtttgataaggtattgactaacaccccagactgattgatcaaagcatggtgcacagcatagtcgacctggtcttggaaattattgaaaaaatcttgtgccgcatcactattctgattaagatttcccccttgcaacccctgagcaccatcaccttgaactccatgcactccatcgccttgaactccatggaccccttgagagttgtcaccttgacttcctagagaaccgccggtagcacctttgtcactcagttgagccgagccatctggagcttgtttcccgtcttcacctttggaagaactggtcctaggatcattggcaactacctttactttatacttctgaactaatgttcccttgcgggtctgcatgaatgagtttaagaactgatcccgggctttctgcaacattgcttcaaaatccttcttctgctcaggtgtgaatttctctggatcgatgggcacgacgtttccttcattgacgtcagtcaaccccaacttctggatcttttctttaacaaggcttgggctagtcgaggatggcgacagcggtggcttctcggccatgaggaagaattgcttgctgacttctaatcggtcccaccaggagtgccaaaagcgtgttgaaagaaaacacggggcctgtgagatctgcttaactccagtgcaggtccaaagctcgccttcgactccaccttgatctaatctcctttttcgatgctaatattaccaaatttggtcgttaacactatgacaatacatgtcatgcatatatcatcgttactttcgtatttgaaaatatttttatatgatgttaagtcatagctgataatatgttagaaatgaaagttgttgataatatgtcatgaataaaaccaatgggtcaaggtatactcttagacaccgtgtagaaaaaactaatacttctatgttttacgcaatttagaacggaggaagtaaccagaaatccatggcgcagcgaagtggccgaccttcatgaatcgtcaaatttgaatgatgctaacctgttctaaaggagaattttgctgtgagcctgtgatacgagaattttgctccagttctaaaggagattgaactattttcttggaaattccacataaattaagtgaaatcaggcgaaaaatgtgcgtgatgtgttctttcttgtgggtttccaacaaggtaataaatagcgtatagcgggttgttagcggattagtgtctgtatagcggattgcgaatagcggacgctattacggacgctaagttccaatagcaaatataagaaaataaccataaatatatctatattaacatcaatttcacgtaaaaattagaatttataatacattttttattactcatatatttcataacataaaaaatataaaataacatatagatatataagataaataagataaataatgaaaagttctacaatccatatatgaaaaacaacatttaagcgttatagcggtccaacaaagtcaatagcggactgttatagctatcgtgaagcgctataatagactaatatagcgggcgctaagttacaacatgctatcttcagtccgctaccttgtagcagcagcggtagaggtccgctaccgctattgtggccgctactgcggccgctacgaacgttatttattagcttggtttctaacccatttccctcgttttccgcgtgcatatttttcaaacggttaaacggtatgcgttttgctaaaattttatataggaaagttgcttttaaaaaaatcatattaatccagttttatgcgttttgtgaaaagtttatatatgaaagttgctttaaaaatcatattaatcaagttttcaagtctttttatagctaatacttagagcaggtacaatagcaggctataatccagctataaatatattttaaaaagataaaggaagagagagaaaagcagcgggctacagatctatagccagttgtagcacgggctccaagacgtaatatgtgatattaatagtataacaaaaaactatgatatgaattggttattacattggttatagatgatttggagttaatagtaagctatactattaaacttgctcttaattaatcatgtgttaatctatggctcttttttttttccgccggaacggttccaagtcccaacccctcagaaggctggtactgggctactagtcatcttctgcctcttcctcatgcaaacacaacaaactgccgtaatcagactatcagaggaaagcgttccgcggcgccgccgtggcgtccggcgtccggcctgtcacctgtgagtcgaggccgcactttggcgcccgcggcagagcccgcgacatgccttgccgcaccgcgccgaggcgtccaaacacacgctccgcccagcccagagagcccactcccgccgccgcgcgtcccatccaaacctccctccgcctccgcgtcccgccggccgccgccaatggaggcgccgccaagcctcccctaccgccacctgccgcagcatctcgccggcctcctcaagacccggccgctccacgacctactctccgacgcgtccacctcccgcgccgcacgccacctgttcgacgctgtgccgcgcccgacccccgccctctgcggcacgctcatctccgctctctcaaggctctgctcgcaccaggagcttctcgacgccttctcatcgcttcaccgcaggggctccgacgtcccgcccggctgtgtgcccctcgttgtgaagtcgtgcgcgatcttggccgcgtcacgtcagggaaagcaggtgcactgtcacgccattgtccgtggtctccttggggatatctttgtgcagactgctctggtggatttctatgcaaagaacggggacatggattgtgctgtgaaggtgtttgacgagatgccggtgaaggacccgataccgatgaactgcttgatcactgggtattccaagtccggtgatgtggtgaaggcgaggaggctatttgatggcatggtaagaaggacatctgcatcctggaattcaatgatcgcctgttatgcgcatggtggggaataccaggaagctttgaggttgttccgtaggatgttgagtgagggtgcaaggccaaatgcgatcactattgcgacgatgttttccatttgtgccaagactggtgatcttgaaacaggaaagtgggcaaggtctttgatcgcagagcaggatttgcagaacatgatagtgcacactgccttgatggaaatgtatgtcaagtgtcgggctattgacgaggcacgccgtgagtttgatcggatgcagcagagagatgtcgtggcatggagcactatgatcgctggttatgcacagaatgggaggccacatgaatctctagagctgtttgagaggatgaaggcaaccagttgcaagccaaatgaggtgactcttgttggtgtactatctgcctgtgctcagctgggctctgatgaattaggaggacagattggtagccatgtcgagagccagaacctaccactcaccagctacctcggatccgcactaattgacatgtacacaaagtgtgggcacgttggcagagctcgcagtgtcttcaaccggatggaacacaaggttgtcataacctggaactccatgatgagaggcctagcactgaatggctttgcgcaagatgcaatcaccttgtacaaagagatgacagaggaggacgtccagccaaacgagattactttcgttgcgctgttaacggcgtgcacccatgctggattggtagaccaaggtatgtcctttttcaaagagatgaagacaattcaccatgtttcccctcaagtggagcactgcgcgtgcatagtggacctcctctgcaaatctggaaggctgcgggaagcgtacaagttcatctgcgacatggaggtcgaaccaaacgcggtgatctggagcacgctgctgagcgcctgcagggctcacgccgacgtcgagctggccaagctcgccgcgagcaagctcctggttcttgagccggacaactcctccatctatgtcctgctgtccaacatctacgcggatgccggcctctggggcgacgtgagggagatcagggacctgatgaggagcaagaacgtgcagaagctgtctgcttatagttggatagagctggacggtgaagtgcacaagttcctggtgcaggatacgtaccacccgaaatcagctgagattttcaacgtcgtcgacggcatggggttgcatctggacgacgttgattctgaccccgatttatttgttctagagcactattgaacatttgaacatgctaacaaacaattgcagcagggcatccttcgttcactgcagattgattgtactttgcataatttatatacatgcatgatccatcgattcgattattattagttagtactagaaagtatgtagaaagtataattggtaagtgttgaattgttgggccttcttgcctagcccaataagaacaatgactaccagtaggccttattgatgatgagcccagttctgagttatcccgagtcctgcctgataaagcaagcagtccaaagcaggagacggcagaacaccaggttgtcagatcccttcgcctctgaaccctgagtcgccgatcgaaacaatccgatggagtccgaagctgacaaggccgccgcgccggcgccggcagcggcggcgtcggtagcggagacgagcgacgacgcgattcaagaggagtcaccggcaccggctcccagcgggaagcctggatcggaggcggcggccaagccggaggtcgaggtgcagctgttccggcgtgggcgggggccggtggccgtgttccggtcgccgctgggcgggtacacgcaggaccagctggaggtgggggacatcctggagcagcacggcctcaagtccgtcttcgtcttccaccccgcctcccgcacccgcggcgtcgccatccgcttccacccccgcaacggccgctccctcctcacctacgtcgctggttccaccatcttcctcgacggcgagcccaaggtaagccttacggatcggttggctctctctggctcgctcaattttaggtagtcgaagtgatgtgatcatgtgagt

SEQ ID NO: 58425 - DNA, 13358 bp, Oryza sativa
aacagaataactatccgctcctagttacccctctccagtctccaaagcgtgtcgttttggacatatatctcatcaaacttttgaaactttgaatatcaatacatttttaatatttagatttgatacatggaaataatgtgcatatttgtctcttaagtactctatgatactataatatctatcaacatttgtaaatatattcaaaatttgcaatagaaattagtggtgaaagatgcattttgataccatgtcaatgttccaaacatgttttcgcaaccagacggagcattacaacacaaaacctccgtagagtactaattagtctattcaaaacattattcatgtatcatgagttcttggcgaaagggcatgtagtctagtagttacagtgacctgagtaacaccccaaggtcctgagttcaaattttaataggagcgaatttcagattgggttgtttgaggagctaagttcccaatttaaatggttgcatatatctggttggatgtagaggccgggtaaaaaatacccatctctaaaaaaagagtatcatgagttcttgtcattcataatttctgctgaaatatacttataggctgttcctagaggaaccaaagtaagtatgtcacgcatgtgcttccgcctcattcattgtattattaggatatgggaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtagcaaacatggagtttcagtttacaaaacaatgatccttgatatatgctattgatgatttttgcatctgtgcattggcacacttcgatgtgcccatcttgcttcgcccttaataaagagctattggataccacaaactgtattttcttgtgcctaagctagatctcggcttaccattatctataggatttaaacactggatttactataaaatgtcatcctgaaaattgtgattgtttcaattatcatacagagaaatcatcaagtaatccccgcatgagaatgctttaggttttgtcacatagtcgaggggcacacttacattgtcatttgctactggcagaatgtcacaaagttctgtgcccatttgccagccatgtgagaatggcaaagttgcccatatctccttccgatctatctatccgctaatctctaccttcgaccatcaccgtgccttggctccagagtgatgctattctcgcgcatttatatgttagaatggatgcgctagaatagcatcaaaattgatcaccagtaatccttacaggagcatgctccatccttgaaatggtgaaacctattcctatctctcataacaatctccctgttgaagaccttggatatcatcttggtataatcatggcagtcctcacatactctcaggttcttcactatcctaatctccatgtcttccggcaacgcgactaggccaaatgcaatggccagcttctcactatgcaaggagattgcatcttctttgtcctcttcctcgatatcaaacaacacctcttttgtgttcgcaatgtacccttgcagcctcagcctctgattcatctctgcaagcatcatctcgatctccttgtgtcttgggtgtgtcttgcctccaacaaagaactcatgcaccttgccaccaacctcaatggcactacacccaggcacctttttcactcccttggccttcatcatgttccgaacattgctgacacccttccagttctgcgagtctgcatagatgttagagagcaggacatgggcggcatcattcttggactcgatcgccatgagcttatccattgcatatttccccagttcaacgtttttgtggatccgtgacgcattgagtagtgctccccacacgccttcgtgtggctccaatggcatgccattgatgaagttcacggcatcatccagacgcccagctcgaccatacaaatcaaccatgcaaccgtagtgttcaagccaaggatcaattccatgattgctcttcatcgaatcgaagcatgctcgtccctcatctaccaacccagccatggagcatccacggaggaccacgacaaaggtgacaccgttaggctcaacccctgtgctctccatgcgcttgaacagcgcaaggcagtctctccccatgccattcatcgcaaggccactcactgcactggtccaagtgtaaacgttcctttcgcccatgctgtcaaacacctccatggctgccgccaccgcgccacacttggaatacatatcaatcaacgcggtgccgagcgtgaccgacagccgcatcccacggctatgtgcacacgagtgcacccacttgcctcgttccagcgcgcccaattgcgcacaggcagtgagcgctgacaccagcgtcacctcccccacggcagcgccagcatgacgcatttcgtcgaacagcctcaaggcctcccttgaccggcccgtgtgcacatacccggcgatcatggcgttccacgcgacatggtccctctgaggcattccgtcaaacagctcgcgcgcagcgtccgcttcgccgccagtggcgagagcccccaccatcgcggtgacgcacaccacgtccgggctcgcgatctccgcgaacgcggcccgcgcggcacccacatccccggccgcggcgtacatggagacggccccgctctgcacgtgcgggtcgcccgcgtgtccgtggcggagcgccgacgcgtgcacgctccccgcgatcagggccgcgtccagcgcggacgccgcggcggcggccagggcggtcgcggcgcggacgaggaaggtgaaggagtagttgtcgggcgcgagcggcaggtcgcggaacgcgccgaaggcgaggtgcgggcgccggccgcgagcgagggcgcggaggagggagttgtgcgcgaggagcgtggcggggcgccgcggcaggaggaggcgcgcgtaggagaggtcgccatcgtcgtcgtcgtcggaggaggaggaggcgagggaggcgaggaaagcggccaggtgggacggggacgcgatgcggcccgagacgaggaggtgcgcgtggatctcgcggaggtgccgctgcgaggaggccgccgctgccagcttcgccgggtcgcggagcggtcgcatttggtttgacacgctacggcctacggcttgtgagctactctgacgaaaggacttcccgtttcgagcattcgccgcgcgcgggctgacgaggccgaacgcgactacgaaccctggcccgcgtgggagtggcccgttccatggaaattgctatacgtacgagatacaactcaattattggaactgagtttgatcgacggcagccatgcgttgaacatctgctcctttcattgatcagtggttgcatttgcatatgattgcgcccgtccataccactacactcgcagggctaaccgacgaaggaagagtgaaaaccagtggattatcggggaaggctcggcagagcctgcaagcaagacagtaacattttcacgttgccacggcgaatagcggcacctcgctttaggcctggtttagttctcgaaactttggatacatgtatggagcattagatatagattaaaaataaactaattgtgcagttaggggggaaatcgcgagacgagtcttttgatcctaattagtccatgattagccataagtgctacagtaacccacatgtgctaatgagggattaattaggctcaaaagattcgtctcgcagtttccacgcgagttatgaaattagtttttttattcgtgtccgaaaaccccttccgacatccagtcaaacatccgatgtgacaccaaaaattttcttttcgcgaactaaacgtgcccttactctgaagattgatgtgcctttcagcaagcctcctggaagggaccaagttcactgaatcacggtcacagacatgcaaagtagaggggagtaaaaaagccaaggagatactctgtgaagccttgcaaaatcagatcagaatggtaacctgcaaacttgcaagggctgctgcctactccagctctttggcgtgtgtaaaacaaacctgacaaaagtcctggacagatgttttgctgtcggattaatcttacttcctccgttcaagaatccttctgaagagacccccttttacaagcatcttggcctagagtttgatccatgcaaagaagtgataggttttacaagcatcttagctgcaggatagagtttgatccatgcaaagaagtgataggatgggcggtggtaaagttaaaaagatgcaaaactggggaacctgctagcttgcaaggattgacggccacaaattcttcagagaacagctgatgaagagcataaagagaagtcgtaaatgcaaaccctgagcaaagatgatgcaatgttgctatttatggggaaaacgcaaagcaagtttcaccgaagcactcattccagtcttttgccatatttggagaaacatggaaaatctggtgaactgtaaatgtacatctcttcgttgcttgattgcttcctccacaattaacttctttattcttgccttcgacctatcagctttgtaggactggtacattgcaggaacctggagcaaagttttttttttcccgagaaaatgacagcaaacctgaaaggacaataaacagcacaattatcttttgaacagcatactttcaaaggaatgagcccgtcactgcactccaaatggcaatttgatcaatttacgaggatgtgaaaacaattgatatattcatacataggatcagtacaagtaaggtattgtagtcgaaatatcagaattttttaacagcatgtaaacagagaggtgaggccgccatacggtctagaaaccaatgcacaacaactcaaatataaacttgtgtaaaagtacaaatcaagtgagtgctgttcacggtcaagtgagaccgtgaggaccacaatgccactactaaaatttaacgctgatgatcagtgaaacaccaaaccgacaagctatgccaaagcttctgtgttatttgctggaattgtcacccaatttctttttctcaagtcttgttctgctgactagaaacaaaaagaaaaagaaaaagaaatgctattctgactttaaactgttggagcacatgctttggtcattctactgcttagcatgctgcataatgtttccctactgataaatcatggggaaacaaactggctgcagaatgtagaagagacatagtccattaaacacggcctgatttcgcacatcatcaagacatctttgccgtgatacgtcagtccagacaggcaatgcaacatgtaactctgtcaaagtcacgaaaacagtttctttgccctaaaaaaatcttaaagagtataaaacatcgagagtctcttttatgcaagctctacctgaaggccactacaaagattgaaaggttcataaaaaatacatcagattttctctgttatggcattaatgttaataaatatagaggtctaaaggcccactgagtcaacaacataaagagaagaatatcaaaacttcacacactttttgcactgggttttcaccattattctgaactgggtttcactgttattatgtctaataacataagaaaacaccaggagactttttgcagattgaaaacaatgaatcaggatttagtccaagcagtgttttacttctttagaattccacataaatatggtcaaatcattatcattattcactcaaacagatgtccttactgcacacataggaacgataacggaactggcatttatccagcatgggcatttggacaatttttccaaagactctgctaatgctaaaacctgcatggaaaagtttgcacaaaacctggcttctgtctgtggtctatataagacagctacagtatgcccaaaactttctacatcccagttgggcaggagagttggagtgttcttcaggttcatccattatggtgtcctggaaggacatctacctcgttcttgaagcgacagttccactatatgtagctatgatactggcctacctatccataaaatggtggaagctgttcaccccagagcagtgctctgggatcaacaagtttgtggcgaagttttctattcctctgctctcttttcaggtcatttccacaaccgatccttatgacatgaatatcaagctcatatactcggatatcctacaaaagtcgcttgccttgctgggatttgcagccatttccaaagcatgctgtgcagagaagtttgactggctgattactggtttttctttatcaacacttcccaatacactgattgttggcatcccgttgctgaaaggaatgtatggtgagcaagccggcaaactactaagtcagatagtagtcctccagagcctaatttggtacactcttcttctatttttgtttgaacttcgggctgctaatggaatggccaccactacatcatctgaaactacaggtacgtacctaaactgactgactcgatttaggatgaaatttgaagttgcttcctcgaaacagcatggcttaaacacatttacatctttatttaagattagaaatccaagatcctggctccaattcgaaataacattgttcaagtaatgaactagtatttgagcatcgtttcctagtaccaactatatttcttctgattttcattattttttttgtgtgtgcgcccatgctaaccttcacaaatagttgcaaaaatgaaaaactcctgcaaatgttatagatcttactttccaaacgaaagaagcctgctagatactcaaataaatgtcgtttaagtgaccaatgtaagaaaatatgcattctatgatggtagctcaaactgatcttatagatgtcgtataatgcaatcatattattgtgaactgagaatacactaagcaaagagaacatagctaattctccgtttaatagaagaaccaatgaagtgaaatactgttctacttgcatcacttctattttaatctgcagtagcaactatagtgtcatactaacaggaactggcctactctgcacaaatatacaactaagtaactatattgtctagaaaccacctgtagtatttaaagttcagaatgaaacagagatttgaatcgctacagcccaatttaaagttgcctgtacaatcatttaaattacttcatttttttagataatccagcctctatatccaaaagtggatatacacagccaaggagaaattgcttcatactttttcattgtaatgcagttcactttacgcaatagatttgtctgaaacattgtacatgaacttgcttgaattatccagtgattgaagtatattttgaacttctttttcatatacgcctcaccagcaagcagcttaacttatcttctgggaatttaacttattattctttattaaattagttcgatggtttttatcccatgtcatgtttcaaaattgaagcagaatcaggtactagaggacctacacagcaaagatatggagatgttcaggcaaaaggtgtatcagcaagatgttcttgtgcttttcgctttttgttggtggttggtaagaagctagtgatgaaccccaacatgtatgcatgcctgataggtttaatttgggcactggtcggcttcaggtatgttaatgagtttatatgaatcaatttggcttcaagcagaaatgcagctgttattgacttacttcatacaactccataacatacccacaggtggcacataagattaccgttgattgtcagcaattctataaggatgctctcggatggagggctgggaatggcaatgttcagcctaggtaagaatagcaggatatctgattcagcttgatgcaatgcagataaacttctaaatacgtctaaactttgcgaaaaccaattatgttattataaattctaaatacttctaatcacaggccttttcactgctctacaaactaaaattatagcctgtggagctaaaaggatgctactagcattagccatcaggttctttctaggaccagcactaatgggtatgtcttcttatgctattggaatgcgtggagtattgctgaagatagccattgtacaggtatattctagttctttctttggacgagctattatttgtaactttgaacaattcaaccacagaaattacgattaacctgtcaaaatcacattcaggcagctctacctcaaggaatagttccgtttgtgtttgcaaaggagtacaatgtccaagcagatattctgagcactgcgtaagtagatcacctaccacgatacgatcctatgcttgtatatatgaagaagcagggaagcatcattaaccaacaccttacactgatctctcttatggcaggataattgttggcatgatggttgcagttcctgtggcgctggcttactactttgcaatgatcatcccagctatcaaataactatttgcagaagctagcctgattgtgttcatttgagaaaacaatgacggctcgctgtggagaataagttcagttatgagtgaatattttgctagactgtatatatatgtgcccttgggtttgtggtgaaccataataaggatatctgatttgtatcttagtgcatagtggccatacataattcttaccgtttcaactatgaacaactctaatgaacagaacatgtagagaaagctcacattccccggcgacgcggcgtgctctgttcctgtcaggcgctccgtccaacagacggtgcaccgtgcaccccgcccatgagctgctggcacccctgtggggcattctgccgaacatcttgcaggcgtacccagggctgaatagcagattatctggctcagcttgatgcaatgcaacagcagccaagagcttcatgtgcatcaaccatttcttggcctcattttttcctctccggagaacaattacatggcaatatggcattcacacaccgttcccttccaactgtggtgtggaagaacaaacagttcgcttcaccggcagcgtggaacttgcaactgttcgacattttgtagttgggaataagttcactttattaccctcaaaactgatcgaaatcgaccctaaaccacaaaaccggatatctcgacccccaaacttttaaaatcggtgtaatttgactctctaggcggttttggagggcggtttcgctgacgtggcgcctacgtggcagtattgactcggtattctttccacgtggcattgacgtggcgcttagttggcattagaaataaaaaaattatgcatgggacccattagtcattcacacacaaaaaattgtggggctcactgacatgtggaccccacatgtcatcctctctctgcctttcttcttcctcccctcttccttccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggtatgacgtccggggcggcggccgcggcggcggggaggaagccgacgtggaaggagagggagaacaacaagaggcgggagcggcggcggcgggccatcgccgccaagatcttcatggggctccgagcactcgggaactgtcgtcgttgtcgatctggtctcgaactggtactcggcgtggtcggagaggtcggcggtgacgactacgaggaggagatggagggggcgggcagcagccggacggtccagcccaccgccgacgcgtacagcaacctgacaaacgcgtcgttattcccctcttcaaccttcctcgattgtatacatggcagcagcgcagcacgtcgtcgtccggccatggacgtcacgggagctggtcaggccatggaggagcagtgagcggaggggtcgatggcggcgttgggacggggcgatgcgctcggagccgagggcgccgtggggagcaacgcggcggagggggcccggcgacgctggccgtggacctcggcgcagagggcggccgtggacctcgacgcaaagggcgccagggcggaggagatccagcggagaccgaataagggaaggagatcaaatcagagcaaagggggagagagaagggagagaaagggagaagatgacacgtgggaccaacatgccagtggggcccacaatttttttattttgtgtgtgaatgacatatgggtcccacgcatattttttatttctaatgccacgtcaacgccatgtggaaagaagactgagtcaatactatcacgtagacgccacgtcagcgaaaccgccctccgaaactaactagggagtcaaattacactggttttaagagtttggtggtcgaaatattcgattttgtggtttagggtaatggattagatttcaatcgcttttgatttgagggtcatgaagtgaacttattccttgtagttgcgcaagataaaagcccaatgggttaaaccaagcccagtgtcacccacggctcaccagtattgtggcccactggtttgtggtcttcggattagcacaaaagtgggcccagtttagtctagaacttttcttttttcttttttttttcttttgcgaaagtttggtactacaatctttgagttctggacacgtataggtaataattaactgtaagtaaagttttgtactgtaacttaatactagtaattcgtggggaatctgtattactgtagacaaaagggggagaggggatgtgataatgacacggattaactcagtataatgccattttaccaagccaccaactcactccccaagaaagcacaaagccacatcaacctcaccttcttgcccccgaagaaaaagaaggccacggaagccacgggagagtgatctgggccgtccatctcacaacaagccacggcggggagagatctgtgccgtccatctcacaaccagctcctcccccacggccccacccccgccgctataaatagacgcttcctcttcctccccccctcttccccaccactccaaagttccaaaccccacaccaccaccgcgcgcccgcatttctccccgctcctcgcgccgccgccgccgccgcgtagtcatcgagtcgagcagaagcgttcctcctgccatggaggcggagacggagtgcaaggtccccggcgtctactccgagaccggcattcccgtggaggatccggctcccggcctcaactccgacgtcagcaagaaggacgcccctcctgccgttgcggcgccgggtcccggcctctacttcgagatcggcaagaaggccagaggtgtacacgcgctcttcatcttgtttggttctcttttttctgggtggtttttgaggggggggggattggtggtggcggttgctggcttgagcaaattttagtggagtggtttgctgatttctgctgcttttcctggtgtttttgcagatcttctgtacaaggacttccacacggaccagaagtttaccctgaccacctacaccaacaatggagttgtgagcattaccgatttccgcatgctttttactggttcctttcttgtggacatcttggctcgcttgctttcgattgtttgtgtgtatgtggtggtttggaatggtttgagtaggaggatctcggtggctgtgtgatgtgcgtgtcggagttgtgttggttagcggggctcggtgtggtccgagcttgtgtgtgtggcgggttgcggccagtgtgtttgtggaattgacctgcgggtttactgagttttggtctgatttgattttgagttgagttgggttgaagagttgatggatagtgcattttactttttctccttcctggtgttggatgagatggtgaatcggtgatcgaagcgtcgattgggtttttctgttcgattgacaggtggtcaatctgtcaggttgatgtttgttacgatgtttccactgggttttttgttcgttggatggttggtaaatctgtcaggtttcggtttggtgatcgaagaattgactgggtttatttgttcggtccatgggtggtcatctgtcagtgtcaggtttcggtttgtgatggaaaagtcgattgagttttttctgttcgatcaacaggtgatcaatctgtcgggtttcagtttgtgatcgaagattcactgggttttttgttggatgaatgggtggtcaatccgtcatgtttcggtttgtgatggaagggtcgattggggtttttgtgttcgatcgacaggtggctaatcagtcaggtttcggtttgtgatcgaagagtgctttggattttttatgtatttctgttagatcgatgggtggtcaatctgtcagcgtcaggtttcactttgttatagtaagatgcttccattccgttgccagtttagtgggtttctttttgttagaatttactactaatttcgtagttcttaaattgtgcaacgagttgacttgttgataattttgggtttcagtcgagaggttcccagtgataattttttatggtttagcttatacgagtactgctttgtttgatctttccttcagtagatgctgcatgtcaacgtcaacttgtgtgtgtttgtacggatcagaggatctcaatccgtgtttgtactgatgctttgtatcatgggtgtcaattgcagattgcgttggatatcttgttgtctactaatataataatcaaatatgactcttattatttgatttctgtgattctgtctataggtaatcactgctgcaagcacaatgaaagatgaagctatctttagcgagatccagaccaagctgaagagcaataatgtgatgctggatgtgaaagctacttccgattctcaggcaagtttctccttgaaaatgcccttcatctatcaaatgttatctgatta

SEQ ID NO: 58426 - DNA, 1396 bp, Oryza sativa
tgaaacatcacggaatacctcctgtgaattagtgttcgaaggctaattttgggacgggcccattacacgatgggctttatttatcactggaggaaatgggcttcaccattttgggccttaatgggcctcaatcttgtgtgtattcgaccagttacatattcatattggacctcattttttgttgggtctagctatacaatcggtgacaaattttctcctaaatatttatgaaatataaatatagcgcattgtagttatattgtaacttacataactacattacaatttgtatgtaatatattatttttgcaaagcgcaggtcggacagattctcctcatctctatgtgtgctatacttttttttcttcccaacttgtacaaatcttgaagtaaatctaacggtttaaaattatacttaagttatatacaagttacattgtagttagatacaagttataatataattacattataatcatactgtatttacatctgacagaaaatttgtccacaaatatataacataatcattttttatgatccaatacattaataagcaaatatttagtagtactacggtgaaacatgcagtcacaaattaagtgagtgctatggattatggatattatggaatttaagggaatatgggtttttagtgttcatgtcaattaattatcgaggaaactcctacagtactattttggaggataaacggctaactttacgttaaaatggaagaaaattaaagagatgttaaatcggattgaatgtatatgaattaattaagatttactaccagctacttgtcctacttgacggatttacagatcaggcagacgtaaagattgatcgagcaaaaacgcataaacaacatttctttaatgcaattacctatgaatcaaaacattacacatatatctccacttgctacagatgagagattaattttgacgactaagcaaagcaacaatctgaattattttggcccgatgatcaaatcctaccgaattcaaacgcaaactgacacgaattaccaacaaaaacaaaaacacaatgcatgcaaaaaaggaaacataatttgcaactagctaggctagaccgttcgaccaacaaatcaaacgagagccattgctccggctgtcgcgacgacgagcagcatcagcaaggcaccacccctcactgatggcgccgacgacggccgcggcggcggcgccgccgtcccgttcgtccccggcgccggcgccgtgaagttcatccctccagccggagacggcgccgtgaagtttcccccagccggaggaggtggcggcggcggcggcgagcctgcaggggccggtgctggaacgggtggcgacggcgccctcgccgtgccgttcgttcccgcggccggcggcgg

SEQ ID NO: 58427 - DNA, 6524 bp, Oryza sativa
cgagttctcctttgcactgcgactccgcactagcatttgatagcggtgaatcggtgctaggttcagagctcagagcggaagcataccgtgtggcgcataacctcctcccatggcgtgtccttcagcgggctgatgctcccgtcgcctactatggagactatgcggacggcgcccttcccggtgatggttccgccggccccgccgccaagctcgcccgcggcggcgcgcggtggcccgagagagcggacgccgccggagtagcggcgggcgatggtgcgcgaaggggcaggcacggaagcggtttcatggaggtggcggcgagtaggtaggaagaggcgagtggtggccgccgcggaggcggacgtggtgggcgtggctgccatgggagtctgggaagaggaggtggacgaagcggctggacctcgagtctcgagccttcgagaacctttcgactcatccctaccgttcgatcagaaaatcgacggtggatactaatctcagggaaaaaaattctggaaaacgtttttctacacaaacaaaatacgagttataaaaactagctggtggcccgcgcaattgcgcggcaaaccccaaacaaaattatatatttttaagtatgattttacttaaaaaatttattaaatagctatctcattgtcttaagacattgaaaggccaaaccttatcatcatcgtgtttctaaatatatagtttttaaaagtcacaccagttgctatccattatgtcatcctcttctttatttgcttgctcgattatcactatttctattcattcttcttggaatcattaaaaattggattttatagttttagagtttattgtcatgttgtgtttcgtttttacaattcctagatgtcccgtcaaatgttgccattatacacctctacggccagtccactgtctcttctctttattatcattgagattttaaaaatcgaaaataattatcgtttggtttattttttactttctaaaagtcctgccaaaccatcagcggctttgccattatactcctatatgactcgcccgttgcctcccttttttattgtcattgagatttcaaaatcgaacatgattatcattggttttttttactttttaaattggacttgtagtttcattttttataatttttagaaattccatcaaacgatgccactatgcccctctacagcccatccgccccctactcattattgtcattgtgattctaaaaatcgaacataattatcgttggaatttattttttattttctagaagtctcgtcaaccgtcggcggctctgcaactatactcttatacaccccgtccgctgcttctctttttattgtcattgagattttaaaaatcaaatatgattatcaatgtggtttattttttttactttctagaagtcccgataaccgtcttactcgtttgcttcacggcctgcctgacatccctccttttaatcgtcattaggattctatttggtgttttattaacattttttatatgtcgtatcaaccgccaacactctactctgttttagatggtattttctttcaatagtctttatttttatcacaaattttagttatttataaattgtattcctaattgaaatcttatttttctttttctaatttcagaattttttttaaaaaaaattagttagtaccgtattgtgttatcttaatgtttttattttttattttcaatttcagttgttttaaaaattgtatttctacttgaactctctttaatttttctaattttagatattattttattttttactctaaattttaattaatctcatattgggttcttatatggattattctttcaatgttgcttatttttaatttcgaatttcagctaattttaaattgtattcctacttacactctcctttcctttaataatttcggattttattctatttttatttcggatttgattaatctcgtattgagttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttcttttattttcattggattttaaaaatcaaacgtaattaccatttgggttctttttttactttctagaagttccaccaagctgtcagcacctttaccactgtacacatgtactgctcgcccgctgccccctctttattgtctttgagattttaaaattcgaacatgattatcattggggtttatttttttactttttagaagtcccgtcaaccgttgtaaccatgctacttaatgacccatccatcgtccctccttttaatcatcattgggattctatttggggttttgtttatagtttttagatattccatcaaccgccaccactctaatcctttacatgcatgttgcttctcctatatttgttgtcatttgtcatagttttataatttttagaagtcatatcaaaccctgtcaccatacttctcttcggcctatccactgcctcttctctttattgtcattgggattttaaaaatcgaacataattattatttgggttcatattttactttctataagtcccgccaaccgccatgaccaggctgcttaacggcccatccatcgtccctccttttaatcatcattgggattctatttgaggttttgttaatagtttttagatgtcctatcaatcgccaccattctacttctttataaacttgttgcttctccccctctttattgttgtttgttatcatttgtgttctagatgaagttttttagaagtccatatttttcagtccgatattttatttacaaattatattcctacttaaactcttataattatttttctattttcagtatttatttttttgttatttcaaattttagttaatctcgtcacatgttctagatggtatcttatttcaatagtttttatttttttatgacgaatttaagttatttataaattttattcctaggtgaactattattttttctttttctatttttggaatttattttaattttgatttagaattttggttaatatcgtattatgtcttatatgaattatttcttaatgttcttttattttcaattttatagttgttttatcctactcaaactatcttttttatttctctaattccggattttattttatttttattctgaattttaattaatctcgtactggattcttatatatactcttcttttaatattccttatttttaattccgaattccagttatttctagattgtattcctatatggactcttcttttttcaatttcagattttattttatttttattccgaattttaattaatctcgtattggattcttatacgaactctatattgcttatttgtaattccgaatttcagctatttttaaattgtatttctatttggactcttctttttttcttctccgattaatgtgggaatttctaacccccataacgaacgtgatgcttttttttcgagcagttttaataatataatagatagatagatatcttcgaaactcccgcccgccaccgagcgggatacgcaaaaatctccaaaattttccccaacccgcgcgcccccagttttcctctcctccgaatcccaatctctcgcagttcgttcgaggagctgagacgctgcgacggccatggcgacgagtctcttcctcgcgctgcagtgcgtccagtgctccactatgcaggtgcgcgtcctcgcccaaatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgctaggggcctagtgttactacttaaaatcaacttgcttgccgcatggtttagtatcgtgttttcaagcttggacgcagtgagtacgggtaatgatacttgtggttcaaggcttaacaaaggcattgctgaactaaaattataagcacctgtttgtgaatagtcttgtatttcatattccatgcatgaatataaatgttattggggcaagctatacattgcttatgcagcgctagcatgatcacaggtctgttacgcagttacaatggctagtacctgaatgctcggctataaaaaagttgaatatctgcattatgtttcaggatgaggttgtattatgtatagcacttctaagtcttgagttagttctcttcatctttgtttatctgcacttatctgggaaggaatgaccagtctttaatgcatgatctaattgttttcatacctcaatttacaaatagatgtagggattcaagtaacaactgaattacctgaaaagaggcctaaagtcacttccttgaagagggcccccaaagcccaattgggattaggtggaaagaggcccaagacaccagtcacttccactttacccaagaggcaaccgatcgaagaaggttcactcccatgttctgcagctcctactgctgaaggcacattcaaatcctaacacatattgtacttgtcattaacaaaacatgtaagttaaacgggttgtatgttttctgcagcacaaagatcaaaatggagcaattatttggatacaagtttctctgaagggggaagtgggtttgaagactctgagcgacattgcagtgaactggaatgctccattactgatgttgtggtggatgatgaggtacaccctgattttgtgtgatatatatgtgtcttgtcttggtctgtagcattttatgctttgaatagtgcagtagttagaaaagatctgatgtgcagttggcaaaatattatcatataggatgggcactttattatgcactgaatcgcaacttgctatgttaaaattgaggagaaattaagatgcatgctaaccttttgaaacaatgatgttaacagtgcatctgcttaacctactttcagagttctctgaacttagtcctttgagtttaaaatgtatatgtataaggtgacaggcttatgtcacaacaagagtttcagttagttgtatactccacttaacaatacccccacccctgtaatttcaaaaaaatccctggcaaaaagagagaggatgggaaaacacaagtggtgactcttttcttcattttggaactccacaaagttatcctaaaaggtaccccgtataaaatcttctgcagtacttcaactggaagtagggatatgtaattccgagttaactgaagattttgttggatgtatatggggattatgcactactaaataactactgattgcatgcttcatttgttatgcttgtgtctggctgagtgcatcactgcatcttccaaacataaactgatattccgaaacaataatccctacacgaagcctgaatcacaatgaacaaatttgaaacttgctgatgtctgaacaattcaacaacttctgatttctgaaaccattgttagtttaaacaattttgatcattgaccatgatgaagatgtgcactcttctgacatgaacctatcaccgatcactgtttcgctgccatcaacctgctaagttatgttataacctattaacttggtaagttcatacgtctcaacatctttctaaatccagaagagggacttgaacaaatggtcattatggtagggcagtctgaag

SEQ ID NO: 58428 - DNA, 3335 bp, Oryza sativa
catattatttatttgctatttagagtacattggttttagattattaccgtgtaagttattgcaatatatttaccgtaatccttgcttccaattatgcataatttcaattttttgttttcatgactcaaaaactgtaccaaatccagatcattcaatcttgtactctaagagaaaaagaccattccatcgttaatacgctactaacaagtcatgcatttggtcatacatatgttaaatttcattagacaactaccagatgcaattacattctcctattatatcctcaccacagttcactggcaagcacatagttgtgcctgtggggtggcgtgctctgaagtgcgcctataaagttagcaagagccgacagctctgcttgcggtgataatctccgtttggtagcgaacaattttgtacgacctcccgcagacccactgcttgccgtagccagcacgacggcaacgtctcaactgcatttcctagtaattcatcacttgtactggccatgtcttcctggtgtttgtttacagtctgtcagtggcagtcagatgaacctgccatttggtgttctgtgtgtcgttacggctttacgcgatctgggtggatttggtggtagttggaagtataacggactgaatatcttgacatgtcagcctgtttattcagtaattctagaaccgtgggagtcagtgcagcattgatggaatttctatcccgcaacttgaggcacttggccatgtgtggtactagcataatcagtactacatcttgagcacttgaatatctttatattgtggcctgtgggagtctgggagatctatacaacatagttacacagtagtgccaacatacactgatattatcctattactgtattgcttaactgggctcgtgtcattctgacctgacgcttcgcgtcacagcctgtgaacaaatatgttttgccgtctcatggtcatgggcgataggtcatataatgatataaagctgtgcaatgtgccaaacttgtgtgatggcacgggctggcggcgtaagcggcagccgacaccgtcagccaggttgccccaaatcgtcgcggcccgcccgtgctcggggcagtggctatcgcgacgccgcggccgcgcgggcgatcaggcgccgtgccgcgcgagatgccaaccgcgaagcgcgtcgcgcgcgtcgcatgcggctggggcgaaatcatagccaacaacgacactcccagcaatggtacggcacaatcatggagcatcaactggtgcgtccaaggatctcaccccatgatgaccccgccgcagcagctgggtatcgcgtgttgtgggctcgagtacctcgtatacggtctctagtctcagttaattgttgccacctacgtacggccctataggccattactgccctcaacaacgcgcgacgtcatcatgtttattgctacgcataatcgttgaaatcaaccatgttgccgcgctgttccgcccgtgcgtgccggcggaggtcaggtcgatcgagctcgcgagctagccgaccggggttggtagttggctggtccttttggcccatccggtcggcgtgataattaggtatttggatgtgtattaaatcacgatgcgatgcccttatccgtctcttccctgttgcctccggatctttggactttggaattggaaaagagctaagggagatgtcatgcttttgttgatgctcctaactaccgaagcttcggtgtttcttttcttttggcatcgtcgcaagtgatggtgactcgacttaacactcatcatcctgctgattgatgccttactttaccgttaacacgtcgatgcgttcgacgaggtgcacgcgccaccgaacgcccgcactatcacggcggatggcaatggctgtacttccatactaatcatattgttctccccgtattcttgtgctaaaaaaaaccggctgtagtaagtatccttaccaacctagctcaaaactgtctgtctgtctgtctgtctgttgtagtggagcatttgctccgttcatcttgccctcccattccgtcgtcgtcgatgttaccgtgaatactttttatgtagtagggggcaagattggaacggggaatcttctaaatcacgtcattaccataactatgtaggctcacataggcatgctagacagcacggcactggtcctcattgcctcagggcaagtataatagtaggttataagccggctaaatgctgagttggaagaagaagcgggctgtaaattaacagccggcttgaacacaggaactaagaaactttgtgagagagacaagtgggtcctgtattaattgtgaagagctaactattatatggataggatgagaaaaggctataaagaaccttatagtcagcaggtcggctgtattattagccttgctctcactggctccaaagcgaagccaatttctaatcttcttttaagcgcgcggattaggatgctttaaaccttaaccagtaacacgatgcaggggtcccaccacccgacaccagctttcactgacaggcggtcccagaggcagcgcatgtagtagtactattactactccggaaaaagagtcctggcagccgttggaaacgttcgttaccaaccgtaaaattttgcatgtgtcactgacagcttgtccccgaagtattctggccccaccagccggcgtcaggggctcatcggatgtcggtgttggattccttttcctgtgggcccccgcgctgcactgttcctctgtctgtcagtcacttgcgctgtgtgcttctgctcgggctcaaagtcgtcagctttttctgtgtcttcccctcgccgtctcgcgcctgagccctgaactagacagaccaagcctctgtctaccaatggaggcctgagtcttagaggccggatttggtcgttggagagagagagagagagagagagagagcgagccgagcctgtgcggtgcggcgacgcctgctcctcttcgctcgcgcgcggcattccggtcgtgtttctgaggtgattttcctcgttagatttttggcgtagtgtttggtgccttgttgatggcttcgtgtggaatggtgtagtttggtcgtcagattcgtgtctgctcatacttggccccgttctgctcggcttctggtggttctctaagttttcttcgttgtcctcggcctctggtggtttcttgtgctggttgtttgctcgggcagtcgggcctgtgtgattttctgccgctgcattcgcatcaccttctcccagtctgtgccctgtgctagtgtgctactctctctactgagctctctcgcctttccgcgttcgacattctcttccagctttgt

SEQ ID NO: 58429 - DNA, 824 bp, Oryza sativa
agcatcccagctgacgagtaggacactgttgacgctgcgacttgccgacaggactaaacccgacgatgagccccacaatgccaatggtaacgaccacctcaagaaccacaaggacaaaatctacgggaatgactcagacaaatgaaaaaaatccgacaagacctactgctactactacgtctcgtcagggttatttccgtagttttgcccttatggttcaggccaaaaatcaattatataattattttgacctacccagataggtcaaacacatctcgtctcaataattaaataattgatcggacctgttaaagccgaaaatacttttatcacgagctacaattaattttcaacgataaattctatgcactaaaaatatttaattttaaattattgttgtgttcaactagtcgtaaacatatagtgtatattaaagtaggaggaaaaaaaggaaacatgaactgagaaacggggttattcttggagttggagggattctttatgttcttgggaaacggggacaacccctattttatttttagaggttttaaaatagggattgttggttgttgctaaatatgttctaaaagggactctcattgtaatgaagtattgatagggactctaatcaggcctcctataaatcgttattgatttgtcaaaatatctctggaaaagaattgctactacctgacaaaatattgttggtggtcaccatcgtccacatcgttgcatcttctgttgcacacaggtttgtagcaccaacattactatgctaccagcatgcttgcatagtttttgagccctgcaaaactggggggatc

SEQ ID NO: 58430 - DNA, 4509 bp, Oryza sativa
tattttttttaatatagacacacaactcactatagaagtcgttattaagatttaaattttaaaacttgattttaagattaattttttacgccttttaacgtagttttatttttcaacattaaatattaaatatattttttttcgtaaataaggtgctaagacttatatttacttctatatggggactagactataccagacgcacggtaaaatatcatctaaaaatctaaaatactggcagttaggaatccaggactcacccttctcctagtagtactgccgtacatctcctgaaagctaaatgataccagctggacagcgatagaggggaagagattctcgtagattctcaaaatcgcacgtctgtagtgttgaggcgccctgctttcccaagctgccaatttgctatccgagaaccatgcgcgtgcggttaatggcaggaccgtttaagggtttagggaacccatcactaaccaaccaagccaggaggatgtcattgtccgtcctcacaatcgactcccacccgaccacactatttatcatggcaaaggtttaaagtgaggtcttctattttttttttcatcttctcatttacatctatttagtttgaaaattaggataggattttgttttgttcttgttgtttaatttacatcgtaattttaggtgttaatcatgttagtaatgattatttgtatcgccttagatcatatatattttataaaaaaatatgtattataagtaaaaatatatttactcttaagagtatatgttacgaaattcgccaatcactctctgaaacatagccggtctggttgatggccccctcgaccactcatttgcccaactgttgtggtcagttggtatcgttgattgtgtgtgtgtttacttcaaaggcccactacggacgcagacacacggatagttttctccaggtgagaccatgacaagaggaaattgcatgacaaaccgacgggttgatgatttccaatctgaacggcccgaacaacgtaaaggccttgagcagcgcacttagctcgaccagcctcctcgacttctctctcctgagcagcgccggtaatggtggcggccgtcggtgtgcaccaacgacccaatccatggccggacattgtagcgcatggggttacacgtagagaggaggcgcttggctaccttgacgaacgaggagcgtcaaggttggcagcaggcacgatagggagcgtcagcacgaaccgcatgatgaagatgaggatttgcgatagtggccatggtgggtggatctggtaggagatcctgcacatgggcgccaccaggtgtcgggccactccttcgggggtatgcggaggtgattaaggaggcatatggccctgcacatggacttctcgaataggaagcacgggaacctattgtgctcctccagccgcctaacggaacggaagaaggcgagccggtcaaggatgggggaatcgagttgggggacaaacacggaggtcatgggagccttgaagaagatgggggtgaatgggttgtcttgttagccaccgcccttctccttgccgcccaccacacgcggtccttatcctttattggttgtcccctgggaaaagatgggtaagaaaggtacaaagggcgggaagaaagacttggctactgacatgtagggcccgtctgtaggatcgaatcacaagaactaagccaaccagaggggggtgaatggttggtatacccaaaaaccgaaaacttttagcggaaataaaagttactctcgaaatcgatggaaatcggtctgaccgaagttgccttgccggtctgaccgctcagatgccgccggtctgaccggtatggtatagatcaaccggtctgaccgccgaagtcgttcgtcgtgcctgtcgcggccgccggtcggaccgcccaaatgctgccggtctgactgccgcttgccgccggtctgaccgccggtagatcactgggtagactaccgaaacccgataaacacaaatcgaagaactcttaaagtagatgacgactttattgattctctctgtgtttacaaagtgcaccaacagcactccttacaaaaatttcgactaaactcgaaaccctaactcaaaactcaactcaattgctctctaaagcgataccgggaagcctcacgctccccctctatttatacatgaggtaggcagcataaagccacaaaccaaactcatattaagagtcctaaacaccttaggaaaccttctagtacaagaaagaaactttacataaccaatcgtaccaaatttgaactccttccaaattcgactccgcatcccatacgcacacaatacctccatcgtatgccatatggaatctccatcaaccacgtgcatcaactctagccttagtatcccgcatgatctttgaccaccacgaacgttgtcttatccccaagctgactcccggtccatcaccgcaaatactctcccaagacatcgagtcacctacacatgaaataaacaaaaaaccatattccgagaccaagttatctccaacttgactcattaatagcaaacaacagtattacatacatatagtatccatctagaagccataatcataaaataatcacggatatctaaacaaacaacccgaaacagaaaccgacacagcgtcggccggtcagaccgcgggctagccggtctgaccgctcgatcaccgccggtctgaccggcaacacctgcccggtctgaccagtcacatgaaataacaacaatatcctatagattcacctgtgaaatccaatcatctccaaaaccacttcgtgaataaatttcaaataacaaaactaattatctccaatgccaattgttcatcacagaataataatcaaaaacacctttgattttacaatctcccccttgatgaacacattggcaaactcataaaaaatgttttggtgtttggaaaaataaaacgaaagtggtaaaaagcacaattcgtacaaatgtacacatcgtgctcaaaaatcgtgctcaaaaatccaaaagaaaacttctcaccctttttaaaagaaagaaattccctattgaaccaaaaacatgctcttctcaacaactctccaaaaattcaccttgcttctccaaaaatccaaaaatttcacattacttctcccccttttgacaatgatgtcatcaagcataggaattatgttcattaatggtcaagagcttagcatatatatagcatatcaagtcatgtgttgcaataaaaagaagataaacccatctagtataaccatgaaccaaagattttacaattaagcttgaatcaacaatcgaaattcatgatttcatacgatttataatgcaacatcttaacaagcatatatgtttgaagaataaacactaaacatatatacctattgcatttatcactgctttctcaaataacctttatcacaaaataaccaatagaattttttaactttttcttttctagagcctttttgctcatattttttttcttttattccgggtacgtccctgtcgtcaagactgtttccagggattcggcacccattattttgctcacatcgaatacgtccttgtcgtcaagactgtttccaaggattcggtattcattttttttcatattttttattctctttttcacaatgagcaattaaagctatttgaggaataacaagtcaataaagcatatatatatatagagcatttataaatcaaaccatatgctagcatcaacattgcatattttcttaattcaagtagaatttaagtgtcatgcatcatctcccttaaaagcaaaatctaaatcttatgaaaagactagaatacatacaagctatgctagagacaaataaaccttcaaagtattgctagcatgcacaagaaaataccatatgtataaccaaagctctcttttatcaattttttcattgtcatattattgcttgataaaaccatgaggtacaaactccccctcaaaccatgccaaaaggatgaattattcccaattcaccatgaagaaaagcaaaacgattagaatccaaagatttagtgaaaatatcagcaatttgcaactttgtgtccaaaaactacaattcaacatctcccttctcaacatgatccctcaaaaagtgaaaacgaatatcaatgtgctttgtgcgtgagtgttgaacaggattcttagcaatattgatagcactagtattatcacaaaatagaggtactttctcaaaagtaagaccataatcttttaaaatagataaaagccaaagaatctgtgaacaacaactagcagcagcaacatattcagattcagcagttgattgagcaacactaaattgtttcctagaagaccttgcaatcaacgatgtaccaagaaaatgacatgttccactagtactttttctatcaattctacaaccaccgaaatcagcatcggaatatccacttaagcatatagaagatgaagtagaataccaaattccaaactcaagtgtat

SEQ ID NO: 58431 - DNA, 1544 bp, Oryza sativa
gtagtaacatttttcctcgttgtttacacgattaatcacctcataactcatgaaggtgtaagaggtattgtaagaggtattgtgtaagaggaaagaattggtcctcataactcacgattaatcacctcattactactatttaataagaggtattgtaagaattgaggttgtgtatgaggaaatctctaagttgcgatgagcgatgcgtgctaacaaaaaaaaatattgtttaactttgtaggtgtgaccgaattctttcctttggcaagggaatgaggctgcaggcctacaggacagttgatatcaggctatccgatcaccgccctgtgacagctgtgtacacttccgatgttgaggttttctgtcccaaaaagttgcagagagctcttaccttcaccgatgcagaggttgaggaccaattctcatttgaggaagagagcacttctggaatctttagcttttgactaggatgagcaccaagtacatcggggaatttatgtaatgaattgcgatgcttttctgaagtctccgaggaattattgttctcacatttcatccgctatttccagtatccatcctactcgcaattagcatcggccatcatgtacattccttccacactctgtatttggagaccagggcgtggcatgtttttttttttttagctttactcttgtgtgcctcttctgactatgaggagtttgtacgcaataatggcctccgtgacgatctgattttgtaattaaacatttgaatactgtagattcctaggcagaccgattgtgcagttcagttggggtttgacctatactcctatgtgcagttttgaatctattgctaccagtaaggaagcaaaccagtgtacattaattagtactctctccgtctcctaatataagggatctttgatattttgcttgtactgtttgaccattcgtcttatttaaaaaatattagaattattatttattttttttgacttactttattatccaaaataccttaagcacaacttttcatttttatatttgcacaattttttaagtgatcaaacagtgcaagtaaaatattaaaatctatgtgcagtttagttcagttattaggattgcttgaccctgatatatggacatactcccttcgtccagagaaaaacgaatctaaaactaaaactgaacacatattctagtacaataaatctggacagaggtatgtccagattcgtagtactaggatgtgctacatttagcattaggttaattttttatgggacggagggagtacggtgtagtttttgcttcagaaggctgcaagttttgtgaacttacatgtgctgactgctgagtgtgaagctgcgtagtagctccgatggcacactgcagcctggacctggacaagggcgatcagtcaacctcccccgttggatggaggagagcgagctggactctgtctttgatgacttgacctcctcgatgacttgatgtgcctgccctgtgccaccacggcaccacgctatctgcgattctgcgcccagaaatagggcaaga

SEQ ID NO: 58432 - DNA, 753 bp, Oryza sativa
aattttgggagatcggctagttttttgtgctccatatccaattcagcattgcattcttcaagctgtgccaagagaatattggatttgatcttgcgggcttcaagccgatcgatattggatttgatcggaccttcggatagttgatcgagtttgactttttcttcatgcacaagctgccgattgacttggattgtggcttcaatctccttgcgctcacggcgttcggctaatcttagcttggctttttctagtttaaattgatgttgctcaagataagtggctagagttaggacatcggccagttcttcaggaattagagcttgaacttcgtgcaatcgtgtcctaatcgatccatagtcgaccactaagctatccagagaagaggcctctagccgacgcgagatatcttccagtgttttctttgcatcatcagataagggagctagagctttgcttgaagtatctttttctgcctcatcaagataatctttgatatcaaaagaaaagagatcggctagaacttgcaggtataagttcagaaagtttgagagctaagtcaatatagtcgatctaaattcttgcattaaaggaaagcttactgggatagcaggagcagccggttgttcttcttccacaatatgatgactccccacggccgatggagttcagtcactcaatgattgttgtacaggagaagaaggaggaggaggaggctgtaaaaagacaagtgttagacaaaatcggctgaaatca

SEQ ID NO: 58433 - DNA, 5178 bp, Oryza sativa
tcagtcataatataagattgcatcctactacaccaatgagaaaaatccgttccgtcgaaaacatgaggcttagttgaaaacctagcaggagtagccatggcaaaaactttagatcgataaaaatccaaagaagaaaacaagtctctgataccacttgtaggatcgaatcaccagaactaagccaaccagagggggtgaatggttggtatacccaaaaaccgaaaacttttagcggaaataaaagttaccctctaaatcgacggagatcggtctgaccgcagttgccttgccggtctgaccgctcagatgccgccggtctgaccggtatagatcaaccggtctgaccgccaaagtcgttcgccgtgcctatcgccgccgtcggtcggaccgcccgaatgccgccggtctgaccgccggtagatcgccggttagaccgccgaaacccggtaaacacaaatcgaagaactcttaaagtagatgacgactttattgattctctctgtgtttacaaagtgcaccaacagcactccttacaaaaatttcgactaaacttgaaaccctaactcaaaactcaactcaattgctctctaaagcgataccgggaagcctcacgctccccctctatttatacatgaggtaggcagcctaaagccacgaaccaaactcatattaggagtcctaaacaccttaggaaaccctctagtacaagaaagaaactttacataaccaatcataccaaatttggactctttccaaattcgactccgcatcccacacgcacacaatacctccattgtatgccatatggaatctccatcaaccaagtacatcaactctagaattagtatcccgcatgatctctgaccaccacggacatcgtcttatccccaagccgactcccggtccatcaccgcaaatactgtcccaagacatcgagtcacctacacatgaaataaacaaagaaaccatattctgagaccaagctatctccaacttgactcattagtagcaaacaacagtattacatacgtatagtattcatctagaagccataatcatgaaataatcacggatatccaaacaaacaacccgaaactgaaaccgacacagcgtcggccggtcaaaccgtgtcacagcctgattttcgttttaggatttataaattatttaataaattattaatagaatttatattaaatgttctttaatttacaagtgaagttaaatgtgggaaataaaatttcctaaatttaaagcatggcaggatttaatttttattaaattctccatgattaattatactctctgaaattttctcggttttttcagagctcaattcctaaatgatacaaagaacagttcaataattagttaatcaataatcattaatgatctagttataattatgttaagtgcttttctcatttaaaaatccttaaattataaattgttgtttaaaaggaattattagaaataatcttaaaagcctaaaagagaagatctaattttaatttgttaaatctcaatataaaagtgggctagataaaattttgttaaatacttctcttgtttctatagttcctagatttttctgggatttatttgagccaaggaagtatttttaataaatggaattgcatttcatgaataatttaaattgaaaaatgttttaaaattctccttttagctttgggccaaaagtcagcccaagtctctctctctccctctcctcggcctgcttgcgccggcccgttcggcccagtctgccacgccctccctcctctctctctctcggtgccgctgacaggtgggacccacatgtcagtcgtcttcttcctccagccgctcctagccgcgcaagccgccgccgatctccttccaaattcgcccgcccctttcctcctccggctgaattgtttgaggggaaatgatcctcgagatctcctcttccttttctcttttggaaacatcggctaatttcgtttggaaatcatcggattcgatctcgaatcggattcgtctctctcccccgaaccctaaactttccatcccgtcgccagcctccgtgggcctccgtcgccgcctcctagcccctataaaaggatccccgggacctcctctctccgtcgccaccctcgccttagctcgtcgccgctcgtagcgccctagccgcgagagctcttgtgccgccgtcgccgccgcttgtccagccgtgcgccaccgccgctccggtcgtcgtcgtcgctcgggaaggtcaccgccgggttcgcgaagtcgtcgccgtcctcgtcccgtcctccgttgctgccgaggatcgccggagcaccgccgtcgtcgtcgacccgatcgtcaccgccgcttcaacctcgtcgccgtcgccgtccggttgccgtccgccgccgtctaagccctcggtgagttcgcgcgtcgcccgctacgcgttggttccctccgtttgcgccaccgcgccgtcgttcgccggcgagcatgcgaggccgagtcatcgccggtgatgacgtcatcgccgacgtcatcgtcgatgtccccgtagacccgcgatagatcaagatgatctcggccgttcgttttgaatcgattagatcccggtcgttcgtttccgtaaaccgccgccatgcacccggtccaccatgagccgagcccgctgatgcaataattcccttttccttttcaaaaataattctttattgtgtcataattcaattaaaatctatataaatgttttaatccggtttaatctttaaaaattcataactaattcatcttagctcggatttagttggttcaagtttctaaagttgtataaaataaagatctacatattaaaattatccataaattgaattaaatttatttagttctttttaaatgggctttaattagattaaatcttgtaaaattcataattaattcatatgaagtcagaatggggccgttcaagtctcataattcatctaaaattatgatttacgtgtttgtttactttttatgtattgtttgtttggagtttcttagtctttttccttgttttgcgttttagcttgtcgtttccgtcgtttcgaaggttcgcgagtgcgccggaagtattcaagaagattaattgaagacccgttattgcaaggcaagtcacacagatcgcaaacacaattcctttgagcatgttgatcctacatttaaattctctatttatttcaattgtgcatttattttcgaatgtcactaggtggtgtgaacttattcctttgttatggcctgtttgcattgattactctattccttgataccttgggttattataatttgactagttgagctttatatattggttcagctagatgttagacataattgcttagccatgcttagaaacattagcacacaattaggataactaatgtttcactgttacttaatgatggacatgataatggtagctcacgatggctaatcgtgattggttaattaattaatgtgccaactaaaacttgataatggtgggttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtagctggggagtccatgcctctggttttttagggggtgactacgatccaggaacggtgcactgctttgggttgagttatgcgaagggtcttgtcacaatcattcgtcatggtgacatgtctgcgcagacacggtgacatgacggtgggttgtgtcttgtgagtacagtggtacacctctggccagagtaaaactattcgaatagccgtgcccgcggttatgggcgggtcgaacaatgtctttcgtgattagtcacacgctactcattaataataatgtggtaattgatggtaattaatttagctcctggtttggaatggtatattcctggtttggagatagatctgtgcagccgggtatggttgttcaggatggttgggcctgtgcagcatgggtgtgctgttcagtgttgattaatattgatgattaattactctactgttttacaattctcaattatttgctaaatgctgcttttgcaaatgagccctatattatgccattctttggtatccttgtgcacttgcatatttgctgtgcagcttgctgagtatgtcatatgctcaccttgcaataatcaatcaaacctcagttgaagacaagttgcgaaggagaagacgtttggtttataccccagttgagctgcttgtgggagtggagccggagcttcgctagattttattttccgctgcagttttcttcatggtaaggactaagtgcctcttaagtaagtatttatcgttttagttaatttgatgaatctgtatattaaattatcagtttgtgtatctcggctgattcctggacgatgatttaatgcacaaataagttctgtaattactagtgaatttctgggcgtgacaaaccgcgggctagccggtctgaccgacaatacctgcccggtctgaccggtcgcatgaaataacagcagtatctgcagattcacctgtgaaatccaatcatctccaaaaccacttcgtgaataaattccaaataacaaaactaataatctccaatgacaaatgttcatcacagaataataatcaaaaacacctttgattttgcaccatctaggtctcatgctaactcaaccgactctattaccgtcaactcgcaatatcagtcaaaaccaggcataatattgttaaggtctcaagtaatccggtttcgtaaattaagaaatctgatattacggttcaaatgacgtgatctaaactcgatattactgtgaggacctgaagtgaacatttctatgtttaatgtagccttagatttcaggatatagacgcaactacaacggtggcgttgcgctcgggccagcccatgcgaatcgcatccaacacggcgagaacgggctgtttgaatccaatagcgccaaatcgcatccaaagttaggagtaaagcgtgtgcattccttactgccggtcaccctgttttctcttactctgtttgtagttcgctgtaaagaacacttcaaatca

SEQ ID NO: 58434 - DNA, 5591 bp, Oryza sativa
  unsure (1)..(5591): unsure at all n locations
gccggtgaagaagacgatggagccatcaccgtcggatgcagcgcgaggcgggaggttggcgaggacacggagccacgcctcgtgcgccccatccatcggccaccagcgacccggggatggagcgggcccaccaaatccggggacggcgacgatctgcgtctcgcccacgctgctcgccatcggtcaccagcggagggagggcggtggcagtgcgctgggacagagacgacgggcggagggagagagatgtgggcggaggaagagagaggcgaggcagcgacacaagggtaggataggaaaatattacaaacggctttgtgggttgggacacacattgtgggctgtagcatcttcatataccctcagttttttaagggtccaactgagagtattctttattgaaaggtgagtgtagtcatatgtagtggcttcagtcaacgaggacactactagtgtggcttggattgtagatgtccctatgacgtttaggcttcgtgttccgatggatgtgcagcgattacgcgtcctgtgatccccaaatgatcgcgcatctcgctgtcactaccggtctaccactccaagtgaaataataatggtcacttggctgtaaattggagtgcgaatgttgttggcttgttgcagggaaagccgtcaacataggccgggaatgcctcttccctttgctgctgcttcacaccttttgcaaaggtgagtgtttaacagaaaaggaaaagaaaagattaagaaatacataaattaacataagtcattagcttatgattaattatatattaattactttaaatttaaaaacatattaatatgatttttcaaaattattttttcatagtaattttttaagaaaaatatattgtttaatagcttggaaaacatatacgtaaataacgaatactcgaggtgccatggtggatgtatgtcgaagatgtgcagccatgaccacgacgccatgaggcccatgatgcatcgagccatcgacgcatcaacaaatatgaaacatcaatcaactggcaaaaaaaaaaaagtgctcagcaactagtgctaatgctatacagactacattagacccgttcactttgatgccattttcaacaatactattgtttaagttaccaaaaaaaaatatctacgtttagtttgtcgtcaaatttaggtcaatacataagaaatcctgctaaaaatttttagcaatatcgctattttaccaaaactttgacattaacaaaatttgataagatttattttggctacaatctaaacaggcctagtatgtttccttcagcaattcaatctgctcatcattccgcgaggcgcgaccgcgcgagcccatatattccgaacgctcagcgaatcagaatactactgtttgccgctgatcgcgtgctgctccgtttctgttttctttttgccgcgaaatgggaccgaccgaaaggtgttcttctagggagggcatagtttcgggaccaaccaattaccaaccgtctcagattctcgctagtcgctcggacaaaaaaaaatatcatatcagctcgaaccgctaaaaagcagaggtccgagacgacggaattcggtgtgggggagggacggcgacatggttggcacagagacagtcaaccgatcgcctatgcagctacgctatatagtacagatcgctagtactacagcattccatggtgaccgatcgaggaattggatctcttctctctcttttttatttccagcggatggtgcaggacatttcgccaaaaaagggctcgcgtttttcagagaccggtagaggccaagttgagcccaagaagaaggcgaggagcacaattcgtaggcattagtacttctatgtcaaaagaaaaaaaaaactaaacatgagaatgtttttggataacatacatatatacagatactccctccgttccaaaatataataacttttagcactaatgaattgtcctaaagtataacaacttcttcaccaaccaatcacaaccctccaccattcactttttttatctacttacacttctcaaccaattacatatttaattctatcacttttcttaataaccatgtccaactctaaaactctcactgctggagaatgcaactacactcccggtttgtaatccccttcaatcacgggtatacaaccgggatctcgaatccggaactaaagatggtaacgccacgtggccggtgctaccatctttagtcccagttggtgttaccaccgagactaaagttattttttcttttttttcattgttttttgctatttgcatattgatttctaacaaaactcaacaataaaatcatccacattcatagaaacatcacaaaattatccacaaattcaccgatcaaactgacatcacaaattcacaattcacgtcgcagatttacagatccaaaaacatcacaaattacaaatttacttgtgctaggccactcgctgccgctgcccccgtgcgggccgccgccttcgccccgcgctagggcgccgatgcccctgcgctggccgtcgtcaccctcgcgtgggccgctgccgctgcctccgcccgcgccacgccaggccatcgcctcgctactgcttctgcaagtaaagaggagaggataagagcaagaaaagaggagaggataagagagaggaggaagttaaaagatgaggataaagactttgcgatagaagatttgaggataagtgcgagggattatatacgacgggttgaattttagtctcggttattaataccaaccgagactaaaaatagtacaggggggtcgccanncgcttatttggacccccgggcacacaaggtgggcgattcgggttttttcaaaccgagaaaaaaaaagatttttggtcaacccaataaagatgtttctctagtagtatctctatattctaggacggaggaagtacatcttttcaattaaacttattttggaatggaagaaatacttcattatattctatactactccaggaaatacttcattatggagtacatttcacttgaaaaaatatatacctgttcatggaacaccaggttgtgtacagagaaggctatttatcgaggggaagattcggtgcgttgcactcgatcgaggacggtgcctgcttggaatcgtagtacaactctagtagtagtactagtaagctgcaccggtcacactcacacctagtacaccgctacattacgtgcgtatgggagtgtggccacccacatccacctgtcatctgcatcgccccttggaattgttgataccaatccatccaccgctcgcctcacctgttcgtcacgacctcacgcctgactctttaacctggaaccgcccgtctgacgagctcaccgtctttgtagttgcagacaaaagtctacgtgacgcacacccttatacggtcatacagtgatacgtactgtacgcattggtgcaacgcaaacagggtggttcagacttcggagcatgatgggtcactcggcccttgtttttatttcccaactttttttttcaaacttctaactttttttatcacatcaaaatttttcaacacatatactttcaacctttttaaatagactttcaattttaatcaaacttttaattttagcataaaactaaacacaccctctgacttttaacttgagattttgagaactcgaacgcattagcaggtactgtacttgatatagcaatgtactactccagcatgctgactcggcgccgacaccggcgacgtgtgacacgtcttgatggacagtatagcgaccgggagtcttgatctttttctggaacaagtggctctcagcatgtaggctctactgcggccgtgtttacttccatggatataaatttttaaagtatacggacacaaatttaaagtattaaacacagactaataacaaaacaaatttcaggttatgtctgtaaactgcgagacaaatttattaagcctaattaatctgttattaacaaatgtttactgtagcacaacattgttaaattatggtgcaattagactcaagagattcatctcgcaatttacacacgagctctatgtatatgtctaaatatttgatgtgatgtttttgttaaaattttttaattaaacaaggcctacttctaaaatagttactgttgaaaggaccttgcttctgtgctgtgcagtgtgcagtttctggggaacttttcaggaaagcgatggcgtatgtagctgttgccttccctaaaaaaacgaagattcctacatcgtttataagggcaataacaatatatataataaaagtagtatataaaacccacttatatgaactttaactattaaaacattcataatatatatggatagcaaatagtattggaaagagagaaaagatagagacaaataatatattttattctctatgggcaacccatatgcttatgggtagcttttgctatggactagttccacaatgttgttaggtggctgaaacaaatattttattacttatggaccacttttagactacatcgtggatgccctaattaagtaaaattagcaggtacctcgtaaattaacttctaggttacctattgatttatatataaatcggttaatgggtcgacccacctacatctctaaatacatgggttatctttatttaatctataagcgggctcgtgggttgacccgctagcatccctagttccagataaattaatcgttcatctcgctggttgtctcaatgtctttgggcccgactatgtgagtggcccttgtacgggtagctgtcttttccctagctattgtcactagcaagtgggctcgtagctttacccattctaccataggtgtacatgcccttactcaaatccatgggcttgtttggatttatgctaatttttgttcttctaaattgttggtaactttaatactagtattataaggatgtttgtttgatgctaaattttatccacactagtacaaatgatactataacaaattttataacaaatttggtagtttcaaaacttatcaggattttggtactaccaatatgttggtagggtgaaaattgtcatcaaaataaattagccccaaatttctctatctccatggatcacatgggaggaagatggtagtgtgaatcaagagcaaacaaaaaggatcatgctctataggttctttattaatctatcgtatgtactgccggtgaccccatgacctatcccaaaacatataaatatattctcgtccccacgtaaaagaacatttgcatatccagcgttacggtgtaaggtcatattgctcttttttgagaggaaaatagctttccattaacttaaggactcagcataatcgttggccaccaaattctccatgcccgaagacgtaccatcccattgcaattgcatgacgttattatgaggacactcacaagttacaacctaaaatttctaaagcgtgagctactttattccattctcggggagctaaaggtcatattgtttggtgcgtaacatcccctcgcatagacaatgggagatgatttgcttctggaattaactaatcacagcttcacaagaaccaaaca

SEQ ID NO: 58435 - DNA, 2853 bp, Oryza sativa
acgcagatcgcaggccgtgtgccggcgtgctcctatgtgagagcaagtttaataataatatagctaactactagctccaattcatttataatcaatttagcagctcattcatataatagttatatactacactattaatacatggtcccacctgttatacacacaatacgtcttagagtctatgctaaaggtggctacaaatctgtagcccgctgtttttctctctccttatttatttttttaaaatatatttacagctggcttatagcctactattactgtaactgctctgaagataatcaaatccccaaccgcccgcaccacgcgtgtgagccgcgcggtagacggcggccagcgcggacgcgagtcgccgctgccacctccacacgggatccgccgtggccggccgcgggccgtacaggtggcgctcgctgataggtgcagtgcgatgggtcggttgttgccttttcatggaatagaccctggcttctgaaagaatggagcgtgtgccccttggctcggccagcctggaatatatggattttttttcattagctggtttattattttgtaacgtggggtactcgactctgctatatggatcgatattatggtttttgtccaaaaatgttatgggtaaggacaactagtttggtttctaattttgatccctggtcactttagtccttattgctcactttaaattgataatatttatcgttttgtataaggatatagtctgaaaaaaattaaaacgacttataatatgaaatagagagaataagtgcaatagctagcctggttgtagggacgggagggcagatgaggagcctggttgtagtactaattgtgaggagttgacaatagacatgtggtttggtttgtgagtgacttaaactcgtgaaggtaacaattccatccaatgttattccggtcaccttacttgtttgaaatgataagtcggtggaaaataaagggaagatgaaattgtatagcaaagatgctatatgtcaaaatggagtaaactttgtgaaaaataaggacaaccaaggagaagcttggttatcaaatataattataagaaattgtgagcgcattaaaaaattaaacacaagatcttaagattaaagtcacacacctcttgcaactatactatggatgtgttcgctagttccggttaggaacccatgtcccacacacagaaaacggagcggcccattagagcgtgattaattaagtattagcaaaaaatattcaaaaatagattaatttgattttttaaaacaactttcatatagaatttttttggaaaaaaacaagagaggggagttggaaacctggggaaagaacacaacctatatagtgcatctctttagactctattaaggtaaatcaacaacttccgtcaaaaattaactagttactttgtttaattgatataattctatttacagctatatattaagagtactcggcagttgaaatttaatgaagtttagtcttatattttaaaatgtatttgtataccgtatagtcagaaatatttttaaccgatcaatagtagaaatttagtcttggaaaccttatgaaatagggtgaaaacggtctgattcggtagcactttttcggaaacgatgctcgatcggctggtaattgaccatatttatcatttaaactactcaatatcgacattaatacgatgtataaagaaattagaaaaaacaaaatataaaaatagacaaaaaggtaccccttaaacggaacggcgtccggtcgatcgggaatttctgtgacagttttcaccccttgaaatatgtataccgtatatcgtaaaccgtacaagaaaaaaagaagttgctgacgacccagtgactttgtaacctgtgagacttccaagctaagcaacaaaaatacgctaggtcaacagttgtttgacaagggaggccctggtatagaacgtagataaaacttggagggggcatctacaaaatcccggcgcagcggactctatttatacgcggccccgctccttgatccccgagggtgaatcgtagcgatagcggatcagattggaggaaaactcgctagtacgcttgttacttgcaactctttctctaatcttgcttcggaaagatatccaaatcgaagaaaaagaaaaaaaaattagaaagcgtgattagccattcctcttctcatctctagccacttcgcttcagcttttcttctttcttgatcgcgagcaaaaagggagagagaaaaaaaaacggtaaaaggacgtgattagcaaggatggtggcgatcgagaaccagagccagggccagcgggcggcggaggcggcggcgcagccacggatccccagggaggcgcggcggctactgcacgagatggcggcgtcgtgggcggacgttgccgactgccgggcgctgcaggtgattccgctcaagggcgccatgaccaacgaggtgtaccaggtgcgctggctcaacggcgccccggccaccgccgacggcggcgaggtggaggcggaggcggccgcaagggagagggaggtgaggaaggtcctcgtgcggatatacggcgacggcgtggagctcttcttcgaccgcgaggacgaggtgcgcaccttcgagtgcatgtctcgccatggccaaggcccccgcctcctcggccggttcaccaacggccgcgtcgaggagttcatccacgcaagggtaggtgcacatgaatatgatatgattccgcgctgctgtagccaaactgtctagccttcctcgcgccacggattgtgttttctcctcccgttttttccctttagttttcctctgtttatcttcgactctcttgaactatta

SEQ ID NO: 58436 - DNA, 7023 bp, Oryza sativa
tgtgttgttttcttggacgaacaaaaggaaaaaaagaacgaaatttcgtgcaatactcctactatcagatttttctcctcaagttttctggtgataatgaaatgttatcacgatggaataactgtccaacctgttacgtcagcaactcaagcatatacaaaaattaatgcaattactttctttcagacactatctgcagcagaccttcgtgatcctgaaatttcagctctggtggcgtcaaaactgagggaattccacaaccttgacatgcctggcccgaaatctgtactcatttgggaccgactgaagtaagagcattttctcagataaatatacacttggcacttttaataagtatataaaactaaacctggccgtgctttttctagaaactggctcaaaactgcaaggaacctgtgctcatctgatgaatccaagaaatttcggctgggtagcctggagaacgagattgctgcattggagaaagaattttcaggggattaccacgggattggtttttgccacaacgatcttcagtatggcaacatcatgattgatgaagacaccaacatgttgactatcatcgtgagtaatattcattcacaataatgtccctgtgatcatatttgttttttgctgcattttttttgcgtgtatctattatgtgcaaatgtgaaatgtagaagaggctattgaacgtaggttgtagaacttttaagtttcttctctcatgtgatcatctgttgaacaacaagcgatatgggatagttggaactgccgtatcattttcactagttggaatagcgccagcccttttccctttcatacaacttgttttttgtttgttgcgttcccttccccctcgacattttaaattgtcacggctctgctaaaaaacaacatagttttggttttggacactacctaccttatggaggactgatgctttgctcctttttttttcccttctgtataccaatttgtcacgactgtttcttaaggaaatctgattcctttttctttacatatatgacaagccccaattaattgttggcaatttgatcctttctgttcttctcatatatatacaggattatgaatatgccagcttcaatccagttgcgtatgacatcgctaatcatttctgcgagatggcagcagactatcattcagagaagccacatagactggactacagtaaatatccaggtacccaaaaatactaccaatgcgctgttttgcttatgttttggtacttaaatcagtttacacaatcttggtccaccttgcttatttgctattctacatgtggcagacactgatgagcagaagcgttttgtgaagacgtacctaagcaattctggtaagtgcaaattcatttctcgtttcattatctgaagatttctttggcactaccatgattatttgactgcaaccattctttttggaggaatatttctgttacaaattcgaattcagcttccattgaatactacttttttcacaataactagctaagatatgctcctaattttgtttagtaagtgaagaacctgatgcggaagaggtggagaaccttctccaaagcattgagaaatacacgctcgccagtcatctagtttggggcctctggggaataatatcggtatgttcatatttctggatgtccattgcctgtttcttttttcaaaagaactatatgaatccattctgtcactgtaaacctgtgctattatctgacctctatcttctgcaggatcatgtcaatgatattgacttcgactacaaggagtatgcaaggcagagattcgagcagtattggcagaagaagcaagcacttttaacttcatgaattgcctgaaggcgtcaggtcgtacctgaaggcctgtgctgcacataacttgtgcgatgttactgacacataactccctgtgaaaagaagaaagatgaagatgataatgaagaagaaaccctttcgggatcaggagttctcatcccgaaatttccgtaaggttcagcttcaggaggaagctgtgggctttggttgctttgtttatagtctgaaaggcagcgaagaaaaagcccctggttgcgtgtttgtttgctcgacaaactagaggccgcttgtggggctagtagtgccgtcgtgtttcatgtgtatgtatacctaaatatatgttacataatggatcttgctttcgtcgactcgagagtcgagacagtgcctccatttagtccatattgtactatgcttacatgactgccctgttgaagaaatagcctatacagctgcactgttattttggttgttgatactacctgataataatatggcgtgtaccaaagctttaacgtggccatgttcagcagttcaggtcatcttcgttgctctctggtgcagacgagctacgaggtatgagctgcctgatgttggtgatacctgacgaaaaatccgtccgaacggctgtgatggatatcagctttcgctgcctcttcctcctgactttgtttcatcggctcatcgccatttcgcctttcgtcaatctctaaccctctctcctttctccttccccacgctgggctgcgaagaggaagatcgatgacgcgtggaattccatgacgcgtcgcttgtgagcccggaacgagatctcaatacccgtttatgacggcccatataagtggaacgggattgccgctaacaagcggcccatatgtgttggctggaacacgacgtgcggcccaagtccggaggtggaatcagatggacgtggtccatgtggagaagggcaaaagttgcccagtccagttttcgctgcccgcaaggctcctggcgaggaataattctagggtgaaaagttttggtatatattatcggataggaaaaagtacgaattaccctcctgaactatcgtggtcgtccgaattaccccctgaaccataaaaccggacatttttcatccctaactatgcaaaccggacgaattaccccctcgacccaatctgcggtggttttagtttacatggcgtacgcgtggcagtacagtcagcattctatttattaaaaaaatgtgggacccatgtgtcatcctcttccactcttcctctctctctcactcttctctctctcactcgctgctcactcttcctctctatctctctctcactggtcgtcagcggccttcctgtccacctgctgctgcgcgccaccgccggccgacgccgccgagtagttgtcgtcgccgttgttcgcggcgaacgacgagtcggtgatgcgaccgcgatgccggctcggcgccgcggggccagggctgtgggagtgggagcgggctggcgtccacagcggcgtcatctcggcggtggccagcgccacggcggcggcgtcgtcgtcgttgaagaggtgccccgtgtaagtaagacgcgacacggtgacagtgcagatgaccgaatctctcagagcagcagagcagagctgcactgtgctgctagctgcttggtgcgtcgagacataggattcctttaggcattgatgatggacggcaggttggcccctgcacggtgcgacgccggcggttttcccggccacaagttcgtacgcctgcctagctttgccagccgcctcgttgggccgtggcggaggaagaagacgtgctagctcgcctacacacgccgtcgtcgtcttctttcctgacaatgggtaggagtagtatgtgcactgctgctctgctagcacgaattcttccaccgccgccgccgccgcccgcctccatccgtccccacgccgaggggcggccgttcgtcgtggccacggccgccgccgccgccgctccgcgtcccccgcctgccgctgaccggcgagaaagagagaggaagagtgtgagaaagagagtgagagagagaggagagagaggggaaaagtgagagaggagtatcacatatgggtctcatattttttttataaataaaatgctgactggactgccacgcgcaaaaccgcttggaattgaattgaggggggtaatttgtccggtattgaaagtttagagtgaacggtgtctggtttttgggtttaggggggaattcagtcgatcgcaatagttcagggggtaatttgtactttttcctatcggatataccgacacatatttaaagtattaagaccctgtttgattcagtttaagattattataatctgaattattaggaataagctgaaacaaacaagtagattgttatgatagattattataatctaataatctcctgtgaaggagcttttctcagattattgggtggctaaaaacccactaccttagatgcctccaataatccagagaaacaaacaactcgcagcttattctatgccagcttattataatccagtttagagtaatctgatttaataatctagattacaataatcttaagctgaaacaaacatggcctaaatatagactaataacaaaacaaattacagattatgcctgtaaactgtgagacgaatttattaagcccaattaatttgtcatcagcaaatgtgtactatagcactatattgtcaaataatagagcaattaggcttaaaagatttgtctcgtaatttacacttaatctgtgtaattagtttttgagtaaatttcacaaaactacaggtgttttgcacaatttatcacaaaactacatatttaagagcttgtttcacaaaactacatatttagtgtctttgtttatcacaaaactacaggtattttctacaatctatcataaaactacatatttaagaatttgtttcacaaaaatatagatttagtgtattcatttatcacagtactacacatttagtgtctttatttatcacaaaactacagatttagtgtctccattctcacaaaactacatgttttagcattgttaaaacgtgtagttttgtgagaatggagacattaaatctgtagttttgtgataaacaaagatattaaacctgtagttttgtgaaactagttcttaaatctatagttttgtgatagattatgcaaagtatctgtagttttatgaaatttactctagtttttttatctatatttaatactctatgcatgtgtccaaacattcgatgtgacagggtgaaaaagttttgcgtggaaactaaacagggccttagaacatcccctaatatggcttcttaaaatttagaaaaactctccaaatttctatttgaccggtttgctaaaactaaagaaagtaaagagtcaaatttatcgtttattccaacaacctctctttttttatataatggaatgaaacattctggcatttgctcaagagatacagccaattattacaaggttcacacaaaagtaaactcatacagtgagtatgtagccaaagtaacaaaaccaaaagtaaaagcaaactaatcaaaaaccaagcaaggtaaagaccccacaactactaaattctattggtgaatctccacccgaagttggcaaagagctacatgatgagtgggttccacgtgtcattctctttttacttctttctccctccctcatcttccttctccccacccgacccatccttcccctctgatgcctattctcaggtgctccaatgttggagagtggagatggtggcagacatggaggtgactagaaggcgaggagtcgacaacgatgatggtgatgacggagaggttgaaggggaagataaggcatgggttccaacgatgccgtcgtgacgaccactggagcttggtggactgatctagaacctcgacacagagggttaggactcggtctcaagagggcagcttgggtcaccacgacccgccctcggatccacccctggcctatcctcacgcgccgcttgctccatccttgccttcacctcatcgtcaccgccgtcgctcatagggaggagaatagacacgtagagctcacgcttagcaagccagttatgccaggccaaaacttggctagttggcaaggttatgggagagcatttttttttcagcaagctggttaaattttgggttatagagtcatttgacaactctgttagggcctcttcggattgagggatttttagaggatttccagaggaatactgtatataggaaatatttcttcacatgaatcaacccaaaggaaaatcagaggaaacattcctttcctgtggaatcaatagagaaacaaaggaaaatttacatctagtcctaccttattttttccatttcctacgtttttcctctgtctatccaaacacatgtttatctacagaattcttgtgtttttcaatcctctgttttacccatgtattcctatcatattcctatgatttttctattcctacgtttttataatcccatggttcgaataagcccttagagttgcttcataggatttggtcgcaatatttgtcatgtgccatgtgtgccgtgctgtcacgcaaggatacgtgatagcaggcgcgtgacctacgacgggccagaccaatcaatcaatcaattggagcgggccgcaggctgggacaggatgccaagtgccaacctagccacgtactccgtacgcctgatcccaccggaaggcccgcgttgtgcgttgtgcgttgtgcgttgtgcctccctttctcgtgcgccgccgggctccgttccatcacccgcggtgccaactgccaactgccgattgcggaagtggaacctggcatcggcggcaacggcacgagcgcacgaggcagccagccgcgcatccaccgatccacgggccgggggaccccgagcgtccgcccacccagcagggcaccgcaggcagccgcgaccgcgagcctcgtgtaatcgtgctggatttttcacattttggtccttttgaaaaacttatttcgcaagtagatccctagaaaaacttatcccaaaaatggtcctttttggggcgccagagtggctggcgccgtcgttcaacaggacggcgccagcctctttggcgccgtcccaccgccgacgtggcggggcgatgctgaggtggctagggg

SEQ ID NO: 58437 - DNA, 1055 bp, Oryza sativa
cgcccccccccccccgaatttttttatttttgttttatttgtttgatatttttttcacgcttagggacacacaagaaccaaccatagaaaaattgaactcaaatggacgtaatatgtgacatgtataatttttcctctcctctcctctctccgaactagtgcagaggagagagatgtgcaacttttttatttttattttatttttttgatatttttttcacacttaggaactcacaggaaccaaccacgtaaaaaataaactcaaacggacgaaatatgtggcatatggaattttccaaagctccaccgaaaaacttctctcctcgaaaacacaatcttgcaagcggaatttggaggttttaatatcgccgaacccagcaaagctggggagaatcggatgtaactttttctgtagatctccgtgcatatattatttgcctgattccgagtccgtatgagaaagttacgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaattatatctctatgtactgtttaacttatatatgtcatttcatatggttatattttgaattagattaagtaatttcatatagtggtagagtgtattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactccatacagagaaacaggaatggaggcggcggcgctagcctggggcggcgccagcatggctggcgcccttctcctgccacgtcggttcgcgtgcgccacggtggcaggaggacggcgccaga

SEQ ID NO: 58438 - DNA, 712 bp, Oryza sativa
tgctcgtgcaaggttaccttttatatcagatgtgacaagctatcaaagtcttcagatgagaatttctccgtaatcggagcaatcataccctgaaaggctagatcggctaactgagcgtcagttaaactcaagctgaagcacttgttcctcatctccctgaatctctgaatatactcgtgcacgggttcatcatgccgctgcttaatcgctgtcaagtcagataacttcatctcatgaaccccactgtagaaatagctgtggaattgcttctccaaatcggcccaactattgatcgacccatacagcaaagaagaaaaccaagtaaaagccgatccagacaaagataaccggaacaacctaaccctcagagcgtccacagccgatgcttcaccacactgagctaaaaatcggctaatgtgctcataagttgacataccatcttgtcccgaaaatttggagaagtctggaactttgaaccgattggggagaggaactctcttaaaccactcagggtaaggctgccgatataagcttccagtctcttttggtttaagcccaaactgttccctcattacatcagcaatcacatcggcccacggtcgttgctgagctgctccctatgactgttgttgcatgggctcgaactgactgtactgagacgcaaactgaggttgagccagtccccctagctgatattgggcttgcggggaag

SEQ ID NO: 58439 - DNA, 1065 bp, Oryza sativa
  unsure (1)..(1065): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcatttttaggagccccacaattgatactgtagaggaatctgtttacattgatgactcatccattgtgaagcctgcttgttctggtactggatctggatttgaaatattgtgtcaaggatttaactgggaatctcataagtcaggaaaatggtatgtggaacttggctcaaaggccaaggagttgtcatcgatgggtttcaccattgtctggtcaccaccacctactgattctgtgtcgcctgaaggatacatgccaagggatttgtataatctaaattccaggtatatctctgtgtgcacaattattgtgttactttagtaatgttttctatgaaatttgaaatattagtaatattggtgctaagctggaagtttacacttccgctatctacaaaaaaatgagatgggatagttggtaagttagagataaagctagtaaccaagttagagctaagatggtgctatgctccagcttgttttatgtaaagccatgctgtgtacatgagttgattatgatggataatcagtctaccctaccttaagtttccttcttctccgttgccaaagcttcttcctccttgctgtttccaaaccaatctactgctaattctccattgcctacctcagctaaccttctacaatctagcatatagcacttgtgctgaagattttagtactacgctatctagtagaaacgaaaacctgggtagcatatgaaattcacatatggattctaaaggagaaaaccccttttatacccctaaaatctctattaaaggcactattactgctgcagtagcttgttgttcttctatggtta

SEQ ID NO: 58440 - DNA, 1367 bp, Oryza sativa
cgtattgggttcttatatggactcctctttcaatattgcttatttttaattccaaatttcagttatttttcagattgtatttctacttggactcttttttttctttttctctgattaatgtgggaatttctagcctccacagcgaacgtggtgccttcttttcgagctgtcttaataatataactagctaggtggcccacgcaattgcgcggctagcacccaaataaaatcatatatttttagtatgattttaattaaaatttattaaatagctatctcattgtcttaagactttgaaagaccaaatcttatcatcgtcgtgtttttaattatatagttttttaaaagtcacaccagttgctacccattatgtcatttccttctttatttgcttgctcgatctaccactatttctaatcattctccttagaacctttaaaaattggatcttacagtttttagagtttattgtcatgttgggttttggttttataatttctagatgtcctgtcaaacgttgccattatactcctctatggcctgtccattgtttcttttctttattgtcattgagattttaaaaatcgaacataattatcgtttggcttcatttttactttttaaagtcccgccaaaccatcagcgactttgccattgtacttctctacggctcgcctgctgcctcccttctttattgtcattgagattttaaaatcgaacatgattatcatttttttttactttttagaaattccgaacctttaaaaattggatcttgtagtttttagagtttattgtcttgttgggtttcattttttataatttttagaagtctcgtcaaacgatgccactatgctcctctacggcccgtccgccgtctactattatggtcattgtgattctaaaaatcgaacatagctatcgttggaattcattttttattttctagaagtcccgtcaaccgtcggcggctctgcaactatactcctatacaccccgtccgatgcttctcctttttattgtcattgagattttaaaaatcaaatatgtttatcaatggggtttatttttttttactttctagaagtcccggcaaccgccttgctcgtctgcttcacggcctgcttatcgtccctccttttaatcgtcattaggattctatttggtgttttattaatagtttttatatgtcgtatcaaccgccaccactctactcctttatagtctagttaatttatctcgtcatgtgttttagatggtcttttctttcaatagtctttatttttatcacaaattttagttatttataaattttattcctaattgaaatcttatttttatttttccaattttagaatttatttttt

SEQ ID NO: 58441 - DNA, 1866 bp, Oryza sativa
aaggctgttgagaatggatctacaaaacttaatgatatgaattactaagcgtaggtggtttatactttacactcacctcatcattcgaaacgtcttcatctaggacagcatcaaacacaaattcatgtttctcaacatattcagtgaggtcaacctgcacaaaaataccccaagacattgataaatgagtatagactgatagtagggagcaaagaatataaagaacattcgtcataacaatgcagatgaatgtaaatagctagcttggaatgaaccttgagtttggtctcatgaacagtcaaggagttcgactgttgttcaatgtctatgatatcttcttctttctttgatatctccttcttattaagtggtcttttgcggacctgcattcacatttcacatcaaatctattagaagtttgcaggttatcttaagctcagcttttctatgaaggaataattatcaaagattatggacaaaaccaagaaacataccaccactttgattttcgcaacaggagctgccttctctttctcagggaaggccttgaggaaattactttcagcaaaaacagtggatttgctcatctgtttatttggagcgaaggttgggtctgaatcatcaaagcctccattgccatagccaaatttttgggcaccatcatacatgccaatccctggcacttgaaactgcatatgaatttgagctccagttaatagaatgatttcagtatggtaaaagattggatagtagataatccttgatcctcactgcaacaacacaaggttcgtgcaaacatttaggtttaaaatgcaccatcaatcaacaaacctagtacactgcatcatgtaaactcaacaacgaaacttaaacaaaccaacaactggaccatatagtcagtattgatgcggtgccacatctcaacaaccgtccacgattccaccaaagtattatttgtttaacatcttgacattccaatccccaaaagaattgcgcatccaacctagcattcctaaaagaagaccaaaagcaccaaagcagtgcacttctccatttcctttccaaattccaactcactgattaactgaaaagaaaaaaaaacacccttaaaaaagcgacagttctgactgcccaagcggccatgccatcgcattgggattcagagcatcagatccacaacgtcggcgtcaatttggaaacgcggcgatttaacccccaaccatgcgagacaatcgaaacagaagggtgggcactaactagaaatgcagctggtcttacatcgctgataagctcggtgtcgaaggcgtggagatcgagcagcccggggctgagctgctgcctctgccccggcgactcccccgccgccgcagccgccgcctcccctccccgcagccgcgccggcgtcgtcggctccaccgacacgaagatctccccatccccgcgccgcaccccaccgcgctgcacacacacgcacacacaaacacaaacgagacacacccattagctcatcccggtgatcccgcacggccgcacccccacgcgtagatctcgaagaaccccgcacgccgtacctggccccacttgccggcgccgcccccggcattggcggggacgtcgaacatgagctgctccgaggagtatcgccggcgaccgcccccgttcatcgtcgccggcgaggctggggtggggattcaggggctccttccgaggagagggaggaagagagagtggaggggggagagaggggggcgacaaggggaggcgtggtggtggagtagagtaaaggccacccgtttttgcggcttccaccctgggactcgcgtgccgttgcggagacgccctccggtttgaattttggagtggagt

SEQ ID NO: 58442 - DNA, 6093 bp, Oryza sativa
gtttgtgttaggtggacgccgtctaaaacccgcggagggggttagtgcggatttcgttttcatccttttcagtcaggatttgttgccctgtccttaagccggtttaaatagagagttacgtcgatagggccattcgattatcattgtttttctactaagtcattgtcgaaatgattttttatttactacttataggcaaatgtgggttttgtttttcatttgcgatgaataatttgtacaagtaaagcttgtaaccatgtttcttcgataagtttagtaggtaggagtatatgttaaggataaatctgtgagaatgagatcatagaaaaagtgctagagtatatattatagttagagttatattaggatatgcttgatttgtgttggactccttccatatttgtaattattccttatctctactctatgtatctcctatatatactggctcatgagccccaataaaaatatgtccaatattcactatattcttatctccctatactattcaacatgatattagagcggacgaactagggccgaccttctcacgcttttgcgtcgtcacactcacacccgggagtaaggatctcccgggggcggccaccatttcattctagttgtcaccaagacgccaagtcgttagcctaggagaaatcgatctccctgggtgtttttcttcgtcgtcatgcttcgacgcagagatcgatattgatctcctcggcatgtctcctgcttcgtcggagtcttcatcgttgaattctagtcttcgtgtcgtcaagtcaagcacagcaacaactccctccatgccaccatcctcggtctaccgcgctcttcctgctgacggctagccgtcggtcttggcgtgccccatccaaagcacgcgacggcttccccacctccgtatgtttgcctcctcactgtgtgctagagcctcactgtcgtcggccaccgagtcccactaccacgccgctcccgatcgcaccccctccgccttcgtcgacctcctctaccgctggcaccgctccggggtgacaaccacctctccaccaccttttcaccaccccaccagtctaccgttgacaaggaccactcctccgctgcctctatctaactaccccatcccaggtcggcgccccatgggcctccaccaccgccgacatcatggagctcgcggacgctcgcttggtcgtcgctcgtcatcgacctttgctagagcagccttgccattgatctccagatgctcgtctctagcttctatctgtctacacatgtgtgttatattatataatagttagagtcatattaagatgagattgatttgtgttgactctttccatatctataacttttttcttatctctatccccatgctcctatatatattggcccttgagcctcaatacagtgtgtctaatattcgtagtattctcttatccttatactattcaacaaagagttacattctcactatgtctttagctccaccaagtccaaagctcaacaattttatttcatcaattgtcttgtttacgaactcctgaacccaagttcttcattcttgaagactcgtctattacactcactccatatttcccatgtaagagcatctccaacaacatatctaaatttgactctccaaacatccatttgcccagcttgccaaaaatttggatagtcgaatttgcctttcactccaacagactctctattacagttctccaatctgtcagtgggtcccacatgtcagcctccttatttatttttcaccccttcttatcctcttcttctctttctcttcttgttattcctttttctccgctatcttgtcttctccacagtcgaatcctggcggcggcggaggatgcggtgatggcggcgaggaggagatgacaaggttccgccgccgctagagatgtgggggagataaaaggagacaagagagcggagacaaggaggatgttggtcgatatagcgacaaaggcggcagccggagctcaagacagcggatccggcggcgacactcctccctcgacggatggtggctgtggcagggaggggcgaagtgtagcagcaagagtaaggagggccgccgcacaggaggaagtcgccttcgtggctgccgccaccaatctagaagaactcaatggcacagtggaagaggtcgacggcgcggaggagcttgtggcgccggaaaaaggaaggcggttgatggccaacgccgagaaggaaaggcaacggtcgagggaggcgagcggccggcactgtggagagtgagaagcggttgatggccgacgctggagcacaagagatgagggggacattcgtggggaggaggaatagcatgtgggcccatcgtttggtgaggcatattggctggcaattcaagccacatcgttttttttcgctcgaatggctaaaaactggtttggagaggctaatagagaggttgttagagcatcaccaacagtccaccaataatctatccccaaaaattaatttttgggtttcctaaactaaaaataggtggtgaaaaaaccccttcctccaaaagatagcctaaattcaatccccaaaaactaaaagtgggcccttctgttaaactatcaatagaaattctagttttttttcctttctcgtgcgtagaaggagatcgccccgacacgggaaggagaggagaaacgtggaaggaggggagaaacgcgcggaaggagtggattgggagtcgttctctctccctcaaatacacctcccgagaaaattggagatgggaactccaaaacgttcagagctcttttgggaatctgttagaccagtttttttaaccaaaatctcaaaaaaataggattaggaatggaatagatagactgttggtgatgctcttagagatgttataacggatgagaacatgtttcatttctcttgaattgtgtttatcttatacttcctccgtttcacaatgtaagtcattctagcatttcccacattcatattgatatcaatgaatatatatatatatatatatatatatattcattagcatcaatatgaatataagaaatgctagaatgacttatattgtgaaatagagggaataaaagctatgcaccttaaaagcaagtacctttagtaatcctaaagctagagctaattagtgcagtactaccacgaaaattatcatgccagatttactgcccgcacgtacagtcacggttccccccgaagaaatgaacatgaagtgataccgtgataagtggcgcacgactgcacgctaagtaaatacttcttccgttctaaaatgttgctatctaggatttgatttgacccatcatgtccagattcgttgttctaggatgggtcaaattctattctaggtagcaacattttgggacagaggaagtacttcctcagtcccctaatataagggattttgactttttatttgcactgtttgaccattcgtcttatttaaaaaaattggaattattatttttttgacttactttattatccaatgtactttaagcacaactttttattttttatatttgtacaatttttttaaataaaataagtggtcaaataatacaagtaaaatgttaaaatctatcatagtatgggacaaagggagtatttcatgcaggaaaagaggagtatcatctctgtcctcaaagtttaaacagctggcgtgataaacctttctcgccaggaaaattttcaaaaagcacaaggactcgacggcaagaaactctcgcaaaatgagcgagggccacacaggccacttcggttttgaatagcgcccccctcgggtaggcgatcgcctttcaccggcacgtggcggccctcctccgcgccgggctcggccggtgacgcgtcgaacgcgaccgaaagcggcccggcgcggacggcgctccccccgcaggccacccgccggttctgcccaggcgccggacgtggggcccacgacgcaggaccctctccctgtcaagcgggccccaccccgcacagcgtccctggctgatttagacgtttaattaaaacacaagtgttttgctggttagagcaagtttaatagtttaatagtatagcccactactaactctaaatcatctatagctaatgtaatagctaattcatataatagttgcttattaatatctggttccacctatcatacacatattacgtcttaaaatccgtgctgcagctagttacaggtctatagcccgctgcttttttttttctctttttttatctttttaaaatatatttatagctggcttatagcctgctattgtaagtgctcttagtgggcgcgattatttattagcaaggactactaaacaaatcaacgcggctgatagcgttgcggcccatgtttgtggcgctttgctcgcgaaaaggtcaaaaattgcttgaaccctagcgccggagccatgcaccgcggctgtggtgcgtgtcacagactcacaggtgggcctggtttcccgattcaaacaattccaaggtaggtctgcaaagcagctgtgctcgagtttgaacgcagcaagcgagacgggtatatggcgtacgtacacgagaaccctaatcggcgaccagtcgcgggggaaccagtcgcgcgcaacctcccccgcgcggagaggtggcgtgggcggcgcggtttttattttttccgaacgatttttctttcttttttttttcggatggttttctttctttttgttttttctgttttttttttctttctgtatctttgccgtgcggttttttttgttacgcacgtttcttttttctgtttttatttctttccatatcttttttagttttttcggttttttaatatgtacatatacaaattttgtatatacgtatacaaactttatatgcatgtatacaaactttgtatgcgtgtattttttgggttttatacctacgcataccaattttgtatacacgtatacaaagtttgtatacacatatataaagtttgtatacgtgtattttttggacttttttacgtacgtatatcaattttgtatatacgtatataaagtttgtatacacatatataaagtttatatacacgtatttttttaagttctttattcatacgcacctaaactttatatacatgtatatatacaaagtttatacgtatgtatagatagtatatacacttgcatatacatgtaatattatagactagaggatatagtagtatatatactctagtatgggcaactcatcagtttcccccgtacgtacacgcctggtatccctaatctcgacgctttcttcgttctgcctcagtttcaagacgatacgctaatatctctccccgacgtttaatattagcgagccccgaaagcaaagcatatagattagtaccaccatgtttgggcaaggggacgcaggaggagtacgtgaaaacacgagaacacgtgacaggagaagcaatttggctaaaaattttgcaagcagccacgctgggcgtgtatcctgtatgagcatgggcattggcgcattgcacgcattccagagctcaaacctgagaggggccgaaaacgttcgggatttcctcgtttcaggcccatgcggtagtctaggtctacgaaaataaactacgacgggccaaggccgacgaaaatattgggattaagttcactggaggtccctcaacttaacagcgagattttttaaggtcccttaaccacagaatcagaaatgtgtacccttaaactcacataaaccgtgcactcaaggtcctatagcagtatatatgtgtggtttcactgacgtggcatcataatcagcaaaaaataataataaaacaagtgcgtggggtccacatgtcatccttcttctcttttcttccccagcctgggagagagggggaggcagcctgacgccggcgggagaaggggtggccgacgcgggaaagggagggggaggtggtcggtgcaactggcgggagaggggaagaggtggccagccgcgccgacggcgggagagggaggagagacggccgtagttccagcctgcggagaagcgcgccccgtgccgcccatgctaccatgttctcggagccgtcgg

SEQ ID NO: 58443 - DNA, 13236 bp, Oryza sativa
ccgccgtagttgccgcacccatgcttccccccgaccacgatgccgccacctccgccatggcgtcctccgaggcccccgcgccgcaggagcagaggaggagggtaagtcgtcggacgcgtagtcggcggcggggggccggcgtcgagctcctgtccgcgtgctgctgcgactcggcaacaaccggctcgccgacctccttttccccctcccgccggcacagccggccattgtggtatcctcctcctcctcctccgcggcggcggcagggggcggcatcgagctcccgtccatgtgcggctgtgacttggcgacaaccggcttgctggcctcctcttccctcctcccgccagcacagccggctgccgtgatgtcctcctcctcttccgtggcggcggcggaggcctcctccgctgtgacaaccacaggttgagataagaagcaaggagagaagagagaagaaagaaagaacgaaaaaaataatagatgtggggctcacgtcattttctcttacacgtgggtctcacatattttatttttattttttctgactaggatgtcacatcagtgaaaccggacatctatacttctacggaatttaaattacatgcctttatatagtttaggagtgaatttaaagtcgaggaccggtaggtgaatttattccaaaatattggcctacctgttgttttcaaggtttcgacgaaacggaggcccagaaacggcccagtgtactggcccaggacaagccgaagacggacgcacgcagcaggcacaagtgcagaacggcgaaagttcactagcccgaccaactgataagagctgccgttttttcatggcagcatcacaggcctgttgatccatgcatatactgtactacgcagtagtgctcatcgaataaagacggagtttttaggtttgatctattgcccggtctacggaagtgaaaagagtactggtacaaatacaagtgggtttctcttttattgttttctggcatgatcgtgcattcgtgcgtgctcacactgtcacacatcagctatatattctcctcgaaaggcaggcatcggctatattctcgaattatcaaattctaagacccacacttgttctctaaactaacaataaacactacgaggtcttatgcttattaactgctagtcctagttggttgttttagccgagataatgagatttagagagagagagagagagggagagagagagagagagagagagagagagagtataaaaggtgtggcgtgtacacgaccgattccttttcgcttcgagggtaggcagctagcagcacatggccggcaaaacagttttgcagcaggagagattcatccgttcaattcgctgcaccctctcattacctttctgaaactttttcttaagtccagatgatgacggtaatgacgtgtggattccctgaaaagagggaggggtacatgatgatgatgatgatgatgggcaataggaatacgagttgctatctcacaagcgaactcgtcgccgcgagcaacggccgatcgagcagggcaaggcatgcggagggagtggaggagaggacccttggcaagctcgatcgggcgcttcttccgctccaaaatccacgaggttcaggccgtccggcaacagggatggctcctccgttcgttattcccctcctgcaagggccgcatctaattgatctgaccaacttgcaaggatagtcattagtcattgattactcgttaggtgctcaggtatctgtatatatttcggcttcgttgcaaagagacagctgacagccgtcggcccaagagcccacactttgagtggcgatataaagcaaatatttcagggtgggaattgtcctgattcatgtgagattgcatttcgttttgtttatgtgaaaaacctgaaatatacttgtgaatagtactttaaatctaatagattgtgcccccctttttttaatatgcagattttacctaggtttccgttagtatatatgtttttcaaactgctaaacggtacacttttacaaaatctttttatatagaagttgatttaaaatataaaatattttttaaagtttgtaacaattaaaacttaattaattatacgctaatgtcttctcgttttatatgcgctaactttgacatctatctcagtagtccaatatttatgttgagaaatttcttacatcctcccgaattttcgctcgatccttccattccatgcctatgaactttagcttatcccctacatatttttcattttgattccctgttgtgataattatatatcaaaacctttgtttttatgaaatttaatctttgaaaaatatataatgggaataggtggggtgaaagatttactgtcaccactatcttttttcaaaatagtatagatattaggttagaatatgcaatgctgatctaacctattaagacgaatttctgttctataatctcaggggagggtgactggattagcaaccctgaaacactagccacctttgatgctctgtgcctctggctaaaggggggcagagactaggttgaccctttttactcattagtaacatgtattaatgttatagggtatgtttggttctctactttgctaaatctttggtgccaaaatttagtaagttttaactctaccaatttttttggtagggtaaagttatgatacatatatttggattgttaccaatgtgaagccaaaatttgatgatatagtgaagaaagttttagaataatgctaaactgttcaaaggcattgccaacaatttggttttgatacaaaacattcactagtactatccaaactaccaatgaattggtccgacacatttggcatcaatccgaaataacccatattgcttattacggagtagtgaacctccttattttaatgcgtgattttttagatatgtttgataattagtcttatttttttaaaaaaaatgcaatagttgttatatattaaaaacggagatagtactggtcaatctttagctttagctgcgcattgcaaaatcctaacaaacaagcacgagcagaacggcaggacgacgtaccactccaaccttatctctactttatactgttataaaattgaaaatgtttttaccagtactttggtacatcgtccgtgcatgagtcagtttttaagtttgttcgcttttggaaatacaaatatgtatttgagtcggtttttaagttcgttcgcttttgaaaatacagaaggaatcatataagaaatatttttaaaaaactcacatgctaacatgagacaactggactcctaattgtagctcataattttctaaaaaatatatatatccaaacaagttctcatagtagattttatcttaactaaaacgtataataacaataataaaattaaaataacattcttccgtagcaatgcatgggtattttttttatattagtaaaggatgatggcagtgaaagtacttaaacacattcacgtgttggccatcaacgagaaaaaaaaagcaccccaaaccacaaacataaccactgtagcacgtagtggcgaccggccgaccagccggtagcggagataacgtcaaaccgcgcgctccgtgtcatcgctcaccgaaacctaaacacccacgccctctcttatccaaatcaatcgcactcaccaagcccgcaccaccacgtacacgagacatcgctagcattgcactccccgtgcgccgcgcccgcgcacgtatcgctcctgcagcgatcgaaatcccccccgtgaatccgtgatccgcagccaccacgcgcgcggcgcccggcgcccggcaacggcaagcaggtcagcagcaggggccgcgcgcgcggccgggcgctgcgatcctgtcgggtcgttttcgcggccaaaagcggcgcactccaccgtcgctttggcacgtaccggcgcgccggttggccggggctcggcggccccacgccataaactacgaggcatctggagatatgatgcatatggccaagatctcgtgctgacaacatatatacgtgctcgatcgtaccacgggggggatctcgctctctctgccctttgacatttgcacaaagtcagtgagatgaaaaggggaggacaatggacacgggagggaataatagccggcgcctgatggctctagcagtcaaggtgcaggcaataataggggcggtagtattaaaaaaaaagggccaagtgtaaaagtttaattccccccacactcgcgtcttttatggcgcgagaggcgagagagagctcgaagattccagcccttttggttctcctctctctctctctctcccttttgacatttggacaagtcaaagaaaacaatacgggagcctatcgccctagcctagcaagcaaaagaggcgaggcgacgacgatcgatggggtccctcttgacaagtgtacatagcaacaactgatagaagaatccctttccaaacaccagcaagctgctgtcccatttggcgactagtttatcaccaattacgacttgtttatcgccaattatcggcatatctcttttttcctaatcgcttgctcccgccgtgcccaccactagtagcgtggcgtttgactctactcccgctagtcgctagctaagccagtggtactagtagctagctagtgacacttcagaatcctctcggaatacgcgtctatgtacagggatacgcgtgtatatatggcgcggcccggccaaaagtcaaccccccgcctccggcgcgagctcgcagcagcacgcgtccttttagctgctagctcacctcgtcaaactctcgcctctccccccacaacgcgagagcttgccgacgtcggcgttcatgcgcggcccgctgctgctgcgcgccgtcgtcgtcgtcgccatggagcacttcaacgactgggacctgcaggccgtcgtgcggagctgcagcttcccgcaatcggagcctcctcgcgtcggcgtcggcgtccccgcggcgccgggagcgggcggggctccggtggtggtggcgccgcccgcgcgcgcaccggatggtccggatcagatggcgcgggcgtcggcgtcggcgctgtacgacctcgagtacctggatttggatcataagccgttcttgctgcccgggtcgtcgtcttcgtcgtcgtcgtcccgagcggtggcgcgggcgcgaggggaggatgacggcaaaggcagacacgaggtgatgatctctttccccgcggcggcggcggcctccacgtccggtgcgcagccgcggtcgccgtccggtcggaagccgggcatacgcaccccgcggcctaagagaaggtagtacacactactagtttgcaaccgttttacgtaccagcgcattggcagcctgatcgctccaagaaaattctcagcttatttcgaagtgatcgattattgtgatttccatggtgtgaggagcagcaagaagagccagctgaagaaggtggtgtacgaggtgccggtggcggacggcggcgtctcctccgacctgtgggcgtggcgcaagtacggccaaaagcccatcaagggctcgccttatccacggtaactaattattaccaacactttctttgaccctgccgtcccctttccacgcgtcactactcactagctactcctgcatatcaccataatcatagcgttgggaaacctaaaattgaaggaaatgagcacataaatttgatatttttattacataatggcatataaataacctgctgcacattgagatcttgagattatggccacaacaatcgaatgcaatgccttgcgtttccaattggacatcatggctttggtcacgctccacgtgacatgtacttccggtgtagtacaaggcaattccctgtacttagcagtacaatcggctgtaagcatgtatactttgcagttgacctaatgacctgtgcgctcggctcaactaacttggcgatacgatggttcgttgggtggttgtgatggatacaggggatactacaagtgcagcagcatgaaggggtgcatggccaggaagatggtggagcgcagcccggccaagcccgggatgctcgtcgtcacctacatggccgagcactgccaccccgtgccgacccagctcaacgcgctcgccggcaccacccgccacaagtccgcccctaccggcgacgacgacaagccgacgtcgccgggccctgcagccggcagagcggccgccggcgagggagtggtcaagtgcgaggacgtcgacggcaacgagctgtcggcgatggccgcggatggcggcgcagaggacacggcggcggcggcggatgacgacggtgagttgtggccggaggggatggggctggagctggacgagttcttgggtcccatggatgacgacgtgttcgagttcgaccatgtcttggaggacgacggcgtgctggggcgacggctctcgctatagctgcaagagaaaagctgtactagctagctttgacgagccttttaggacagttgactgtcagctccaacctcttcaggagatccaagccatgtataggcggtttttattcgtgcgtgtttgtggcatgatctctctcaagtcaaggttccaagtttcaagtttgcacaagtgtatatacttgtaatattcgcagggatgtcagtgcgcattgacacttttgcattcctgtacataattctcgtggttggtgactttgtcccaacacgtggaccgggctcaaagggaagtgacagcttcagtgcagtttgcctgcttgccagattgctattgtaacatccaagggacagtgcagataagagcatccccagcggctcctctatccagacatcgatactgtgtttggtgtatggaggtgaaaaattgcactccagcagaatctccatcacacacgccatttttataggtcctccaaaccggggagtggattttaatccctcaaggggatatcccctcgtatacctttttctttcaaattcgatgcaaatagttgtgaaaaattctgaaaaaaattgacaatgtagagtataatgatacctactagtccaccaaaatttatgttcaaattcgatctacacatcgagaaacaaaaaagacaaatttagatataaacagtgcactactattcatacgctgaatttgtcttttttatatctcgacgtgtgagttgagtttggacttaagattttgtgaagttgtatatatgtgttgtatgaatattgtcaaatttttccagaatttttcataaccgtttagatggtttttgagcaaacgaggaaacatcccctcgagggattagaatagtttccctccaaaccgagcctttcacaagccaaaaatggcggttctctctcctcatgccatcctcaactgccgacctcgcgccactatatggactgcataccgtgggagagaggagctgcataccggatttggaggtggagatcgccggagtagaggtggagaggcagcggatctggcagtgaggtcgccgccgtccccgccgctcggggtctctgccgctcctctgaccccgccgcccctctgccccgccgctcctccgccgccccttcgcagagactgggtggtggtggtggcggcgggccatcggcgggaggaggagggagatggacccaccgggaggaggagggagatggacccgccggccgtcccttgcgccgctcctccgccccttcgccccttgcgccacccgcatcgctcctccgaccgcgccgcccctttgcccagccgctcctccgagtgcgccgcccctccggttggccctcatcctccccgtcctctcggcgctggtggtagagaagaaagaaaggtggggagatcggcggtagagaagacatacagatggggagtttttttttagagtagtgataagtatgtggtagttgtaaaatattagtaaaatataggatgttggtatatagaggatgtaatatagatgatctgttagagtgaaaagtaatatggagtaggtatcttttttatgactatctaaatgggagtatggaggataaaatttagatgagctgctggggatgctctaagcttcctcctaccgaacattatatttgaagttttgaatggcacaacaccgcaatatccactagtaatatatgttactataaaagaaggattcgattaaaaaaatacagaaacttcttgatctcttatttctgaacaaaatcaaatgaattcaatgtatctttgcactctaaacatcggaacaaatgtttgcaaagcaaaagacgtataaattgcacaccttacaagtctgcaagaattgcagtaaagaatatatactccaaaattatcaagtggattcattactcgtcaccatttctcatgaagcatttactatctctgttctaaaatataaaagattttgtccatgcacttacatagatatgacatatctattatatttttagaacgaagatagtagacattaagctattatcttctttgtgcttcgctagttgccatctactgatccacgtctacaaatatccgatgatatcaacaaatacattaaacgagcacatcttttttgaatcagttgcatacatacaaggggaatgcacgggtctccaaccaccagtgctgcaggatcggagagagaacaggggagagggaaatatggctagcggagcatagattattaaaggggaacaatcgaggaaagagtactgaagaacctgcatgctgtacgtaagatacattaggtgcttgtttctaattttttcttcaaacttttaactttttcatcacattaaaactttcctacacacataaatttctaacttttttcttcaaacttccaattttagcgtgaaactaaaccaattttggcgtgaaactaaacacagcctagcctgcggaattgattatttttcgatggaaactgagcaattatttttcgatcgaaactcaaacaattattctaacactcattggttgcatatatttgtgttaagttattttatttttgttgtatgcatatgtacgttttttaatctaagtctttgtctatgttacaataagatgagtttttttttatattggacataaaaaaaatactctagactttcagatgggagagtaaacagatagtcaacaaactaactgtgagcattgtagaggctacaattaagacgaacatcgcatttcagggatgataggagatacagcactactttgcaatattagtaaaacgacagagcattctgcacttcggagcaaagattcagataacgtattcttgtgtccagatgtatcttccaaaactaggataaagtcttagacaagctagcctgtcacacagagagcttacaatatggaaacgcaacgaagagcatcacacaaaatccaacttgacaatgatgcgcgaaatctccagccaagtgatgactcacgacgataacgaatttacagcatgcacgaaccgagatcttagtactcccatttcttaagctccatcccatcaggtgggcttccctctaccttcttcgagccaacatctttccaattggtcgacagaacagtaccgttagattcaacctgcaaacaagcacatcgttgatgtataagtatacaaagttcaaacttactaaacgcacttctgtcagcaaggtcactagttataaacatttcatcaattgtgctaaagaaagacatacaaaagatttcatcattgctcgtcgcatgtcttcatcagcatcactgtagatgtcacggaaaaatttgttcaatgcagcatcgccttcaagcttctcctccttctcctgttggaaattcaaagtcatgcaattcaataattaccagagttcaaggaatgtccacaggcagtgaaacgttgaaccatgtgcatcatactaacctcctttttaacttcagcttccagtttatcccagtctttcttggattttgaggaaggatatgatggcctctgggccgattcagctgataaaagaagggctatcagtaaaactgtaggagagatggggaaagaataacaattgaaccccaaaaaaaagccagacttgatcttggttgtattccagtcatgtacagttcatgcttaagccgatctggcagtaaaccatcagcctcaacaaggtattagcaagataacactcagaaccctcttccattttcatttaaattcgattaccaattttttgtgacattaatgtgttcaacaagcacaggaaccagcaaaatggaaatgactagcctgacatgtgagccagcgatcagcaagtgcatagaacggcagaccttattgataactaccacatgaatggaaaagaagtcatttctttccatggctataaatcagctcaccagttactaacataaagcagtaaataattatacccagcaaagtacagatatttaaggggaacctcttataataagattgaacagtgcaactttcaactaaccacaagaagcaacacaatagtaggttcaacagttttctggaaatcaactgcaatagttttgcttagtttgttacctggagggattatcttttgtggaacagcctttggttttttatcataatcaagtgaggtccatgtaatctgttcagctttagccagtcttatttcaaccttcgtggatagcacttggtatctgcttttctcagggatgatctgatagtcaagagattagcaaaagttaagaggtgagatgattggtactgtgcatagaaatcataataaacagatgctgagtattggttttcaaaaagaactgtatgtatggatcaacagcaatgcaaccaaagaaaataggcaaagcagtacacccagctttattaggtttggaagcatatttcaggtaaataccttacaaattagaggaaatgcacaaacatattcaggtcataacaatatgcactgtttccatttccaatgcattaagaagagaaataatcctggtattgcagggattgcataccttagaaaacagacgaggctgaaaatggtacggctcctctccagggacttcaatcgacacacttaactaaaatggaaggcttaattagtgagcacagtaaattagtaaatatagatgatttgcaacaatttattgttaaggtacacaccatttgttcaccaaaatcaacaacaacattctcagcaggaacaccctttgcaaaaattgtcaatacaacttctgtagcactgttgtagaagtcgtgcctgcaacaccaggtgcatttccagaaaatgtcagtaccaaatcattggggttaaaatccagccctaagaagcacttggtttagtgtctgaaaaagggtgtgggacattatcccatatattcatgtggattctgtcaagtggtttccaaaatataaagtggacccctcaattcaaaataacttgatacttgactaaagaactgtattgggaaaagaagcacagtgttaaaggattcatgaactggttacctgtattttggcttcacttctaccattggtggtgtattatccatgtttgcagcatcatccttttcctcaacaaaagaagcaacagagggggcagctgctccatcttcagccttcttaacagggacttcactaagctcctctgaaaagaaaatgcacagcatcaaagtatgagaaagatgtctcgtgcatacatttcacttcaacttacaggactgctgtggatattcatcccagaggacaaatatgtgtgaaaatgcatactataatatggtagtctcacgtaatggtatgccccaggtaaaaatataacacaatactgcaaatgtattaaccaagcaatggactcaaagggacagcttaccagcaatgcgctcatcacactccttcattaggcgagtaaaccttgagtcaccagatgcgaacgagtaacccaattcaagagctgcttttgcagtttgatactcctccagtcgtatacatgcagcgctaaagatcatttgcttatcagccatcataataaattaatgtgcctagtcttttttcataacattaaataatttagtcaagactgaccctttacgaagataagccttgtgcattgatgggtcaagttcaatggccttgttagcatcagctacagcctctgcaagacaaagtgcaatttgttgctttaatatgaaacagcatgataatgtctttgcaaacaaaacaaaataaacatgcagctaagtcattttagcaccagcacccttatactgaggtattttaagatatagcagtgctgataatttaaggctacaggctacaaaacaacttacagctattactgataaggatgattaatgccttgtttggcaataaaattttgcaacatttcggacagaattgtcaaagatatgtgcaacctgacaaatttttacaaagatcagaaccaaggggaatgatcaaacactagtccaacctgacttttttttacaaagatcagaaccaaggggttttctgctggcaagcagcaagttgtcgccagatatcattttagcaccagcactcttatactaattcaatactatgataacagacagaaaacagtaatcagcaaacatgcaggagtatagcatttccttgagttggcaaatttagctgggaattctcagtaagtaatagctgaacaataacaacaggtagacccatcaaaatctgccacggctaactattgctctaaaataagagtagacctactctcctacatagctagctaaacagtcaagcacacatatctttataaatttcttgttttatcttactttgtaaatcaaaaggaacaggcaagatcagcacactaaggagttaaatttgattgtttcatcaaattttaaatatctgtttttgtttgctatatgcaatcattaggcatgatatgcggtgcagatgaaatttggatatatagaacaagggaaattttaaacaatcattaacatgcatcatcttggatcattagttgtcaattttttctacagcgcacaccagctttgtcatatactccctccggttctatattaattgacattttgaacaagattgatgtcaaacttttataactttgaccatcaataactttaaaaatatttagtttaaaggaactagaacaacatatatagatttgtcttttaaagcactataataaaagtaaacatgcatttatttattatatatattataatagaaaaataagatcaaatatatatcttgtagaccgtgtca

SEQ ID NO: 58444 - DNA, 2263 bp, Oryza sativa
  unsure (1)..(2263): unsure at all n locations
cgaaacatggtatttgtggcgtcctcatatcccccacaaacaactatgctgcttctttcgactaggatggtacctgccacaatgcagctatgccctccttgcgctcaatatctcctcctatcagcaagtcaactgtcactaataaaacttattttggcccatcccatgaccttcaccctagatccttctccaaatcacgaagcgcgatcacacacacgcacacgaattgcttgaacacgcaaaacaaacaccggtttgacgtaactcccgcaaataggcgcaacaaaccacgaatcaaaaacgcacaaaaccacacaccccacgcctcacgatctcatctacatccacacagactccccagaccaccaccaccaccaccgcacacacggcaaaccaatctaatcgaaggaaggggaggaagggggagattgcgagagatggattaccagtgtagttgcctagcttgatatgggcctgggcgcggtcggcgtagagctcggcggtggcggggctggcctcgattgcctgcgtgtagagctcggcggcgagctcgaagtcgtcgtcgacgaaggccgccttggccttgctctccagatccgacgcggcggcggttgccatggcggcttggcttttgcggctgcggtgaggaggccgggggatgcgggtgggggaagaccagacgaagacttcgcggaggggtagaataagatcacggtgaaaggcctttttaagggcccgtgtggcgagtttctagagagttcgatgcgggagaggccgggccgacgcttggaatttcatttttcttctctctctttttttctttgcctttttttttctctttatctttttttttctttcgtgtgggtcaagtcgtctctctggtggtttgttttttgttatccggaagccaggaagtttccggaatcatttgggtttcattgatgtttaagcgttgcaagttgtgtgtttagtgcacttattcggattgtgattaggaagcgactactagctggcagaccatcctcccttgtcatcatggtctcatactctcatgtggcgttgagaatttgagatcaatatccaaagttctaagcgggttttcctggtggctggtgatcaagtcggtgatatggataattcccgtctcccgatcacagccacaagccatgccaaaattcagcgtgtcgatcggagtgtctgaattcgtagaagttaccacgattgtggaactcaatttcagaggacttgtatcaaaaagtagcacacttttcggtaggagccactagtgagtactactccctccgtcccaaaatataagaatctagaactggatgtaaaatttacatgtccagattagtagtactagaaaatatcacatccagtcatatgttcttatattttaaaacggagggagtatctatttgcatagagcaaacttttttttaaagattaaggtggcaggagctctgccgactatattagaagaagtaaaccaaaaactaacnaacaggtccgagagtatatattacataaacattacaaaacagaaattaataactttaggccatgtttacttcccacctggaacgtttgaacacatacataaagtagctaaaaaattaactaattgcacagattgtgactaatttgcgagacgaatcttttaagcctaattgctccatgatttgacaatgtggtgctacagtaaatataattaaaggaatagaaaaaggagcatccacgttcgctctcatggcctacaaattctcacattaatcggagaaaaaaaaacagagtccatatagaaatacaatttagaaatagctgaaattcggaattaaaaaataaagaatattaaaagaggagactagagtccatatagaaatacactttagaaatagttgaaatttggaattaaaaaataagaaatattataataggagtatagagttcatatagaaatacaattaggaaataatagaaattcggaattaaaaataaggaatattagaagaggggtatagagtccatatagaaatacaattaggaaataatagaaattctgaattaaaaataaggaatattagaagtagagtatagagtccatatagaaatacaattaggaaataaccaaaattcggaattaaaaataagaaatattagaagtagagtatagagtccatatagaaatacaattaagaaaaaaatagaaatttggaattaaaaaataaggaatattagaagtagagtatagagttcatat

SEQ ID NO: 58445 - DNA, 1361 bp, Oryza sativa
attcctgcagccctctgcggcttactgatggattctgtaattagtttttttatagtgtccgaacaccctatgcgacactctatataatatctgatatgacacaccaaaactttacaactctaaagctatacaaccccttagacacagagtaaaagaggctagtagctgactggaagcgtaaacgcaagtacgctttgttctaggtcttctatgattaagtttattgtcagcttccttgaattctccctgaaaaattctactatttcgttgcaactagatatgccaccaggttgtgagtagtgcccccgtcctctggcgggattgtgcctttgtggcgctgtttgttatttgaatcacccaatctataatattttgggcttgtgcagccacggacagtggtggatctagaaagaaataacaatggagtatgagtaaactagatagcaatagagtctcaataaactagatagagttactagatagagttacagttccccctttcatctacatatggtaaaaattttagtagggttttttttggagactcttatagttttcacgccaatagtgagggttcgagacccgccatcccatgctagatccgcccctggccagaggattccttctttttagtgagtgtattccagacttgtcttgtgtatgcgcagtcacggtacaggtggtctacatcctcaaaagcttctctgcaaagggagaaaatccaatcacaggccaatgcctaattaacaagttttcttctattagggtcttttggtgcaggatcagccagcccatgaagcgttgctttagctgtgccggcgtttcccaaaccgtggtcacgaactgtgtttgtatttgcataaaacaaacttaaaatatatataccacttcacaaaaatgttgagtctaaacttcactcacatatcaatattattttctaaaagaagtctagcattacgcatttactgtaatatttatgctcagatttatcttttcttttcttaatatgtaggtcaaatttaaacttaatttttgtgaattaaataagtcattacactgcacatcattaattttttatacaaccatttgcacttgaatttgcattaattcatttttggagtttgaaataaccaacactcaattaatcatgtgtttatctcgttttacgtatcttatcattttttttcttttcatgttctatcaaacaaaccctttagaacagatacaataacagactataagacagctataaacacatattgaggagataaaagaagagagagataagcagcaggctataaatctgtagccaactgcaatacggactataagacacaatgtgtgtatgacaggtggggggc

SEQ ID NO: 58446 - DNA, 7397 bp, Oryza sativa
  unsure (1)..(7397): unsure at all n locations
ctgcagcccttggttgtttataatttggagctagtggttgactagtatacaattaaacttgctcttagtgagcgaaggttgtgttatctagtctaagttcataactcatctcttattttctgtatacacgttttctaaattggtaacaatttataagatagtccgatggatgatgggtctattcgctgcaacttttcggcagctgcagccgttacagtgactatattgtttatacacattggtactgttgatgtagttgcaactgctgcagcagcaagctgcaccgaacagagccgataagtccaatggatgagaagtccgatgggtatgcaatctatcgaatgattgttcctgtgaacttttatggggatgttttgcaaactagtataatgggtataatgggtttatagatgttattgttccttccaatgcctaagattagacaaatcgtcacaaccacaatttgtgagcagataagaaacacggttgcatgggctgatgggcagcatcaccagagcctgccaagaaaatacagggccggagtacacatatcgaagattggcaccaactagctagtataatctgagcaatcctaacgccaattaaatggagcaaacagcaaacaactgacaatgctgcaacaagattttcaccgtacgtacattccttattacacgcaagttaaattaacaaaccacttgggctatgccccgatgaatcagaaaggttttcagaagaggaggtcccggaaggtggggagcttcatctcaccctcggtggcgagcgggatggtgaanctgccnacnacngggaggtcgatggtgatcccgacctccagcacgtagtcgatgtcccagtccccgctcacgtccttgatcagcgacacgatgaagtcgtacggcaccttcaccggcagctccagatttgtcgtccgctcgccgcgatccaccctgggtcaggcatcgtgccggacgctatcaccctgcaaaaattgacgcaaatcgcgcgagaaccagccagctgactcttttttaatttgcttcggataatttgaacacgaactaactggatgcgccggctaacaattatgtaaataatgcacgcacttgtcgccgctcttgaaggtgtaggtgagctcgcagatggggatgcggtgcgagtaggggttgttgacgtcgaggtggctgtggagcgtgatgcactcgcggctgacgcccttgaaggagacgcggtccagcgtcgcgtcgggcttggggattttcgcgatcttctgcgccacgaaccccttggccctgtccaccagcccgcccaccccgcctcgctcccgccggtcctcctctccaccttccccatcgtcccgctcctgccgatctcctctctcctccgccgcgctcatcctctcgctcgcgcgcgcgcacgtcgtgacggatcggtacacgtctctgttgctcgtcgcggctgctgcgctctcgcgtacgcgcggcgtgttctgcctgcgttaccattccggccgtgtgcatgcgcacgggtcgcgggctcgcggctaggcgcgacacgcggggagtgtgtctgtgtgtgtggatcgatgcacgcatgcgcgcgcgcgcactggtgcacggccaccacggaaacgtttggtccgcgaagcgtgcactgcgcgcggcctgtacggcagatcgggcaatgattgtttacgctgtcttgcgcgaaacctgggaataaagcggcgcagggagctggaatctttggacgtgagatccaaggcaagctcgcgtgagggagggaccactgttcgtgttgggtgattgggtcggccgctttgtaagatcgaaacaaatctgcaaaccagggcccgggggattgtgggcttgtgatattattgtgtacatgggtgggtacaaacgaaaacaaaaatataaatgagaaaaaaaatgaaattgaaaatgattttgcttcaaactaaccatatccgacttttattcttatggtaattaccatatttcatattatgataattatcgtatttctaaatatgcatttatgatctattttcttatttgacatagtttagaggtctatcaacttcacaaccaaatccttaactcgagtacaagattaaaagaagataatttataatttacatagcataaccttgaatttattttaacatattatatagttatgcaaagttaaatgtgtgattttatagttcaatatttccaatatttgttatggcttcctattgatactgatatgtttctgttcgtatagttcatttctggttttttaattgtttttgtttccgcttttaccattttttattcagtttttgggaaaaaaacatggctatggaaataatcgagatattttccaaccgttttcatccctaattgtgcagcagcaaactaggtgatcaaatctgcaagggagaaatggattcacatgaattgaagagtgtacttcctttaataagaaaaagaaaagcaaacatgcatctgatgtccacattgttttggtgttggcgcatctcattgtttactgtttaaagtgattatagctggtcattttctgaagagaatagtgatctctgaattctgggccgaactgtcatatgttgcatattatggccgagaacatgatgagtttgaactacagaaacagagcataaggatcacatcttttgcctataacgtatatgccaatgttaaaatttaaattttaaaacttactagttgattttgagatattttattatatttcatttttcagcattgatgtttaagttatttgtaaaagttttaattataaattattttttcgctaatacactctttggtgtattatccgtaattggccaatcgatggcataggatgaagaaaatcttctagcgttgcgctgctccgggcccaatacagaatggggctcaaaatggatcgcgttatcagcctccatatacttaaaatgggccttctgcaaatgggcgtctgactttctgacttgtaaactcatagatcgttttttgttccattttctcatgtagtagaacccgttcatgattacaggctttcagcgttgatcaacaaaacgttcttgccctcttgataaatgataatcgaccgacttgccgcatttgcggattgagggctgctatataccgaaatcccactccaaaatgggatgaggtatcgggtgatacttatcaggtatcatgtgatacttgcgaggtatcatatggtacctatcaggtataatacgattcttaccacatagaaggagataattgcgaggtatcatgtcctataacctaaccggtatagggtgatacttataaggtatcatgcgattctaccacgtatcagatgatacttgcgaggtatcagatgatcctcgtcgtctccactgcaccgcatgcccattccttcccccggcggcgctccaccaccaccaatgcatcggcgccccagcagcaggaggaaggatcccttggagtacaaggagtacatcgtcctcctgaggccgtggccggacgctgccaccaccggcatggacgatgacggcgcgtagtggagctagtacatgcccttcctccccggcaacagcactgctggcggcaagccgcaactggtccgctcgtacaagcacatcgttgacggcttcaccgcaatcgctgtgtccaagaagcccgacttccgacgctgcttccaggacggcatcgcttgcttgcattgctggtttaaacaggaaggaggatggcaaccttgcctgatccggccatggtgacgacacgctatgcgcgcggcgagagcactcgaggcagagctgctgcggatgcaccagggcagaggcaacggcgacgcgccgcctgcgcggcggagttcggtgaggtgggaggacgcgagggacgacgacgccgccattctctctccaatccaatcccttcgtctcgcgctgcagggtggacgacacggtggacaaaagtggatcctatcccgtcccgacgggatcccgctgtttagcatttatgttgcggatttatcggcagcatcaagtattagccattttggactcggttcgtgtaatatgttttcaataggttgtttggaacaaagaaatgtcgaccaaaaattcgttgaaagctctcgtactatttatctatttaaaagagattggaaattttagaggataatgacaaggagggcctatacagccattcgctcgcccgcgtagcctcccgcacaggtgacccgggtggaaaccctagccgccgccgctgccgcccccctcccccaacccatcccttgcctcaccgccgcttgagcgagtggctggcaaagccgacggcctgcaaggacagcggtagcagggctcgcggctgcgaccaccatagttccagcgcgggcaagtccatggtggaagctggccgaaaagacgacagcgtcgaggcggggtgccggcgctagcggggcacctggatctggcaccccccacgtcggatccagccgtggcgatggcgacagaggaccagtggcgctggcggcgaccgtggctgcggcggctgtctggcgtcgtggccgtcagatctgggccacgacgttgactgcggcggtaagctgcgggtggtggcatcagcggggaggcgtgggagattgcggtaggcggcggcaggagcgacggcggcgcacgaaggagcaggcgcctggccggcagcaggcgcgacgaatgtgctggccggtggggctggcggccaacacggtgaaggagactcggccggcgccggctaggcgaaggaggtgtggccggtagcggtgcagcgcgaggaggagtggccggtggccgcggagtgaggaggtgcggccatggcacgccgaggacggccagtgcgcgagggcctccgcagcgggaggtgaggctggtggaggtggagccagtgaggtggtagcacatggagattggccggcggggggcaccggtgcaatggtgcccacgtgccaacggaggcttagatgacgatggagcaatggtacacctgtggtagatcggtaggtgatggatggcgtgtgaaaacctagcctggtcttgaccgggctggcaatgatgatgttcgagcgtcattcccctcctgggagcgttgttgtgttgtctcatccctcaagtgtggttgcctggcgaaagcccagtctcggctctctttgagaccttgacggacggcggtggcggtgtttttcgtcacttctctccttggcgacgtcgtttaggcacctccttgccgaaacccccaaccaattggtgcaaccttgctctaaatttcatgctcttgtagtgacatcctagtttctataagttggccacgtcggagggccttagggggagaggagttccattcttctctctcaccctctctccctaactcctgaagacttggatagagtggggctttgtgttggttgtaatggtttaggttttgggcgatctcggctgtgttccgttgttggcctagcggcggtcgttcacgcttagcagcggctggtccggtgctagccttctcctgtatctgtgagttggcactgtcagtgtatgggtagtggtatacctttttccttttcctggttacgacctttcaagtttgtaatcttgtaattttttttcttgttctatccatagaatttcgcaccatatcgtgcgagtcgttaaaaaaaagggagaggggggagcatacatgtttggaaagataacagcaggggggtttccagaagggattaaatattaaacatctactaatgcagtcgcttccatcattgtagaagaataaaacggtgggacataacacgacgcgaaaacaaactccaaccctatccaccattgtccccatggacccccatactgtttcttgctgctaatagcagctaacttcgtaactggatagggacgctaactccccgccgattcctgtaatgtaaaatataatcttgtttatactagtactgttttttagggggacatactcaacaaataccatattcacggtaccaatcaggcacactcactcatgtactgatgcacatgcatctagtacacatgttcgaaaattacgagacaccaaatcctatgtgagcgccgcaaggatgcatgcatacccagacatacgcaattatgcatgttcatctctctcagaaacagtgaacatgaataatttctctgtttcacgttataaaacgtctggggtttttaatatattcatgtatgaatgtatgtatgagtttgaatttatatgcatatcagcgaatttagacgagcatcttatagtgtggatcggagggagtactagatatccatgtttgatgtttctaaaaaagaaaaagaaagaacataaccatgtttgatgtaaaataacatcacctgaccatttggatactatttttttgaaaaaaaaatgatcatgttcctactcctacctctatgaatgaaaggaacaaacccactgcttattttttttctaggagaacacggagacagagagcgtctcaacctccggactccagagaggtttcttgtgcttgcagggccacgttgaggatttgccattggccctgttttgatccaagggttagagttagtttctagctctcaactaactctgaactaactctagccctagaggtgtttggatggaagggttagattgacaataaatatacttttccaatcatttggctcctttccaaccggatttggtgtggcagactcatgtgtagcctcctccctctcacaaatgacacaaacaaatcatatttcaacccctccgccgccggcgcctatgagttgaggtcgaagccgacgccggcagaggaagcggtggcagggccactcgccgacggctgcgaagcccacgcgctgaggtcgtcgaagccgtcttcgtccatgcgtggccggcggcgcagatcggtggaggcggcgacgcggatggtcggaggcagcgcggctcggggttggcggcggcgcggttggagggagggcgcggcgcgggtagtgggggaggccacgccgcgaggatcggcggcggaggcgcggatcggggacggcggcgcggatctgtggcggcggcggcgtggatcggggaggcggcggcgtccagcgagaggatcctgtgcgggatcgggaagagatggggatccggtgcaagcagagagagagaaaagtggcttctacggtgggccccactcaaactagctccaataagcacctcttgaaggggctagtttttttgtgggttagatgcaactagccccaatctaactcctcatgtttggatcctttaaggctatttgagcctcaactagctcaaactaactctaacccttggatttaaacagggccattgtcttcattgtaattggaa

SEQ ID NO: 58447 - DNA, 2323 bp, Oryza sativa
gcgcggaggcgagccgtcgtcggtgccgcggggcttcctaattcctcccgggggagtgtggtcgagtgggggtttctggggttcttcgccacttcgccgcccgccggtgagttcgcttcctctcttccaagttccagtaagggcttgggtcactcgattgatgctgattcggcgcgtttcgcttgactgggaagttcgtcacgcgattgtcatacggttctcgcgtaattggtggcgtgtttcgatgagaatggccgttaggcttagcttgtagactgtgcaagactgtttttaggctgttgctaccgtggtctgtttggtgagaaaatggctggccttcctgattccttgtggtgttcgtagtggaatttgatgggggtctgatcgttgtggggggtcgcttgccggtgaaggaggctgctcttcggcaaatggttgggtgggtgggtcactgggtgctcaccgttttccggatctgggattctgaggtactgaaggtggtgtcgtctgtggttggggagtggtgcggttttcaagtttaggggcgtgtttaggacctgatgatgcaattgtaaatttgtaatacgatttgcaacgtccatatgtccacagcaacccaaatttattggtatagctctgatgaaacttcgggagtttcatttcagtatccctgttggtgaaaattatctcttctttcttgtattttgttcatgaagagtgatacaattaatagtattgccactgttactgtttttttctgaaaaaatttggcgccttcttttgtcttaacctgcttggatgatacgcatagttaatcacatcattaatccattatgctgtaatgatgtgtgaattttcttacaaactttgttttcttttgcagtttagtaaattcaacattttggacctacatgagttgataacaagtccattccattgtccttcatggaggcttcatcttggttgtgctaccaagctcgtggttttggttcatccagagtatggttatggctttttctagctcttgttcttctgaattgcagcctggtactctcagcctcgccgtatctggtcggtatggggagcttcgacataacaggacctgcagcagatgttaacatgatgggatatgcaaatactgagcagattgcatcgggaattcacttcaggctgaagtcacgtgcatttattgtggctgagcctaatggaaagcgtgttgtgtttgttaatatcgatgcttgtatggcatcacagattgtgactataaaggtgcttgaaaggctaaaagcaaggtaagagttaacatttcttgcgaccttattaatgcttgcatgtttgttgcaactttatgtgatatgcgcttatagatcgtgtataaaatgatccatcaacctttctacatgcatggtatgttccccaaaaaagcagacccgtaactcattgtcaagttactcatcatcatggattgagaatttgagatcctctgacttacttccctttgacttggagtcactgacatgtgggcccgctacctaaagggccaacatgtcggtgatccctgtcagaggtaagtaagtcataggatcctcttcctcaccatcatttgttgatggccgtcttattgttttcaaagattgttcaagtgaggcactgcctcaaaatcattggccattttgcaatgcatgttgcagaaacattgaggaacccagatgccctcatgttcactggtatgatcttgtttgaatctgttatgtcccaaagctcagtgaggcattatagcacgccatcatgtaggctggtgctgacaatgctgtagctaaggtactcatgttgcttgtctgttgtagcacgcctagagtctcagtcgagtcactttgttggaagttggaacattatctcttaaatcgactacctactcaacatggtattgtatttcctatgggtaaataaaccaaatttctagtttatattttgtccaactgaacctcaaaaccttgacttacagcatcaggattcttcccagtgcttctggccagccttgagacccttatgcagccatgcacctaataaagtctgctcagtagtttttcataacatcagggatcctcaaatttgcaggtatggtgatctttataatgagaacaacgtggctatcagtggcatccacactcatgctgggcctggaggttatcttcagtatgtagtttatattgtcacgtctcttgggtttgttcgccaatcctttgatgtaattgttgatggcatcgagcaaagcattgttgaagctcataacaacctccgtcctgggaaaatatttgtgaat

SEQ ID NO: 58448 - DNA, 1103 bp, Oryza sativa
tacctaaataatcctgccgaagagagaagcaagtacgagtataatgttgataaagaaatgaccctcatcaagtttgtagacgatgaactgggtccagttggaagtttcaattggtttgcaactcatggaacatcaatgagccgtacaaattctttgataagtggtgataacaagggagccgctgcacgcttcatggaagactgggctgaacaaatgggcttgcccaaacagtcagctcatgcaaattctgatgatttgagatctttgcacaagacatctgtacttcctcggagagtttctactataattcctgaaccaaatgagataagtatgaacctgaaccatatgccccttgatctgtacacatatatcggtgaaacatgttgggtcatgcctgaacttttattttcttcaattgctgttcagctgatgacttgatacaattggcatcatcctatgaggcctcaggtggcaggcggttggcaggttcaagtatcactaggcgcattagaagtactcaacaaaacaaacctaaatttgtttctgcattttgtcagtccaattgtggagatgttagtccaaatgtccttggaacattttgcatagacaccaatcttccctgtgacttcaatcacagcacatgtaatgggaaaaatgaactttgctatggacgaggcccagggtatccaccatgcctgaaaagtttaataaccttcctgtacatctgctagaaactgttataaatgaggttcttctttgctgctttgcagataccctgatgagtttgaaagtacccgtgttattgggaataggcaatttctaaaggctagagatctctttgattcagcttctgaagaaatacaaggcaaaattgactataggcacacttatttagatttctcaaaacttgaagttaaagtttctacaagtgcaggcggtcagcagaccgtgaaaacatgcccagcagcaatgggctttgcttttgctgctggaaccacagatggccctggagcttttgatttcagacaaggagatgtcaaggtttagcatgtcaatacatagtagcttcaaaatttgggtaacatgctactcactggtttata

SEQ ID NO: 58449 - DNA, 1530 bp, Oryza sativa
tctaaaaatgtcactcgagaagccgtgcaatagatagaaccagtaatgacgatatgcaatatcaaattttcaattttcactgtaagacatgaattagagatcatgtagagcaaccgaccattgcaatcgcagaacagtccaataataacagtaatgagttcaccaacacagttccatcggtcgctccccaatcagcgagaagatacggcagtaaactagaaccattcactgtatcagactggttcctgaggaaggggttagttaccgagcacgaagaaagcgacaaagaaaacgtacgaaggcgcggttagccggagaggtctcttcgtcgtatccattgcgagaagctgcgccgcatccacctccggcggactggcggcgcgccgcccttcccgtccatcgccataggcggcggcggcggcggctaagtgggttttttcgcgttccgcgcggagaagaaaagctgaagagccgtttccccgtctcttcttcattacagcgacaccaacgttgatttccgctaacgacacaggaaggcgtattctggataatgggcccacttgtcagcctcccgtgaaccagatccaggttcccaccaaacagaaaaacagaagctccaccactgcatcgtagtcgtcttcttcacgcgcacggcgcacccagatccaagcgtccatcgccgcggccgcatccgccatggctccgacggcgcccacggcggcgaagtccgcctccccgtcccagccatccgggtgcgccaccctcctgctccttcactcctgacggcatctctttcatccccaacctgaaccctaaactgaccaattttggggggacttgtgagttgaggtgtgcaggaagagcgaggtggcggatctgaagcagcagctgcggcagctggcggggagccgcgcgcccgacgccgacgaccagcggagggacgtcttcaagcgggtgatctcctgcatgacggccggcatcgacgtgtcggcggcgttcggggagatggtgctctgctccgccacctccgacgtcgtgctgaagaagatgtgctacctctacgtcggcgtccacgcgcgcaaccacccggacctcgcgctcctcaccatcaacttcctccagcgcgactgccacgaccaggaccccaccatacgcggcctggcactccgcagcctctgctccctccgcgttcccaacctcgtcgagtaccttgtctcgccgctcgccactgggctcaaggaccccagtgcttacgtccggatgatcgctgctgttggtgctgcgaagctgtatcacatatctgccaccgcctgccttgatgctgacttgcctgcggcgctcaaagcgcttatgctctctgatcctgatgcacaggtgagttgccattccacaaacaatgttgtgattatcatgcaactatgatgctgctacctgttgcaatgattcattatctgtagattatagtgctcacaataccgtttaattaccaccgaaaagtctatgacatctgtagtgctgatttaaagttgg

SEQ ID NO: 58450 - DNA, 1958 bp, Oryza sativa
tcctgcctgaggcttctaaccaagtgggttttacctctgatttgtaagtgatcttgcacattcactcatatgtgtaatctcagatccaatccaaaatacattgtaatataatattatccaacccgcctgttcactgtatagactgtggttataccaggtagagtgacacggtttgcccatgactttttgtactatgcttgtttgttactttgtgaaaagcttaactgaattgctagtatctgttgacttgagagagttacattatccttttaggtggctggttagtgattacacttgtgaatttgcaggtagttgcgaattgcatgcatgcattacaggagatctggaccctagaagcagctaagtcagaggaagctgcaagggagattgagacactatatagcaagccagtagtattttaccttcttaacaggtagattaccacctacttttttttctgttaactactctctcagtctctaagtagtattttaccttcttaacaggtagattaccacctacttttttttttctgttaactactctctcagtctctagaagagtgtagttttagcctaatatttttccctagaagagtgtagttttagcctaagatttttccctaaaagagtgtagttttagagtggtccactgagcttctttatgactacgatatccttctcatgtcatttttagccactgaaccgatattattccctcctcctccctcattgttttctccccgtcgttttctctctgaattaatgggcatagtagtcttttaagtttcaaccttgtgctgtaatatgtctttgactagctagaactacactcttttagggacgagagggaatactcaataactctattccgtgcatacttattgttttatttgtcattgcaggatcaaagagttcagtgagtgggcacagtgcctcgttctagaattagtgtcaaacttcctaccatctgataacaacgaaatttttgacatcatgaaccttcttgaggacagacttcagcatgcaaatggagctgttgttttggcaacaatcaaagtttttctccacttgacaatgtcaatgactgatgttcaccagcaggtcttactcttgcagcatagttttgatacttacgctagtggaagtttgtcactgttatgcatacagatatactgaaattccattttgcataactaaagccccacataaatgctttggaagtttatatggtctgataatttcttcactctgatctgagatcacctggactgtttggatttttatacctttttgttgtatggatttcatttgtgacattggttttgtgcactttatagtatgaaagaagagacatgactgatgatctttgtaatcattgtttgcatactccattgtaggtttatgagcgtataaaagcaccactgcttactcttgtaggagctgggagtcctgaacaatcatattctgtgctatgccatttgcatcttttggtgatgcgtgctccaatgctattttcctccgactacaaaagtttctactgccagttcagtgatccttcatatgtcaagaagcttaaacttgagatgctgactgctatagcaaacgagagcaacacctatgaaattggtacagcagatatctgtttccattgattatacatcggcatatctcacaacatatgtgatatatttttaactccatgattttcattatgtttataaaattttgtggccttctttcgttccagtaactgagttgtgtgaatatgctggaaatgttgatgtaccaatcgcacgtgagtctattcgagcagttgggaaaatagcgctgcagcagtatgatgtgaatgctattgttgacaggcttctgcaattccttgaaatggacaaggaatatgtgacggctgaaactcttgtaagtttttttgatagtattttaactgttcatcattcacta

SEQ ID NO: 58451 - DNA, 878 bp, Oryza sativa
aagacctacaccatgcgtccactgcctctcaaggcctcccaagacattctgagattgatgcatcatacatatcgcaatcaaggctatcagttattcgtgagcttctttgaaatatatggtgggaaattatttgatcttctcaatgaaaggaggtaagtagcccccaatcaattatgcttatagacagtatatattcaggaagcctgttacatcttcttgttcgaaacatttttgacttcatgcagtaaactttgcatgagggaggatgggaaacagaaagtttgcattgttggtttacaagagtatcgggtgtctgatgttgaaaccataaaggagttgattgagaaaggcaatgccaccagaagtaccggtactactggtgcaaatgaagagtcatcaagatcccatgccattcttcagcttgctattaaaaagcgtgttgatggcaatgactcaaaaccacccagattggctggcaagttgtcgtttattgaccttgctggcagtgagcgtggtgctgatacaacggacaacgacaaacaaacaaggttatctcacaacttttctcttctatcttgttataggaatgccatgaatattatgaaactgcctattatgttgaggtctgctgtactgaactgcctattatgaaacttgatgcagaattgaaggagctgagatcaataaaagtttgcttgctttaaaggaatgcatcagagcactagataatgaccagacccacattccatttcgaggaagcaaattaactgaagttttgcgggattccttcattggggactcacgcactgtcatgatatcatgcatttctcccagctctggttcttgtgaacatactctgaacacattgagatatgctg

SEQ ID NO: 58452 - DNA, 7914 bp, Oryza sativa
cagtaggccaccgtaccatgcacagcacatgtaggaattatagcgttttacttccacatatgcatgagacagactctcctctcagttcttggagaatcctcccacagtggctgcacgatcagaagatccaacttttctagaaaacgcccaaaattgcgtgcaaatggctacttgcaaccttttgttggtcctaggaagaacgtccttcttggtgcatgcgtgacaaaatgattgattgatttgttcacgcccacgtactggccgtagctactagagtagcagctagctagccgcggacctcccttttcacgaactaatttccttgtccttagagtcggcaagaaatcgatcagatcatccacactagctgggcggtaatgagaatctcatcgatcgcacgttcagccagcaccaaggccttgtaggttgtagccactcaagttaattagctgaaacggagcagagtcaaaatttgactctctggctcgtgtagcttttgataaggaggttttactttctaattccaagccttgatcatcagttcatcacaaccataaaatgagtgaacgcttatatggctgctatttatggtatactaatgaaagataagcccttctgcgtgtgcccgcagtgttatgttgtgtaaccgaattgctttcttctaattgaatgatgtgcaattgttctgtgtgttcgaaaaaaataatcaaaggtaatggcagaaggaagacggaacaataacaccacatatgaacatctaatagtgtgccgcctaaaaaatataatttacacggaaggccatctaagatacgtccccatgtaaatatagatatttttctagtcggcacttcaatgaaaccgtctgcgtgcgggtggctgcttaaggtagccgctcgggtaaattgaaacaatcttcacgtgcggcggttgtcagtggtcacccgcgtttttatgtttacacgaatggctctctgaccctttgacacaagagatatcatcattcgtaaccataaaacatgcattttgtattttcatccacttgggaaattaatcgtgagggacctgcaaaaacttttttttgaagtagtgggagctagcacactggtgttgagaggtgtcctaggagaaactggagctcgagctagtaacaatcaacaagcctatgttagatatgaatataatcaaaactgaattacggaataatcaaaaccgaattgaaagtcgattatatggagatttgagatagatatatatttgcaaacatcgaaaaaggcaagatactaaagcactttcaatatctaagaacctgaaagatgaagctatccctgaagtgacctgaaagatgaacatgaaagacgaattacctccttgacaaataaaaaatagaggggtccacttgttagttctatctcttctttcggtcaccatatggcagttcaatcagcactaaaaaaagtacaaaaaggtagagcccacatgtggtgattgagagaagaggcagaactaacaagtgggcccccactattttttattttgttgactaccacgtgtgtgctacatagaatcaaaaccgttctggattcggtcaaggggtaattcgtccggtatgaaaagttaagagtgaagaatatctatttttaaattgagggggataatacgtactgttacaatagtttgagaggtagagagaggggtaattcagatttgtttttttcccttaattaatctctacatttaatttgtgacttgtcattcctggatcaagttctagagttacaatgttccatgaagatattataggcttaagggaaaattaacatgtactcccttcgtcccaaaatatagtaacctaggatgggatgaaatctatcctaggacaacgaatctggatatgtcttatcccattctaggttgttatatttttaggacggagagagcaacaaggtatttgtacttctatatcttgtattgcactttattatgtattagtgtgccactatcgaggagtttgaggataacaactggacttgaccagggcttgagaaaatactaggtccgttaacgcagacatacacaaaggctgatagctacttaaggccatttacaacccaataactaggatggtgtccataacattaaataagctgccacctaggatgaaaaatgatgtggcaagtgaataaatgaggaaagagaaggaaactatatcttgcatgagacatgacttctacacaatatccaaaacatcatgtgagataagtagcattaaatttaaatataggataattatgtttacattggaagagtagtgtctagtaggagtagtagtttcttaatgatgtggagtttatgaaaactatgtctagtgtcttgggttgagaatggccttagtgatcctgtccttgctatatattataggattggcaataattaacagccattctttttcctctcttcttcttttagatattttctttttttatttcaagaacgttagttgagctagcatgcgtcctttttttaaaaaaaaataatcaagatcttctctcttgcatgctgtccttaattaagagaagaaaataattgagcatatgaattgacttgttagttttaatttacttgattctccaaagctacctaccaattctatttctacacctgaccgtcaacagtattgatagtcgtcagcaactaactactaatttgccccatatatatatatttatatatatgcttgcacgagggataaccggaaaagaagagtttggtcaaatatgacggcagagggaataaaaatgatggcactagactgtcaaaactaaggaattattcagctatatcgagaggaaaccgagacatgctcgtatctgcaatccgtttaaaaggtgcaacttttgcgtggcaaagatacaaaatacatgtgtgtgctgaaggagatcgagcctttttatcattccatgcatgcatgcgtgaaaggattagaaaatacaccatctgtgcactcccaaagcatgtcgtgagggcaagtattttgcacgtctccttcacattttgtgcagataaaatttcgtaaataaacttataatcaaagtggattcactcataaagagaaaacgtatgcacgctagtaaagactaatcttgaagaagtatttatgcttgccctccgtcctgtaactgaaaacttactggtactccggcacttgcaatattaattaatactagtatatatgcggatttatcgtgtacatctaaaaacttgcggtcacaaccatatccatcagaccaccgtacgtacacatatattatctcagttttataatatatgatgtcgttcatttttttaactaacatttaatcattaatcgttttaatcaaaatttttgtgtaaatataaaaaaattaagtcatacatacgtaaagaatttttaacgataaatcaagtcaaagtaaaataaataatagttatatattttttaataagataaatgatcaagcatacgttaaaaaaattcaacggcaccatatcttagaaaaacgaagggggtacatcttggggaattaatatatcgatcatgatcattcatagaacatataaggccagataaaacatcagattcaacacatgttttgattagataccatacaagaatgtgaaaaaagaagaaataataaatgtgttatgttgaactgaataacaaatagctagcgatagacatagatctaacgcaaaaccggcctgctgcaggtactagctagctaatcgaatatgagaacaacagtattaattatcatttacttattcttgtgtcaaaatcccaatattacggccatctgctaccaaacaaaacaagcaaaccatgcatcatgataaggctatcttatggacactaccacaagaaaccggccagttcagtgtatcaatgtccaaagcaatcagaactctctcttttgcaccgtcattgtgtattaattccagatttatacatatatgtaggcacaaaagaaactacacacccgtcattaatttgtacaatctaacaaccaaaagcgggtcgatcatgtataataagttggcatcttctttgattgtcaaaagcgaaaatgtgagacgaaatattaattaatttgctctctccgaaaatgagtcaatgaggtacacatgatatacactagtacatgcatgtacaataagtctagaggtgcagaacagtaaagggctatgctgaagaatcaagtggaatgcagccgttctagttataaagttgtagcttccatctctactgatccgttcaatttgcaaccagggaaatgttgacaaatggaagagagaaaaaagcatgaagtgcacaacacacacaagttacgttcaagatgaaaagcttgcagaaaatcaattaattaataacaattatatattctcaccaagaccaagctgatcatcaagcactccctagccatcacatttttggcgcaacgactccaatgtttgaaaagcatcttgataaattccgggtgctagttaaatattgagtagtatatatttgtgcagaatcagttagatcagtcatcatcatgggttgctgctgggcattgtggaagggaaaaggtcttgcagcagggcgtagtcagtgaagtgatgctgctgaagaggaggatgatcgttgggcggcattgcaccgccgccagccacagcaggaggcggcggagcagaagcagctacgcccgggaagtacatgctagggtttgcggcggcggcggccatggccgggtggtggtgcatgaggcccatcagctcagggtggaaccccgccggcatgaggtgcgacggcggcaggccatgcacgccgggcatgaagaggtggtggtggtggtgccctccgacgatgccgacgccgccgccgccgccgcggaggctcgccgggctgtggtgcgtgtgctgcccttcgtacgtggtgatcaccgtggaggggtcctggtacgaccgctccacccgcttcttcacaccgcacttgggcgtcgtgcaccggtagtagctcctgcaatattcgaattcgaattgaattgcattttgaaattggagtacttgaacaccatcgtgccatgcaattgtatggcacagtaacatggtatactacgatatatgtatgtgctacaacaactgggtgaaattaaggtttgtacatgtatatagatgtgtacctcgggtatgggctgttcttgactgccttctggccgtacttgcgccaccggtagccgtcctcgaggtgatcaacctcgctcttggtgaggaacgccacgcgaggctgccgctgcctcttctcagctttcttcttgggcttgttcctgtgtagatgcatggtacaaaatatcaaaaataaggtcaggtggattagctagaaacagagagatgatatggattcagaagatcagttgatatttctgcggtgacaagctcaatcaggcctaattattaattagtttgggctttttcagagcaccaacaatcaaactagctaactagcttgctagataggtaggatcatggtggactatgggaatagctagctatttcatgttagattagcaccaggttttgctagaaatagttgttattttgatatatagtattaattagggtctaataagttagctagctagctagatatctgttggattgcatgttatggggcaagatcagcgttaattttgcaaaagtactgaggaactattgtagatttaggtggttggtggtgatacgaaaatatatcttaatttgaatcatttctaaaaggggaaatcataatataatcttcaaagacctagcaagtcaaaaattgaagctataactcgtaaaattgattcattctacgcaagatctattatggagcataggttggttgtctattaaattaaatcgaatagtagtagccccatcgtctgaaagatcatattggaaattgggtcaaaacggaatcagaagaaaaggggaacaagaggatagacggatctactaaaaagaaccctaaggaaccaaaattctagcaaaccctaatgttcacaccatgcatgcagtagagagaaagcataaacgaaagaaaatttcaggtcaaattttgcaactccgcaacagtatgaccaaccagatctagccccaagaaagtatccccatctcaagacacgcatcaaaaaagaattaatcaagcaagaaatcaagacaagaatcagacaaagtatagagtagaatcaatggaaatttaacatacggtttcttggagttctctccatcctcctcatccttgtcgtcctcctcctccgccttcgctgacccttcttgcaccggcgtgacgatttgccgccctccgcctctccgtcgctggacgagaaggacgccgacgagttcggcgtggcctgcgcgacgccttctccggcgacgccgccggtgccctggctgtcagggctcgtcacatccaccgacagctcctgcttgaccaccgtgtcctgagacgacgggcacgccacgtcgaggtgccgagctagcccggaggggtccaataacccctgcaggtagtccgtgatgctggagtacggcatgatctcgtcggcaccgccggcgccgacgacgccaccaccacccccgccgatgccgacgcccccgggttggctgaagaagaagctctccatgtcgctgctgctgtacacgtaatcagcgccttcgccgcggccgaggtgcccgtgctggtggtaggggccatggcgatctcctcctcctcctcctcctcctccagaagacatggggtgtgagagtatggggagctagcttatgtgtggaaaggaaagagaggcgtggaagtgaggagggtttcagctttcaaccggtctcacctcccttttgatttgttttttctttcttttccttcgctggaaaaggataggcgcaagatacgactttttgtgatggaatatgtaaatctgtctcggtgcggcgtctagtgatcttcgtttatatatatataatactccataattccagcagtactattaatatatatacacacatatatactagctagctagtcgtcaattcttaatggtagagacgttttattaatgaaatcagcgtgcttaatttagattcttttcgcatctgttggtcagggaggtattaggtataagaccggccagtgtcaacgtaattaaattgtgtagggcctgccgtactatgaatagttgaatccatacagttcagcttactgtatgctgaattaagatactatttcccggttggagttggtatatattgggcatagcatgcatatactatgtacatgttttgtgtccattaatttgagcaatgtaactcacttacatccaccgcgttttaacggacatctacggggatccagccaagagttcgaaactgtgcatgtgaatttcgattcaaatgtttatgcatgatcaggcatgcttcaagattttaaatgatttgcacagtacactacagctctttcttgacatacacgtgccacacaagtaccgttttgaaggatgacatgtatccatacgtatatacagctgtacatatttatagttggatattggacgtacggctgtcacagtacccttgcacagtgcacagctaccaaactactctcatcttattaaggacaaatatttcattcggttaaaaattagagaagaaagacgtcaaaaaaaaattcgagaagaaagacgtacgtctaaaaaaaatcgagaagaatgttcattgcaattgccttctgatctacacaatctagcattgacctcatggtccaattgaataacatggcaaaaaatatagtagtatatgcgtgtgtatctgtgagatgtgtctacatcgaacatgtacgtctacaagtttttaatttctgttgat

SEQ ID NO: 58453 - DNA, 4485 bp, Oryza sativa
tcgtcggcatatatatttagagaaagtttagggatgaatatcctgaaaactgtatttttctagaggaagatggacacggatgattctatgagctgtggttcgtctatctaattaattttctagtcgattgattttcacgtggaaatactgtttttttatgggttggttattttcgagttaggatgtttttttttagtggaaaaggagcgatggtctggcaggaggatggcaccgctcttacggtacgtagtagagataatggattcgagtatgtgctgatcaaatgaaattaatctgtaggtgatccctccttttttcgccatttttatgataatgaggaaacacagagataaatgataacgtaattagttcctagattaattatagaaataccccactatatcaattaaggtttatattatggctgcttttttccaagactgttgattgatgagttgtctgaagatcaaacaatataaagaagtatagcaccttcattattcaaaattatatactccctcctttctaaagtataaagtataaggtgatttagatttttacgtggtgatctcctatgttatagcttgaccattaattttttgcatgatataacatcggcagctacgaaattaacatcatataaaaatcttatcaaatatgaatataatagtactacatgtaactaataaactctcacgtattgtaaatttaattattagtagtacaatttaaaatttttgatttttataaaagacgggtgcattatattttacggatggagtaacatacttgacgctggcatagtgatctatagatacgggaattgatgccagcgaaacttattacatcacatatagatcaacattttttacaagaaaaatgatgttatgattttcagctgatcaactctttacagtactgtgtttggtatattttctggtaaaagtgaaaaaaaaaactatatcattcaacatatatattatactttttatatactggaagtattacaaattaaagatatagttattccttatttgcctcaactcagcgtcccacgtttttttactgttatatcagtcgcatgcatatttggtcacggctagctgtgatttgggatgcgaagtatgtatgctgaccatgaaactattttaatcccttgaaaaaaatatctagctcctttatttaaaaacaataaataaaaacaatccgaagttatagaaaaatcttacaaaatttgacaacactcacatgacatatatatattagttaacaaaatttttggtataaataaactcaactcacttatcgagatataataaaataataaacttatataaatagtagggtactgttaacatttgaattcatttatttttcaatatgtaggtcaagtttaaacttaattttaggggattgatagttgtcactatactctgtattaccaagttattttttaaaaatatttcacaactaattacgttaaattaaaaagaaaaagttacacgatgagtatttccctcgagggattatgctaacccagcgcgtgttatttggtctagctaatttgggagtcataaacgatactggagatcgagctggtacttagcttagagaattactacctttcttgaacatttttatattttaaaggaccgtcgtttgattccattcaaatcaaaatccaactaaaacattataagataggaaaatatctccctattagtaaaaaaaaatctccagaatatagcaacgaaataagcagagacccgcttataaaaaaacggccggcgcacgttgccccacggctactggctggtctcggttgttagagagatcacgactctctcatgttttcctcccatgccacgagtcacggccggccggccagcgccgcgggcgtcgcgtcacaccacgagcgcgcgcacagtacacggaatacaagacgcccgtacgtacagccgcgcagctacagtcccccgtcacgttgggctcgctcgctcgcgcgcggcctgtgcactaacggcgtacgtcgactctggtgtacgtacgtggtggagaggccggccaccgggcacgtctcgccgtaagctagcgtataccggtatacgtcgatcgatcggcgcgctgcgcggcgcagcgcgcgtggagtcaaacttccccgcgcctgcacgtgcgccattagctatctaagccggtcaagcgcgctcgcccaaatcggcaaacaacccggcggaacccgatcgacgtcgacgcgcgcttgtcaccgagccgtgtaccgctccgccggccacacgtggcgtggcccgtcggccatcgcaccgtacgtggaggcgaagcatcgatcgccgtctacagagactcctccggccggggccgcgcgcgagcgatgggtcccgggtcccgggcatgcatcgatcggggccgtaattcattcgccggcgtgcgtgcgtgcgtgcgtgcgcgcgcgaccgtgtgaacggcccggcgccgcgatagtacgatggctggtaggcggcatcagtgggcgcgggaccgggtgggttattccaggccctctcccgatcgagttccgtgattccgtctggtttcctccgctgatctccagggatttccgagcgtgcgtgcgtgcgcgcggatcggacgagatcgacccggggccgggccggggagcggctgcgcgtgtcggcaggcaggtcaattgagttgaggtgatatgctgttggcgtggtgggtcgtggacgcgcggggggatctcggatcgatcttgtgcgtgttcgtgcagcgcgcggcgcggggtggccggtggacgcgaacgcgacgtatataggtggtgtagcgcgcgcgggtggggttgggttacgtggtggagctgagcccggcggcgcgcggtttgttccgccgcgtgcgcgtttcagctcctttttcggcttcttttttggcgatttgattttgatgcctgctccccgatgtgtccatcgggtgtcggttctaccagagacagcggggccgggccgtgactcggacaggtttggagtttttcgcgggaccggtaacgtacgtaggtgctgcttccttcaaaaggtgggggtgagccggccggcgaatatgcacgcgcgtgtacccgctcgaatactcggtcagctaatgagatgatttgggcgtccgtggctcggtggcggctacgttcagattcagcttcatatgcataccgtacgactgtcaattgtcatgataccgacggttacctttttcgtcgggttgaaatataaatgctaataagatgcggcaatggtgttagcgtagcaaggcgaggtatctgtgtgaaaatgaggaggaattcatgacagagatgctgattgctgagcggtacatatgggctggcattgccgaccaaccggtgactagactaccatactggtacagtgctactcatttctgagcgactgttgttttgtcccatgcaggctgcaggctgacctgatcaattgggctgtcaaaaatgtccagcccaaactctatggtaacgcagcccaatataactacgctcttttgggcccatcaggtctctcctcaagttagagtcgaagaggcccacgaacaagccaatattaccccccaaatcaccgaaccggaagggatcatcaaaccccagaacgacacttccgcacagccctagggtttctgttcagcgaccccccgaatcgaatcaagagggaggtgccatggcgtcgcggccgtcgctgaagccgaagcccaaggtcaagggcgcgaggaagggatccccggcggccgacgaggagcagtccacggctgcggcggcggtgcggttcgtcaaggagtggaccacgtggaccatgaagaagaccaaggtggcggcgcactacggcttcatcccgctcatcatcgtcgtcggcatgagatccgagccgaggccctccctcgcccagctcctcagcccggtctgatctgacgatcgccttcaagccctagatgcgatcgatctgcccccctttactaccgctttagtagtgactttagtaatagttctttcttagatcgtgccttctgagcagttgatgctgctgtgcggatttagaggtttttgctatatgaatctaataatgttatatgggtggatgcttctttggattaaactcttgctattattgtgcgggtcatggatctgctattaatacttcggtatggtatggagaaattttctgtgttatttgtatattcctactccttccggttccattttaattgacgttttggacaatgacacggtctaaaagatatttttaatcttacttttctattataatatatgttgttctagttcctttaaactaaatattttttaaagttattaatggtcaagttataaaagtttggcctcaaaccggagggagtacatgtttatgcttctgtgtgacctatttagctttccgatccgttctgattgaagtattgaactactcagaa

SEQ ID NO: 58454 - DNA, 2815 bp, Oryza sativa
cacttataattagtgacataaaactgggacaattattgtgtgtttttgtggatgtggataacttgatttgcaaaacagcaagctcgtggtggcgaggaaagattcagaactcccattgcctaatgaattgtggactatgctagcagcgaagtggatgcgaccagggttttcgatttgacgaaagccgatcgaataccgtgaaaatttgaggttttgacatgggatgcaagtagattttggatgaaatttcaaatggttctttagaattcaaatttgaaacaataattcaaccagaatttgatcaaaacaaccatcctcaatttgatcttactgcgtttttctattgatttttatttataggaaaaaaaacctgccaaacacgggcagatccaatttacaataaacttgtccgtgagcattgcaagctaagtttcacaagtgcaagtaagaaatcagtcgatttacttcacaatgtaaaggggcttaatatgtgtcacttcatattggtagaatgaacagctttattgctctgtgcaagtaagaaatacggagtactaacatacagaagcagcgctgtatctatattgtctctacatcgacaaaacaggtgacattcaccttcagaaacacaagaagccacaacaactcacttctccagatgaaatatacgacaatgctaatttttctccaccgagccaccataaatactccttaaaaaactccagcctgtgctctccctgctgtatatgctgttgaggatgttcaaactcatgcttcaacattcccattaaagatgtaccaaaaatctttaggacgttcaaggatgtggtaggacaagcagagaaactgacaggctcatcaccaatataaaatgctcaggatcaagaaagcccaaatttggacaaagctgactgaaacaacgttgaaaatgcctctgcagcggtcccatcatcagccttcactttgatctgtgccttcgctgatgctgtgttgacgatacattctacaaggaagaaagcggtagcaccatccttttgagcatagaaaaagaacttgtagtttgggggctggccacctgaagcaatacactgaatgtagttgttttgcatatgtcgaatgagtgattgaggattcatcaatgatgctgctccttgtggacttaatgaacattcctgacaacataaaaaagcgcacaacgaaagaaaatttaaattgtataagggtcataaggcgaagcaattagaacatgtaactattaacttaaggcttcccgattgacaatgaatttatttcattagaattaaggattgctatcataagaaaacaatagcactttaacaaggccaatcattactcagaacatataactgctgatttcaaacacctcatcagagtgactttcatgggaagacacttagtatttagatttagacaatagcagcaccccataatttcatgctaaaatagttcaaatttgagtgagcaactacaaaaaggctacatgagcatgttgctgtacaaataatcacaaaatgcatgggaaagaactcagaagcaacatacctgagacaaggataaggccagctggccccatttcttctggaaagtaccaggatccagcacaggttttgagttgagggtcaatgctggagctggtggaggtgcagaggattgtggaacaccaagcccaagaaggtcatcaagactgaagttggactgtgacgaatatgtaggtgcaccaggatttattagtgaagtttcagacggtatttgtgaactaagcaatgaaggaccactcaagtctgaaggagcattgtaggtagaggcagaagaaccattgctggtagctgttgcattgtcctctttatccgaagtacttagcaaaagatcattatcactttcttgatatctttgggctgagatggtgttttccgtcgtttctgccccgacagccaaattcgtaagatcctccgagtactcaaatggtccacgatgctccttgtcagtaaacatgtaagatggctgccaaatgcaaagataatgtcatattgatacttcacatgtatttgttcaatagtagcatgagtaattatattagagtagctaacaccaagagaagtacataatggacttatacagaactaataaagtaataatactgataaaagtatccagtaaatgcattatcaatatttaattttgttagcaatggttgaatataaaaaaaatatataccttctgatataccactgataggctgttgaattcatcaaatatccgatctttgatttcactgctctgcgtatctgcaaatacagagacagcttgcttgggagggtttacaacacgttcagcaacagcaggatcatactgcaaaagcctatagtagaaaagtgctcggtcatgaacatcctgcaatcaattcttggcagttaagctagagctcatagaaatgttacagtaatcaaattattatcagaaaagatcttgacctggtgagtgtcagatagaccagcggttaatgtagctcctagtgccatttgtgtctctggtggcctcttaaagaaacatttcatcaccgcagtcaggagatgcaagcgaacctgcaaagtacaatattacaggaataatgaaatagaattcaaaaacaagtagctacaggcatatgatggtctaaagaaagggatagaattttacaataatgtccaatgactcactaggtataagatagcaattcaaaagaaaaaaaacaatagaatcacccttagtttttggtgccataatatgtgaatttcagtctggcacttctattttg

SEQ ID NO: 58455 - DNA, 7613 bp, Oryza sativa
tttcagttctaaacaagactaattcagcatggtccactggaacggcaatcattcttcattatgcaacgactaagagcaggtacaatagcaggctataagccagctacaaacatattttaagcagataaatgaggagataaaagggcagcgggttacagatttgtagccagctgtagcatagactctaagacacagtgtgtatgacaggtgggaccagatattaatagtgtagtatgtaactattgtatgaatgagctattaaattggctatagataaattggagctagtagttgactatactattaaacttgctctaaacaagatgtaagtacaaatttcccagagccttcgtgttatcctttactaggatcatttgactagcaatgccatcctacacttctgtctagcgaggaaaccgtatcttacacaaccaaaaaaattcatacaatacaattttatggtcggtaactcggtaatgcatcggctgtgaccaactgaccaacattcaaggaatttgagtccagcagttgaccccttgcaaaggacaaaaactatagcactgtaaagcgttcatgtttacctattgaaagagtaaagagtagcctctgccaaaggaaccatggaaaaaaaattagaagacactttgggaaagcaaaagcataaaaaagaaaagaactaaaaaatatgttccttttcctaggccgaaggtgaaatgctgcttcttgttcttccatgtggagagcatatgtacggttgctgcctttgcaagccatacagtgtaggaaggcgccatgtaatctcactccaaagaacctgtgtgcaatttcttggcattgggaatactagatccccttatcatctcggtcccatccttgtccgtgatttagaggcacgtttgataccctagaaccacgaaaccgaatagtgatgttcttgcccgatgtgacatgtgttcatgcacctctggaccctcaaaacatgaacagaaaacgtagaacccaaacagttcgttatctaaaaaaagaacccgaatagttcaggcaacagcaagaggcatatccaaggaggctgcttgttgttctgcaacaaggtgaagaggtgatagatctccctctaattaaaatctctctaaaccatcgtgtcttacggctcctgtcgagaacgagcaaaacgggattcatgcatccaaatccaaaggtagcaaacgtggtgcagtctcataattaagctagatattcacaatctgaagaactcatagttttttcatgggaaagatgtgtgttgctatgatccaaagcagtacgagtactactactaaactactaaaacaaaccatttcccgttgctgctcaaatagcgcacgattgtgaatgagtgtccgtagtagcaatctcagttgcatatgccatttgccatgatagcccaactctatgctcactaggaagactgaatcgattgccttgccccaactctactgaagttcagactactactgctatgcacaagcacaatgaaggccctatctatctaccgcaaacgaagcatctctcccctcctctccaagcagtcaagatccgcgaaatcctgcacatcgcgtttcatcattgcacccgcaagtttctgcagagagggggatgcagttttgtcatcagtacaaaggccagccaagaacaaaagaagcctcctttcgcagaatataagattagagacaattttttttccattgggcatcatggccatggcccccacattagatgcacgctaggcctcctcggattcgctgctaatgctgacgacgacgatgcacggcgtaactcacgttatcagcgtagcttttgccaagcttttgcgttagttatgccatggctttcctaacccgaacgagattaaagtcctaaagccaagcaaaggtcagactaaacaatgctctatctctctctgggcgtcgtcaaagctttgggccattctcgtggcctttttttctcacctttgctgcctcgcacacaggtgaactcagatgagaaggtactgaaggtgatgggaggggcggtaactagcagtagtgtggttgcacagtaaactggtagtggtaaaacgggaggaacagcagcggcagagcagcaaaagaagagggggaaggggaaaaagaagaggaaagagaaaggctgcagcgagttgccgtggaacggcagtgcgtgctggggataaacaaagccgaaagaaatgggctctcgcggcgcggctcgagaggagcgaatcatgcgcagatctttgtcccgcccaaatgcccacccacccccacacagcccacaaatcgtacgtatcgtctctcgccaccgtcctgatcatggccgcccctgcttcctcctaaacacatcttgcaaagctacattttggtgtatcgtatcatgtttctgagataactggtcatgttctgagaaaacgggcatgtgggacacggttcgatcgagtcagagagaagaatgcagtggatttcaagtgcctaattacaggtcgtgttgcgagtaacaaaatatgaaaaagaggagtaacaacaagtgacatacagagctgacaactccacgcttgtacgtgaggaggggagtggctaaaggagcctaaaaggagctctttccccgcgcctaaaactacacaaaagaacgaactcaactcactcactcgcaccaaagaagaagaaaggttaataaaagagaattctctcgctcgctgaaccaccgcgttttcttttcttgaggcttttaacaagcaattcgtacttgaaggttccctcgtcttcttcttttttttcttcatctcgccttcctccgcgaaattcagcgcgaagcttcttcggaggcctctgcttcgtcgagagaattcgaagccgattggtacagctagcttcgtggatcgctccgtgaccgcagcaatggcgagtcgaactctgacatggacgctgcacgacgcaagtgaatgaacacggggcgtcaggattcagtgcacttcgagacgagatcacgaaatggaggatcacaagtgacaatgtggcgcggggcgcgtaccacggtggagcgactccttgcagtgcgcgatggcgctcgcgatgccgtcctgctgctcgaggagcgagtcgtcgcggcgaggcggcggcgactggcacgccgccgtctgcgccgcggacgccgaccggctcttccgtagccggaggtccgcgccggcgctgggggctacccggcgcagttgcctcgagatcttgctgaggtaccgcctgatcacgtcccgcgagggcgtcctcctgttggcctcgtccccctggtccggcgagccgtagccgaacgcggcgaagagcctggccgagcgcgcgctgttggagctcctggagaagctggcgcggccgccgtagaacgcggccttggcggacccgaagctgagcgtgcgcagcttgccgcgcctgccggagccgtaccgcgaggcggcgtcgctcggctcggacgcgcagaacttgaggtgcgcgggcgccgccgccgccgcgcgcgcccacccactaccgccgccaacgtagaagacccgctcctcgtacgacggcgacgcggagcggctccgctgcagcgagatgacgaagtctgactcgccggcgcacgacgagtagtcctccgactcggaccccgactcggcgctcgacgcgggcgccgaggccgagcagcacgacaggtcgaggtcaaagaacgggccctcgtcctcgccataccagccgccgccaccgcatggcgtggcccgcgccgtcgccgtgatcgtggacaccgcgcggcgccggaaccgccgcgccgcgagcagccgtaggaccttcatgtgcgcagctgctggtgttcgggacggtggtgctcgtcaggtcggtgttattagtgggagatgtggaggggtagtggtgttggtggggggaggcaggaggcggggcggtggctcgcttttaaacgggagcggcaaaggccgcagcgtcggtggagtacgtgcgcgagatttaagaaaggccctactgggttttcttggggagtttttccatgtttcggcggtgtttgcggtgcgaagtgttgaagccgatggcatccgcggcgtttcgcggtttcgccaggcaacttgggttgggtggctcggcgcggtgtgggtcgcgtcgcgtggcgtggcgtggcgcggccgttgcgttgccgtggttgttggcgtgcgccgcacgggccgtggatggcaaggggagcgtgcgtgcgcgcgcgcggcgcggtgcgtggcagtagcggccagtttcgagcgcgatgccgctcggctccgtggtgtcgccggcgtgcgtgcgtgcgggcgcgctgttgccctgaaatctgtgaattagtggtagtatcggtgggtaggtttcgtcaagaattccggatttttacttttgtctcttgcttaccaacccgatatccagaaggatggctaccccgtaccattttcgcgttgttaatgacgttgttgtgcctagtgtctatgtaaagtatagtgagcgctaacaacttattaccaacaaattaagcagagtgaataatacttctatgtactactagtatcttcgtgcacgtgtccaatcagtcacgggcgctctcctgtcaacatttctgagcttctctcgcacaagatgaattttccttttcagagaacagctgatggttataactcatcacttcatgatcgatactaatgactaatgtcaactactctcccgtacaaatgaaaacagcatattaccctctccaggggcacttacatactgtcatgctgacaatcatggtgcccagcccctgggactattcgatgaacaccaagcctgggaaaagaaacatgaaatcaggaatcattcattcctgagccaaaaaaatttcatggcctcactaacagaagcttcacaaaagtctgcaaaaaccatccactagctagctttgctttcaaagagactgtggagtgtgggcagcaaaggaagggagctgccagatgggaactgacggctgtgaacaacagcgtcgctcaagtgcaatgcagtgcagcgccgttgcagctagtagctgcagcagaggcagcagcagcactcgatgagtccaactccatggcgcgagctttcactgttttcacagcctttttcaccggtggtcttcgtcttctactcttccctctcctcgtctggtccaacccatctacagtagtttcaggtcaaaaaccgccattattcggcttgaccggaccagtcttgagaatggcctgcacttgtcatatgtgacgaatagattctgtaaactgttaccatagtgtactatatactggagttgcagtacatttatactgttatctgaaaatgcttttgccagatttgtttaagctctaccattccgtgttaatggccgctacatttgccgttttctcaagaaagatgtgacgtgatggatcatggacgatgactttcagagctagattttggcaccctgtgccaggtaggtcaggtcaggagacctgcccgtgcgagaacacatgtcgccattcgaaatagaagcagcagagttataatcagtgaagtgtgattacaagaaaaataatccaaaatggatccaatggtgtgcatgtgcttgactaactagtctcatcatcgattcagagcataaaaggcttaaagcgtcttaccctttctttcctgcagatctcgaacaagtgtttgcccgtctgtccatgagagttcagagaatgcgtcggcgagactaccacaaaagtttgaacagagtttcataaatttctgtttcttaaagccaagtactgcaggaacagcagcgccaacggcatgtaccacgtctgaattctgatggatcatttccctggactgcaaagcagagcaataaatactagatcaaaggaccaagttcagatgaaatattgatggttcaaaagctcgtcatccacagtccaccaaaaggttcttacatggtgaatgggtgatactagcagtaaatcccgtcattcatactgtgtaacattagtgcctgaattcctgccaatcctgttttgaatgtgaaaggaaaaacgtgaggaactgaaaaggggtttgtctatggctatttgcagagtgaagtccagaagaaaatttcaacgcaaggagttcacataacacagaaaataaacatacaacatcaatgttttcttaacatatcagagtaacgattcaaatgattgcatgtatacgatgttttaccaaggaaaagttttactttggccctaattggaaattggaaattgcatgtatacgattacagataaagtatgtcctttataatttaaccttacatctatcctctacaaaactacccaaactattgcagtctactactcacatagaatgtgtgcttaattccgggaagctgcatccggaagttttgcttcgacgagtcaaggtcatcctgcgatcgcctgactgaacctgttcagtcaaaggcaacgataatggcaagtgacaatattgcgggtcctgctccaaacggtgaccatcgtacaaggatcctaagttcctaccacctcccgaaccagagaagaaagaaacgtcttcacaatcccatgaagccatgaactactactgctgactactgtatccgttggacccgcagaatagttgggattaagcaactccaacaattgttatcttatgtattttggagctggacttagtgctcttgctgacgttggccagtccacacgaagggcaaaatttcggtttatgagtcttgcaatccagtcagacgcgtgctgtactggtgttgtatttgtgcactgaagtctacaagtcagtggacaactgaacagggtttcagttcagtagactggccagtacaggctttgaggtttcagcatcacgacgtcttcgggttcatgtatcttcttcgctacagaatttatcattttcgcttgtggatttatccaccattggattccatattccaactttcgctgtgtttagttcttgaaattgggaaaaagtttggggaaagttggtagtttggaaaaaaagttagtagtttatgtgagtatgcaagttttagatgtgatgtgatgtaatggaaagttgggagtttgggggaagtttggtgtcaactaaacatgacctcattaacttcagtacttcagttctgattccatgacggccctcggagtttgatcaggttgggcgccaaggggaaaggtcccctgtttgttagatatcttgaggtccaaccgcgagtgttgggcttatgtacacttttctgcggccctgtataaaaagcccataatggacacactcgttgcacgccaggaataagttcacctgccgtccctcaactttacaccgagtttgtttgacatccctaatccttaataccagaaatcgtcatccgtaaatcctagtcagcaaaaaaatgtatatgggacccacatgtcagccaccctcttattccttatcttttcttcccagaccttccgttcgccggccgctcaagtgggccagtagcaacggccacccggcgctatctgctgccgctgttggtgcccccgggagctgccccgactccgacct

SEQ ID NO: 58456 - DNA, 5775 bp, Oryza sativa
tcggaggtcgaccacatgccgccgcctccgccacggggtccaccaatgcccccacgccacaggagcagaggtggagggcaagggacgccaagctgtccgtgctcgcgtcggccacccgccctgtgaccgcccgagccgccgtgttctaggggccgtcggacgtgtcgtcggcggcggggtgcggcgttgtgttcttgcccacgtgcgagctgcgactcggtggcaaccggctcgcaggcctcctcttccccctctcccgccagcgcagcctgccgccttgaggggcttcatcaacatcctcatcttgccgccgcactcgcggcacccatgcttccccgaccatgatgccaccacctccgccacggcgttcgccgaggcccctgcgccataggagcagaggcggagggcgagtcctcggacgcgtcatcggcggcggagggctgtgactcggcggcaaaaggcttgccgtcctcctctttcgccctctcccgctggcatggccgggcgctgtggtctcctcctccgcggcagcggcgggggcctcctcccccgtggcaactgcaggaggactccgcctcccccatccgcgcgccggccgagaacagaagcaaggagagaagaaaaggagaagaaagaaaaaaaaaagaatagacttggggcccacatcattttctctcacttacatgtgagtcccacatacttttttttttctgactaggatgccacatcagcgaaaccagacatctagacctaaattgcatggttttgtatagtttagtggtgaagatttctcatattgtgaattagggatatcaaactaactcggtgtaaaattgagggacggcaagtgaacttattcagtgcacgcaactgtataaaagcccataagttgcatcttttcgttgggctattatttttgctcactgctgcaaagtgccactattttggtgtggtagcaacaagttttaccactccacaagtccacagttcaaaacggtaactctgattgttcagtagtgttctttgctctaacatctttctttttccaaccagtctaccgatagcggattttaagctctcaaagtaacgtttttcgttgtttgtatatcacttaaatagttataaaaaaatttaaaaataaattagagtaaattgcacccacggtgtatcaattgtcaggtgggtgtgcaatttgatgcaataacttgagaaataagcgttctaatgtaataacttggcacgtatgtgcaatttagtataagagtttttataagtgatcgcataaaatacagcaacttgcaagatatgtgcaaatttgatataataaattaagaagttatgcgacaacttaattatttggagcacttttttttatacatattcaatttttaagtacttattttgacgatatacttgtggatttgtataagcacattcatattttttatcctcataactaatgactaaaagtgaattaaacatctaattattatagttcggttgagatttagaaaggtgaaggaaacagaaattcttaaaggtaattagatgtgcggtataattcttaaagattaaattcaatatgataaagtaatatccgtaggattgctatgtaatggcatattgacatcgtaaagaaaactcacatagcatatgtttagccaagttgatgcacaaaaatactaaattgtcaagtttttgtactagaacgcatccatttgtcaagttgttgcactcggacgttcaagtctcaagttcttgcactttatcgcacccacatgccaagttgttatatggtgggtgtaatttacacaataaattaagatgtattaacatgtgatatattactataccaacatctaacttaaaattcaatttctacatattaaaaaaataaatttgactattaatatacgttaactaattgttatttaatttatttttttcgttacaacatgtagaagttgaattttaagttgcatgtttgtgaagatatatcacatatcagtacgcctacttaatgttttttcaaattttttcataattgtttaagtgatatacaaacaacaagcgaatatcccctcgagaatttagaataatttcccccagtctaccctcaatcccatctcccctatattcttccccaatccgggcgactgagctcagaggcagttgcacatcactacgtcacctcccaaaatgatcctagtaatttcctaatccatttggctattggtgcggccgcctagtcctgcagttttattaggaatagcaattccgtttattaaactcccccgcacgagtgacgagatgccgctgcgccttgcttctccgtgaaacaacccccggcatgactccccagcgatacgtccacacacacataccacaagtagagttccaaacttgccatatttcccggttgctgatcatcaatcatcacttcatcagcgcatacgtccggaacgtggatgggaatttgaagcttcgctacattccaccctgtttctcgcctcttgtcccctgcatcaacgcgacgacacgcccaaatctctatctgctaacgcgatgctactcctcccgttctcctgaactcatcaggccagggccagccacgcatgtgagttgcagccgccagtcaagcccaggtttcggctgcactgcatggatcgagcccgactgccgcaagcaatctcctgaccaacactaccacatgccgacttcgccgcaaaccgccccggctagctagtagtaacatggtgtcacgttcgcgatgggagctagtggctgcgactttggacttcgttactgcaatctcgccaggattctggggaaatccgttacgtgacagttgacacgcaccgcaacctagcacgcacagttcacattcagttgcacctcgagctctataaatggcgtgatgcagcgaagcgaaatatgtcagtagctagcagcgatccgataagtgataatttagtggtgttttcacgcatggctcggtgcagcgtctcccgtgttgtcttgttgctcttgtgttgcatgcatctgtcggctgcagctgcaggagcagcagtgtacaacgtcgagagttacgacgcgagacctgacggccggacggacgcgtccagggcattggcgtccgcctggtccgccgcatgccggtcgccggagccggccaccgtgtacgtgccagacggcgagttctttgtcagccactcggccttcgctggcccgtgttccggcggcaggatgacggtccagatcgacggcacgctggtcgcaccgtccggttacaccggcagtgccagctctggcggggagtggattgtgttcgaccacgtcgacggcctcaccgtgtccggcggcaccctcgacggccgcggtgagtcgctgtgggcgtgcaaggcggccggccacggcggctgcccggacggcgcaacagtacgtacatactacagcgcacagtgtactgatgagcttaattgcagggaaacttaaaaaacatttttgtgttaaaccgacgtgtgttgatgtcgacgtggtgcgtggcgtgcagtcgatgaaggtgctgaactcgagggacgtggtgataagcggggtcaagtcggtgaacagcgagctgtaccacgtcgtgatcgacgggtgcgagggcgtggcggtgcaggacgcccggatcgtggcgcccgggagcagccccaacacggacggcatccacgtgcagtcgtcgtccgcggtcaccatcaccggcgccagcatccagaccggcgacgactgcatctccgtcggccccggcacctccaacctccgcgtcgagcacgtcagctgcggccccggccacggcataagcatcgggagcctggggaaggagagcgaggagggcggggtggagaacgtgacggtgagcggcgcggcgttcgtgggcacggagaacgggctgcggatcaagacgtgggggcgggcggcgcgctcgggggcgtacgtgcgcggcgtcgtcttcgagcacgcgctcatgcgcgacgtgagcaaccccatcatcatcgaccagagctactgccccaacgacggcggccaaggctgcccccatcaggtaccgtacgcgccgccgccaacacatcgtatcccatcgccgtcgtgtctaatgaggaggtgtttagataggggtgtaaagttttaatgtgtcacatcaggtattatatagaatgtcacatctgagtagtaccccaaggtcctgggttcaaatctcttatggagcgaatttcagattgggttgtttgcggggctaagttccctatttcaatggccgtatatatcagttgaatgtagaggccgggtaaaaaatactcttctctaaaaaaaatataaaaaaaattatatagaatgtcacataggatgtttgggctagtataaaagaactaattacagaatccaacagtaaaccgtgaaacgaatttatttagcctaattaatttatcattagcaaatgttaattgtagcaccatattatcaaatcatagagcaattaggtttaaaagaatcgtctcgtaaattaatcgcaatctgtgcaattagttattttttagcatatatttaatatttcatgcaggtgttcaaacgttcgttgtgacataatataaaatttttgtgtgggaactaatcaagggcatgagttgttttttttcttgcagagctccgacgtgcagatcagcggggtgacgtacacagacatccagggttcgtcggcgtcgcaggtggcggtcaagttcgactgcagcgcgagcaaaccctgcagcgggctcggcctgcaggacatcaagctcacgttcgacggcggcaagccggcggaggcgacctgccaacacgccgacggcacggcctccggtgtcctcatgcctcccagttgcctgtaacgctttaccgccaaattggagaaacaattcttgtaaaccgagtactcactatttacacatggacgaagatacaacggatagtatagtgaattagtgatattaacaagatatttgattcggtccaacaaaaaacggatagtatagtgaattagtgatattaacaagatatttgattcggtccaataaaaagtacctcgacgtaccggtagtccggtaactcacagtactagatccaacgatcggaaataatttggtaccgtgaggtcctgtacctcgaggtactttttgttggaccggagcaaatctctattaagaaacttcaacgattccagctctaatcagtaatcgaccaattgtattcccgaatcaagaaggttcagcattattattcaataaatcaactagggaatgacaatcaaattatcgggtctgacgactactactcctaaatgcctcttttttccctatgttcttctctgcttcagtacatccagtcatccgggggccagatgccaaccacaaacactacaaatgtatatacaagtaatgaattcttcactacaagaagtatgtcagttgctcccgcttcctcgacccgcctttgccgtagagctcattccattccttgatctgattcatcacaacgccttcgctagcgaagctagcggcgacctgcatagtgttcaatgcgcaacagcttagcaatatgttcttgctgtgaaaaggatagctaagataagtacattgcgtgtgtatcatgaagaatccgtcagtgacttacttcatcctttgcctttctcaagtcctccatgtttagcggtctcagggtagtctctccagcatcgcctttgtctgatttatctttcttgtc

SEQ ID NO: 58457 - DNA, 10567 bp, Oryza sativa
  unsure (1)..(10567): unsure at all n locations
cagaacgcccttgcatggcttcaagagaccacctttgaagaaatcaggtcgttgaagaggaagcatgacaagctcgtgaaggcattctttgatatcagccagtgctccaatgtcatcaaatgtcactcctatttcattggctggtataaccgttggtcggatcttcttttcatactcattgtctggaacgacctgtaagttaagaatagcaaaattttaaacatgtaattaaactaggaaaattacttaattataacttattgtagttgaaacaatgtattaccatctctgtctcatcctttgcttccactgtatctttcccaaggtcgttgctctcttggaatatgcgtaatccatgggataagctgtgaaagtgccatgttagcaaaagcgagataaagcaacaatggaccacctcaaactcaaagtaaatttagctaacctctccgaagatatgacaagattcccgtttctgtatttagggttcttgttattcatcagatggtaagagacagatggggttataatttcttctaagtaagccacaatgattttacaatcatcatctgcattgatcgagctcaaatcttcacactcaagattgttttctgcgagcacttccgcgatgtagttttgaacgacttgattattgttattattcgaatcttcctccatctgggtcttccatttctcaagaaggaccttgtctttgggaggctttgtctccagaatacaagggaaaagagcacacacagattcttcaatatcttctctatcctcatcatcatcgaggaattgtgaaccaatcacgattacccgtccagatagttttttcaacattttctgaaacatacagtatgctttttctgaacttccaagcaagtcatcaacatcccttatgtaaagaatgactggactgatttcagaagcagaaactataatctgcaaaagccatccaatatcagcttgtacaaatagggcacgtaaatttggactatactgctgaataactgagttaccttgtaaagggattgtatgagaaccttctcattcaaactccagcatggtttaactgatgctgcatcaaaagagagggtgatctacagatagctaaaaactaggcaggttaggataactgcagatttcagttggaggaaccctcatgggcaggcacatttgaatatacaggtaaatgaggatgttgggttgtctgaaactagttgaagctggcaacatatgcattatacatctaatgtgcacatgtgcaattggggcataaataaacaagagagcataaaaaaatggatttcactcaccaaggtatttagaagattcgggatcatggtccttctcgggaggtaccaaggataactgaacccgtactgaaggtgtgttatgaggacaacaagtgctgcaaaagcaatagcataaaatgctcagaaaatcaatatctaatacctctagttgcatatccaggcagagatattacctagtcctgagatcaaggatgcctgtttcacggctcaatggtcctacattagtgtttcatgaagacacagtcagaacatcagaaaagttggagcatgggcatcgcttcaaaatcatgattgagagaaagaaggataaagcattgcagaaagtaaacaggcaaagaaacggtgagtgcacaacaggaagaaacagggtacctgttccagttggttcttccttcttgcgaaacagattgaaagctccaaccaaactagacactctatcgaaggctgcctctgtcatggatctctcacgggtctgtgttatgaacagatcagaattgattaggtaaatcatcagacaaatccacgccacttcacaaaattgtaacaaatgctcctgttcgaaaaaaactgcacattcagcaactctactagctaaattgttcagtgtggacagagtagactaggttctatcctcctcaagtaccccgtttaagttgtgcagaggccggaatcgtaaaacgctattccataatctaaagaaaagtacccattgtttcaacagggacaccatgttttactttgactcattaaggaaaaaaaaaaggccaaactgataaacagaaatgaaaatcctgaatttcccatgtcgcttggtatatcaaccaaatgtgctatacaagatggaactaccagttaccacctagaaaaagaaggcagaaataggatacagacctgtgtattgcttggaccgccgtacttatgatggagctgcaatggcaatcgggaaaagaacagtttaggatcataagaggccagggcgacaacaaagctaaaatttctcaaattgcatctaactgaccttgcacgcgaagtcgatgacatcgagcagcagcaggcgagcactgaactggtttgcgagagccttcgcgagcgactgaaggtacgcctctgcaacagagaaacagcggctgtgagaaaaaaaaaagatcgcgcttttggcgaaaacgaacaacgcacattgcggttcaggaagcggagggcgaacctgatgggccgcagagcagtatggtgcggctggacgcggagaggacgcggatgtgattgggcaggatcgttgggctcagatgcacgaacgccgtgctggtgagggccagcttcgactgctcgctgcaagaaaaccatgggaaacacatgctcaattagccgcccttcaccaaacaccgcattgatttctactgacgacgcaacgcgtatccatgggatcagtaattaaatcatgtgatcctacccgaaatataccagcaaaggcataaactaatcgataaagctaccggtcaaaataagggaaaaaaaggtttggttttttttttccttctcccacattggattggggggtttttggctctgaggattcgcatcgacgacgggacgaacctgaggtagtacgggaagtcgtcgaaggagacgccgacgtcgcggccgtccaccaccagacaccgcagctccgcctccacctccgccgccgtggcgccgccgccagtcgccaacccggtcagccgcgacgagacgaggccgatgccgacccccaccccgacgcccacccccacggccgacgcgatgatgctcccgtgctccatgtgtcctcctcgttcctcctcccgccgccgccgccgccgccgacacgacgaccacacctacgcggaagccgacttcgacagcggcatgcaaaactttcaggggcgcggattcggtacgggtgcgatcgaacggcacagacacggaggggcggtatttatagagaggagggttggagagagttcgggtcggtcccgtcgcgtcgcggccaggatcgagccgagcgagcccacggcacggggcacggcggcgtcacggggcaggagggggtggtgccgattgggattgggacgcctcgcggatgccgatgccgacgcggatttggcccaaaaaaaagaggggtgaaatttccggtgcacaaacacctctcgtcggcggaatctcgttgtcgcggatcgagtggccgattcctattgtttatttctattatttcgctatactagatagacttggtctatgtgtaaaactcaagtctatgtaaaattctcctttcatcactagggtaaaagtagcaccttttttttctccgccttgtaactccgtcatgccgtcattcgattccctctgggttttttttttctttttaatgctttctgatttggccgaatgttaacggtgacagaatagttgtacgctttagcaccacggcagattggcgaaaggcgtgtgacacttgggccttgggctgtcaacaccaccaatagcagagacgcgtgggggcggcggtattgatggatgtcatgagatcatggtttttgccgagttggggaccactagttcgcttctcgcttccttttcgagcgtaacgcagacaaacgtgcatcacggctggtgtttgaaggttgcgagatttccctttcttgctataacgtctttggatggttgtatcaagactattatgtgacactgattcttattcatcgaaagttcgaaactaccgttggttccacacttccactgtttaaccacggcgggagcaggagcgacccagcccagagacaagtcccgagccagcctatgctaatttctcagggtaattctaggcagaggtatcttccttgtaactatgagggtgtttgggagaggtactaatagtccctctctccaaaaaaataagtccctagatttagtccctctctcccaaacactctctatatatctcaacatgacatgatgagtagtcggacttctgatcctattcaaaaacatcggacggtgtttcatggtttcttcgaattgtgttagcatcgatggcaaggggtgctccctgtgcaccatctttttctgaggcagacattgtgtccctttcttaagaatcagtggacgacatggcatgatccacatggcggtggacccacgacgaggtccaatcataaccatgactagtcgagcgtgtctgaagaagaccaccgagcaatatggcgatgcgacccttttgtcacgtcattgggcttaccacccctagactctcgatggttgaatagctagctcgctcaatggtctccctcagccacacctagttagtcatggttatggttggatcttaccatgggcccattatttgcgtggaccacatcgtatgtcaatcactattaaagagatgcaaattctgtcactctcagataaataagagatgaacattacatatctatgcctgtgaagctgacatacacgctattttttaatcatctatcgtcatggatagccgcaaacctatacaataacccctgtgtatgcatggatgaacttcatttcacttccgtatttgttgatctaataatgacactacagttgcccatgacatcatcattatttttttttaccatgcatgacatcactatttcactaagatgatgtttaatagagctcctgggtgggtcgggggctttaccacaggatgaggacatgagaactgtggcaaattacgccgacaggatgggatggccactatgaagggaaaaggtgaggagggcatggctagtgtgcttctcgatgtgattaacggctaagctaatataacgtgaatggcatttaagaagaaattttaaaacagtggcgaccagataagaatactactcccgataatataacaacctaaaatcaggtgaaacatttcagagtacaatgaatttagtcacgagcttgtcaatattcattgtattataaggtagtgtttggttttgggactatgtgggatgggatagaaccatccctgatttttgagttgggatgattccacttacatgtttggtttgtaggatgggatgatcctaaatttttgtttggttgaagggacgaggggatcaacgatcacctgatttgcccccacagtcctccccatcgccggaggaagagcaagaggaagagctggcagcgagcaagagcaagagcaggaagagaaccatggcttgctcacctccccatcaccggatccgccgctgcccctcgacctcctcctcgcactccgccgccgctcctccctatcgccgaatccgccgccgccctatcgtcggatctgccgccgcccctcaacctcctcctcgcatgccgccgccgctcctccccatcgccgaatccgccgccgcagtcctccccatcgctggatccgtcgccgccgccctccccaccactggatccatcgtcgccgagtcccccgccatcgctgtcgctgtcgcccgagctgtttgccgttgctctcgagggcgagcgcgcgagtaaggcgccgtcacgccgttcgctcgtcccaggtgggacgagttcgtccaccacattttcccggatcggttggacccggatctgagaggaatattcctctatagggaccaacccatcttactcacccctcaaccaaacacccttaaaagtgggttcgtcctatcccatatcattattgcaactaaacactacctaaaatgttccatccgatcctaaattgctatattatgggacatagagtagcaacttttaggtcaaaataagaaagcttgccaagtttgagaacaaaaagaaaagatatttctctattaaatagtaaagataagagttagattgtctcattaaattgactatatttcaactgattaagtttttctttggtggaacataccatctgaatttaagtaataaacttgatagttgacatgagtactcgcattctgactttaccaatcttaagacacgggtctagcacccttcctagaaagacccgagcttatttggaatgatttggggggagggggggaggggggcaagtaagggtagggtgtagtattcttctctactctgccactgtttctagccaatagaacacatgtgcatacgcatgcgcacatcacacacgcgtgcgcgtgcgcgtgcacggcaatgatgagatatgctagtgagcgccggtattaaagggttgtctcatttattacaggatctattaaggtaaggtaagatatgctagagtgtctgaatttatactgatatttttagaagtaaaaaagttgtctcatnnnnnnnnnnnnnnnnnnnnnnnntaaaggttttctttatagtacttccctaatatatgtcgtttgaggtatcacctatagaatttatgggacccatccttttgcttaagccaaatgacatatttgcaaacgaaaataatgtgtgaataaaacttttatatttatatatatatatatatatatatatatatatatatatatatatatatatatatatatgtttttagcaatttaaaagcaaaagctgaaaaataaacttcgatgagaaaaaccccaaaattatatcgttgataattcaaattttgactgataagcataagcgaaaagatgaggttatgtactaccatataattattttctataatatatatctcgtgattaccagtttgtcactagaaacatacttttatctcttaacacgtactctcttcgtcgcataaggaataggaaaacttgaaaatgcgtagtacactgtgattattactagtaccttagtccttatccggtcagaaacaccaacaaaaagacatataaaagagagataagtgcgatattctgcacaagcctccgacgtggcagagcatgcatgtggaaacctttccgcaaaaggctccgacgatgatgtacagacggactccaacattcacctccaccatccaatgaagtaacaaatgcaacgaaatttcgcctgcaatcatccatgttcttccatcccaagtttacttgagggatcggaagacttcgtttgtcgtgtaggtttcacatgcgtacacatacaccgaatccctatcacctatcatcaccatcaccccgatgctatcctacagccgcccggtcgtttacctcctcacctctcttgtgcacgctaacatacaagtagcttgttttaatattacccgcgacgaccagaacacggcgagtcagtcagtcaacgtgatacggatgcgattttctcctgtagttgagtagaaaagctaggaacagagactaagttgggtgtcgtgtgtggtggagtccaccatggatccatgatgctagcgctgcttgctaatcctgcaacgtttgttcggtgcgtgtccacggttgttgccccgttggagcttagctagttggcgaccactcgatcgacatccgatcaggatgatatgtgtcatacgtggtcctgcctgcccctgtaaaaccccatagcggcaagggccatcgaccgaccggccgcgtccgccgtacgtactacgttcgtgcggccggcctgccgtctccggcaggaattctccgccgcgcgtggcgggtgcgcacgtacgtacgggcgcggccgctggcgttggcatattggcatggtccatcgcgcggacgaaaccgagtcttcgctaccgtcgctgttgcggtggggctcgtatacagttttgtgctcgtttctccctccgatcgagtgcacgtttcccgaagcaacgatcgtctttcatttggtggttgttgtcatgttgggctcgcaagtgggggcggctctggagattgtgttctcttgggctacaatacgctgggccaccatgaaagggaggtcggttttccggtatggatccggacctggcctggctggcccagcatgtcatatggtccatggcgcggtgtgtagtccagcgaaaaccatcacccacccatccacccaccgcacttagggttagggacgcgcgtttagttaagagccatgtcactaaggaacgcgttaattaatttgttggtgaacgattgaaaagccataataacgattgcgttcggagttgcggtttgtctgtatatccaaattaagagttttgtataggttgcgtcaactagagtttggtgcccgctcgcctaaatagatatataggtgtctgtttaaatgaagtcaagcgtcaacaacaagaaactggagtgtactctctccccgtatcaaaataaaccaatatatcattggagggaagtaaaacttgatgataataaagagatgctcccctgcgaaatcacgcatgattgcaggacgggatgcttcagcacgacatggaagctccaactgattgtcgagttctcgatttaattaaacggagcacgggagcaggatatctcctaacaggacggtggtatatgagaccggaaatggaccctctgacttattatcctctgacttagagtgacttttgaatccacatattagtgacacaagttaaaaataagtaagtttgaggattttaatccctattagacgtgggacgttagctagatgctaacgaacagttgatctcaactcctcaagtcgaagtcacggtgttgtgactttgttattccctctgcttgcatcagaggatctgcgttcacggcacgcgcgcatgttcggccatgcatgtgtgcacggtgcaggccctcaggccacacgtacgcggtacgcgttaacagctcgatcgatcgccgtcgcgtgtgcgggccggacatctgattgcgaggttggcgatagatgggccgtgtcccgtgggcgtatgtgacgagatcgctaattagtttttttcccaccactttcctttttttcttttggcacatatagttttttttcaggttaatttaaagtttacgcgccaaaattttataagttaaaagtttatatattcgattcaaatttaaatttaaatattttttatatagaatatatatatatatatatatattttatacgtacgaaatttacggtatatatttataagttctatgcacgtgtataagggtattattatttttattttattttctaacttggaaggagggaatnnaatggggcatgaggaggaggaggcgngggggttagnnnaagngaggggggagggggagggggagggatcgctgtgggtgatcatccgcctattagccctctcccgtacgtgaggcgtggactagtctcagcccgcgcgctcgtctccacgagtgtttcggcagctctaatgtaacagtctatactatagtaatggtggtgtctattctcacatcattcctaccattaacatttggctcccataatatatattattacaccctttgaacaagtcctctctcatttcattataggctcctcaaattttaaaattatctacttgtataataagaaaaatcatagtactactaagactaaataagtaagctagaaacttaatttgttttctgttgcaactcacggactctaggcttactagctaattaacgtacccttacgtcacgtaggatcaagttatagtgctttcacagcctactatatagtccttagtttttttaaaaaaatgtgtattaaaacttagtccatcctatctaacccttgaattttcactaaaatttgagacctatttccacaccctaagtacagtatgcacgcttgtccattctccctactcatgagggagggacacagtagataacggtatccatgtcgacccggtttaagacttaattgtttgacttatgcttgtgcttttaagctaaattttgaattttacaacttaattttaaatttattcattttcttatcatagtttattttacaatatttatttttgagtcattaagaacacgtacacaaaagtattactcgcaaatacttttttatttgctaataagctgtttagagcatcaccaaccgtatctctatattctatccccaaataatttttatgggaatcctaaataaaatttaagatataaaaatagtgttccctcaaacagacttgctaaaactgacctcctaagaactaaaaagtggacccatgaaaaattaccaactgaaattggcttctctctccctcccatgagatcataccagccacgcgtccactgatcgtgctagatcaccgatcggtgtcggccctctctatatgatatagcatgatcgatcccatccagtggcgtagctacctaggtggcactgtggtccatggaccacctaaa

SEQ ID NO: 58458 - DNA, 1539 bp, Oryza sativa
  unsure (1)..(1539): unsure at all n locations
gaatcatgggggagctacagacttattccagccagccacgggaagacaatgctggtgacgggatagatcgacacggcggtgtacgagagcgcgaagaggagaacatgtcgccaaccacgcgcgaaggagtgaagtacgatgtattgggaggcagacctcgtccctagaagtggagagcaaacaatccagaatcgggatttccaactattgggagcttcgctagggactctgttggagtcattttttgaacaaaaatctgattggaaatcatatacagacactattggtgatgctctaaacaacgtgacacttaataatagcttgtcaagtagccttcttcctggaataatgctatctttttctcgatcgcttcgtacgtgcctaccacatagctgttctaagagatacttaggttgtgttcttcccctattttcccaacccacatctctcatttttcgcacgcacgtttttcaaactgttaaatggtgtgatttataaaaaactttctatatatgaaagttgttttaaaaaaaatcatattaatccatttttcaaaaaatatagttaatacttaattaaccatgcaataatacgtgctttgttttgcgtgccgggaaggaagggttccagccttagggtgtgttcagaatcccccttttccaactcagctctctacttttccgaacgtaagcttttcaaactgttaaacgatgtgattttttaaaaaagtctctatacaaaagttgcttaaaaaatcatattgatttatattagaaaaaaagctaatacttaattaatcatgtgctaatggactgctccgttttctgtgcagatattttagttccaaactccacacagcgaacacagccttagatactactactctatatccattcagtttttttttctttttgaaaactataaccattcgatcaatcagcgattcaacggttacacgcacaagtaataaagaaaacaacgtacgagatctagtactgcgtacatacacggagttcccaaatgtttggcgatcttatctgggccgtgctttgtggacgagagcaactattcagatgtactctcttttttcttttcctttggaatgccagtacaaactttatatagcgtgaaggaatcaattgggctgtgtggacatgagtagatcatgggccgtattcgccgcactctgttggtactgtggtgcatggctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58459 - DNA, 7994 bp, Oryza sativa
  unsure (1)..(7994): unsure at all n locations
aaaaataaaataaaacatattttttattttattacctaaaaataaattgtcataaataatgtatcgtgcaacaaaatgataattattaatagtcttatgcgataaacttttatattttcaataatgtaatttataaaaatttctatgttcatccaaagggtaaaatggtcaattttatagaaattagatggtcgactgacgggagggatatggaagggaccaaaataaaattttaggagtatacaaagaaagcaagtaaaattcagaggcataaaaaggattagctaaaattttagagatatataagtgattttctccaaccggagttgaaatgggattgcactatatgcacttcctacttccaagacatgtagtcatgcacgcctgcacggatagtctggtagatatatgtactgtatttgtttagatttgactacattagcaagtttttttttggagataatagaattgaatttgataataaatcatttcttctctttcacgagaccacaaatacactcgatatagttatatatactttatataattatatacaactataataatcgtcgatctacttcattataggttgcattcactatgatcaacggtatacgtctttatttttcctatcaacacatactactgataggcccacagaacgaacaatctcctgtcttacgtcctgtttcgttcatgggtctaatccattagtcccttcattttaatctgttttagtctctaagaatttaaacaagatgactaaaattaactaaaagtgtatgttaggattaaaatccattaatcccttatggagatatttgtaaggaagaaagtggcagcctctctcttctctctccctctatccacatacctttagtcccttttagtctctggatctaaatagtaggagactaaagtttaaagtttttagtttagagactaaatgatccaaacaagaccttaacatgatactccctttgtttgaagtatttcaaaattgagggcagaggtggttcaaataacataatactacaaaggtacgaataactatactttggcacggagtaaatagatagataaatctatctattattatatactaaaagtccattaatcttcctacaaacactctcaaggagccacgtggctttctaaaaacgttctcaagccgtcacgtggcactctaataaattagagaaaatcctacaaattctgagaaaaaagcaaaacatctagcccttagttttcacttaaattggtgacccaatatttcaggccattaaattaaatctattaaaatcattccttcttctaatatagatacgatgcgtggagaggaaggtacgatgtactattcgtaaacagtaaaaaaaaatcctatgcgatgcatatggaaggagaggaatgtacgtatgtactacctaaaaaaaattacatgatatacgtttatatgaacgtaatgtaagatcgtacgatcggaaattaaaaagcataaagcgaaaaaaccaaattatatataaaagtccactaaactttctacaaacgcttttaagctgtcacatgactcctacaaacgctactaagccatcacgtggcgctctaataattaaattagagaaatctaaaaaattttgagaaaaaaaaggaaaacattatatcattgattttcacttaacatggtagacccatcattttatctcctattatctcacctgctcacttctttatccaaattttctagatagcagctcagtacataacaataagaaatgctatattaactatctattatatagtacaaatcaaataaactccgtacaaacgctttcaatctgtcacatgcgtggtgtgctacaaacgctcctaagatgccatatggtactcaaacaaattaagattcctaaaaattatgataaaaaacaaaccattgattttcctttaaataggtgaacccaaaaattatatctactacaataaatattttttaaaataatttttctatctatattgattcacatgcataactaattgcacatatatgagaagtaattaaagagagggctagcaggatggtaaaaaaaaccaatgaaagtttgttgatatttcttcacgaaagagatatataaagaacactcaattcaaaatagaaaatacgttactttaattttaatttgatttgttagaactattttcgaaacaaactaatgcgcagcccgcgtaaatgcgcgggctatcttcctagttaaataaacaatatagaaaacctaatccattagaccaatggagacaggtgttgaacataaaacatttcacgtattttcttttttagcaaagcagtacgtagtccatgatttcaattagccgcaaaagatatcatctgcgaggacattattaatttatttatagaaggtataagaagggactttcctcttgtagtaagaatgactttgtcactaactaattccactgatggatctaagctaggaggcccaaacgaattaggcaggataacctcacaaaaccacccaccaacaccaaacccactactactaaaatggagtaatggtactactggtagctgatagtaagaccatatggacacagaaagtggagtatcctttcattcctaaaagggcatggaatagaacaaccccaattttggaaacggggagcagagccattcagctgtttggggaccaaaggcaaggaggcatgaccgaccgatccccatccattccaagccttcaagagacaagatattttcgaagagagcacacctaggccctagctagcacagtgcgcgctacagtatagtattaggagcacttcttttcccccgattctccaatcaatccaatccaatcctcgtgtaggccaccaggaggcccctccatccgtcccactctgccctaccgcccatctcatccccatccatccggtcgctgaaatccgccgtgcacgtacaccgtcttgtcgatcacgaccaaaccccggccgcctccgcctcctttctggtggcgcgcaccgcccgcgatctcgatcgttcactcccggccgtgccgggacgatcgcgcgcgctcgccgaccggtgtcacggatcatatcaaatctcgcgtagctagcggtcgaagtcggtggccatcgtttgttcgccttcgcacaggtgtccgctgatctcggcgctcacaaagcggtcaacacctagtactagctactgaagtactgtcaagagatcgagccaagccgggccggccgggtatatccaggggcgatatgacggatctggcaagtagattaggcatgcggttagttgggattagatcgagaggcatgcacgcccgcgcccgctttggcgttgccgggtgccccggatcacgctgttggtccaaaaggcggcactgtttagtgtcatggcctcaaatctcacgcgatggcgacgtacgccacagcgggaagggtcaggagcccgacacttgtcgcgctccggcctcccggacacttctatatgaacaacccccccaacgccccaatagtagtatatgccgctcatatcatcacttgtttactttagatcatgtcctgtcatcgcagtataagggttaaccacgatcgagcgagctagccaccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggcgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacgtcagtatcattcaatcgccggcgccggtccgccgtactcccgatgattaacgctttttccgtcttgtggtacgtgcagggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcgggtggggngccngcnancaccangnggctgctgctgcggccagcgtgggaatgtcgggagaggaggaggatacgacggaggacgtgctggccaaggagaccgcgctgttaaagaaggtgcagagactgcggcaagagcagacggccatcggggaggagctggcgcggatgagccagcggctgcaggcgacggagcggcggcccgaccagctcatgtccttcctcgccaagctcgccgacgaccccaacgccgtcacgggccacctcctcgagcaggccgccgagaggaagcgccggcgccagcacctcccttcccacgagcccaccgtctgtcccctcccgccggcgccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctagtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctggaaacatgcatttggcttcctgtgattgcccatctaccctgatgttaacttcagcaatacacttagtttattgagtggtttgtgacttttgtgagaagtggcttttgctttcagactctttaatttctccagggcccactgcacacagccaataagaagctaggggtggtgacgaattgccgatcgctgtgctgtgttaatggtccaggtgtctgcttccattagcattttctgtagtgatgatgttaattaaagtttggatttggacgtcgatgccggaagctagctagctagctagctaagggaagcagaagaagaaatgaaaggctcttagagctcacgagagggcgcgcggcgcgaccagcgatttggcgatttttgacgtgattttcccctgtgattttctcctctcttcctctctcccccgtcgctctcgcgggcgccgcgccttcgatcgagtccacttcttaattacgcgccccgcggatatgcaggagtttgcaggtataggagtgtacttgactcctttagtttggactgagatcgatcgatcgcgtggcttaatcgtggctaagcatcgcgaaatctttgtttaattacaccactaagctggtcctgcccccagctgttaacttcggtggcgcgcaaggtgtgacactccgattgatatatgatatataatcctactagtaatctaccagtagtaatttgctttgcgggattattattccaacctgccggcaggtgtagatcgatcgatatttacaaagatttggctgtccgccagcttgatcgtcgatcgatatatcgatcgagtggtactacgtgctagctagctactggctgagctatagctgtgaggagatatatatgtatatttatgggcgtacggtaaatcactaactaaaggctgagctaattaagtactctaggtggtatatatatagtagtaccagtatagtactccgtcttaaaataagtgtagttttacactattcacgtttaacatttgaccgttcgtcttatttgaaatttttttatgattagcatttttattgctattagatgataaaatattaataatattttatatacgactaaatattttcaaattttttataaattttttcaaataagacgaacggtaaaccgttagacacagatattcacgactgcatttattttgggacggatgcagtagaatgtatagcgcgatgcatggccactagccaatatccatccaccacccacgtgacatgatatggtccatgtccccctcggccggaatatgcttatatgcaaatgatatgacggctcgtataattacgctggtctccatggtcaggtagccagacactgacgcgctagctctacatacattactgtatttcgtaattcataaaagaattaattgaaatatataaataccgtgatatcgatggtaattaagggaatgccattatggaacgggatataaaatgatttttttatcattgttttctatatatcggagtgatcgatgtcatgtcactgtacgacgacgcaagtggctgtaggactgcgtacaagatcggatgaacaatgatcactctcttaattgttttgacccgtcgcgcgttgagattatagcgagagggcatatgggcaaagtaaacggatgtgtccaaaacagggtgggccccgcgatatatattcagcagcaggtggcccccagttggcaggtctccatcgggcacaaagatgactttggccatgtttaggggagcttctcctcttagctgcagtttttttcaaaaattgtttctgttagaagctgcctcaaatagttacagattctaaaaatgaaataaaaagccagaaactggagaagttgggtttcagagttttttcagattctcataagctgactatcaaatagctgcttctcagaatttaaaactccccaaacatatcctttgtctgtgtttactgtgtgaagcaccgatggaattatgtctcgcgggtgtactgtgttacgttggcgaccgtaggagcccaccttgatcacgccggccttaaaggtgcccatacacgtacagttacggttactgtgagccgcatctccaaccgtcgcgcgacgacaggcgatatacgaccagctgctacactatttaattaagccgcgtgacaacaaagttaaaaacaatcgatactcattatcaatcgacgggctaattaactaacaacgttctggcggtcagttaacgagttgataatacacggtgtaaacccacatgcatgcaactgtagagtatatacttctactatttacagcacgcgcgcaagcaaagaatgcaggatagctaaaggcaaaggcgacatgtatctgcctacctatctatcgatcgacctctcatctcaaaccatgtgagaaaggaggcaaaggcagcgtgtgtgcaggcgtgacatgccactgtgtgactgtgactgtaggattgcctgggaggtcatgcatgcaggcggttctctagctagctatagccaacttgatcgcactgttgcgcattcaatcgcatgttagccggtgcggggctcaccatgtcaggcataaaatatgttatctatgcacctgcttagctgctaggctaggctgctgctagcagaaatcaagcaagctggctgagtagtacggaagtggatttcttgctccctagctccgtcctaaaaataagaaattt

SEQ ID NO: 58460 - DNA, 18096 bp, Oryza sativa
ttcacccaaaaacttttatattttgagatacagggagtatatagagtagacatggaggaaaaggaatatttacgtggtaaactcctctgccgccatcacccctctgcctgatctgggagggagagggagagggaggggagggaatcaaggaagtgaaggagaggggtggaggatgagggtaggaagtgagggacttagccgagatgaatggttggaggcagattttataaggtatctaactttttgtaagccgatatttttacgtctcgtgtgtgaaaatcgatttttacatgtgtgatctaaagaggtccgtctgtaaaaataattcttacctcttaagaccatacctgtaaaaatcgactagttttaattttataggcaagactagttttattgtacctttacttatttttgaaaatggtaattttttttacctttacttatttttgtaaatggtaattttatagtctatctggaaaaataaaataatgatgttggaaaaaatcgtcttgaaaattcctacagtatatttttccctcaaataaaaaaactcttattttttattaaaaaaaactatgattccgtatatccgtggacagaggaagaagtttttgtgatgcgggacggggggtaacaacagcagcatatgcatgtttgcacgcatggatgcatgcgaagggtgtcgagtagtccccccttgcacgtgtgcgcgaatggtttgtgttcccttgcaatgccgcatggcatactgtgtgcgggatattggacgcatattatggcttatggggcaccgatcgatcgattattctatcatagattcaaatatacgatatctacactatgatcgaattgttcttattcataaacattatggtatacagcactattatgttcctgccttcctggtatatatccattaagttaggcccttgctctattgtcagtggactggcatctcttaggacatgtacaatggtctttattagcggtctctctttattgtcatgcaagcatatttggtgacgtggaagagagaggaagtaggaaagagaaagatggttgctacgcatgacaacggtgtagagtcgactcttagcatttattagaaaatttttttgttgcattgagtctaataaaggaaagatgactagtaagaaagtattttggtacattaatggttagagactgtactggcttaactattgtaacgtgatagcctctaattaacgtagagaccacaccgatctctacctttgtacttgcccttatttagccatttttctgcaacgagaaatggtaattaagatatggacattgatatgtctaaattaattaaggatcccataccttctagaaatcttgctgcttgtaaccctaggcgttatatcaattcagcggatattccatgggcatgcctttacgttgctattgcatattctggctcaactgctaaggctctaagaaaacaaaaggaaaatgggaaaacgttatttcgctggtgttattatattttgctagagagagacgacatatgtagatggttttttttcttctgaaaactcatgtatttattcgatataggagttctcacatgcaaacagattacatgtgccatttggacatctctcagaaaaagagagattgagttgctagctctcagtagaacaagcagctggtagaagtacaacacaacatgcaaaaggatccttgaaaaaggacaagttatacaaaggtccttgaaatatgtaaagaaggacacgaaaagaaaatagaaaagcattccagtccttgcttcgctttttctccctcaccggtgacctagatgatgaagccgacaacggctatggtgaaaacaaggttgactgcaaaagatgacatccagccacaaacccaacaggggcctcgtaaagtagaggttgaaatgaactcgacactactgcaggatagatttttgtggacgccgcccccttttatttccatgcgatctgtaagtggaaccgcacgggaaaataggaagaccggcgccaagccgtcgcccgcacgggaaaacgaattatcccgtgtgggcggcttaagccaaccgcacgcgaaaatagaattattttcccatgcggatccttaagaggcccacacaggaaaatcgattttcgcatgtgggcctcttaaaggcctgtctataagtctatcattcctccccttatccctcctcgatacttcaaaatttcatccttatccaccactcttccttatcttcaaaatatctctcctctctcactctcacctctccttcacatccttatctcctcgcctcgggattgcatcctcacatcctcacctcggttggcgcactgatcaactgcatcgggacgatgacgacgaggaggcggccagcttcctcgccctccggcggcggctcccttgccctccagccgggagctacgacgacgaggaggaggcgaccggctccctcgccctccggccgggagctacaatgatgacgaggaggcggccgggagcggcgcagccggccgaatcaacgccgcccctgtagccgacgacgacgaggaggcggtggcctcgagcgagcgagcgagcggcgggtggcgcagttccctcaatctctggcctcgagcgacgacaacgaggaggaggcggtcgggagcggcgccgccggcctgatcaggccgccgacgaggaggcgcctgtcgcggctgctggtggaggcagcgcggtggccgccgccgacgtcgaggaggaggaggcgacagtcgggagcggcgccgctgccgatgacgacgaggaggaggcggccgggagcggcgccaccgtccccacctcatgcggccgccgacgatgatgatgaggaggctgctaggagcggcaccgcccttcccacgccaggatccggcggtggcggctgccctccggctagatctagcggcggcagcagggagcggtggatctagggttagggtttcggtaatttgtgaattttatttttttttcaggtttttatttttcgtgcgggcgacataagcacccgcacggaaaaatccaattttcgcgtgcgggggcgcctcccgcactcaaaaatcacgattttcgcagacgagtagttgcgtgcgggccattcattcgcatgcgaaaatattttttgactgcacggaaaaacccttcctgtagtagtgcgatgaacaagagaagtttcagtcaaaccttggagataccccatcgaagacaaggaaggacaccagaccagcagcgacaacctcactggagatgatttgaaagaccagcaccacctcatcgttgtggaggaagaagtgttcccaccacagggaatatctgttgcacttgtggatctaacaccaacagaaacctccatagcaaccctctgaaccgcatgaagctgagaaatcccggattgaactcaagctgagcatggaagggagcatctgggatgaagaagatgggtgttgacatcgccttcgagctgtacacaaaagaggaagaagaaaacctagaacgagataaactcgatacataacgggataaatctgaccacgggatgaacacaatagctccctgaacccccaccccccccccccacgcgtcaacggcgactagctgccaccacaagcgtaggggagaggggtttcagcgaagtggaaaggaggagtctggctgttcactttttaccgccaacgggagagaaaggataaggttgatagagagaccccatgacatacgtagatgtggagtattattaatgcaagcacggaaggagaaataatgaattaatgaacctcggttgaaaggcctctctgtttggcccaatcgagttagtaataagtccgtttcatctccctcatcttttgctcttgattgagtcacatccctcgattacaaaatcaggtataatgcttcccttaacttaaaaaacaggtgcaaatcagctcattcattggtttaggaagcagtttcttcatgtggggcccacatgtcagtgagacatgacaaaacatatgcggtgggccctacttgacagtggcagtagcggccgtgtgtgcgagaatgcagccatggatgtgcgcaacaacactacttcaacacccagttccgttgatattgctcactcgtgccccttgccgcctcgtcctcctcctcctcctttgcagatggcatggtggttgtcggagacccacgctgcgagctcctcccaccgaccaccgacggggcgcctaggagaactgcaccacgaactcctcccgtactgaaggcaggcggtgcacacgtattggaggatgctgggcacgataacctctacatcagcatacaccatgcgggcactttgccgtcggcaacgaagcagccggctgggggaggagccaacagcgtggaggcacgggagggttgggagaaggtgcagatgcatattcgaaggggttgggcacaactacgtatttgccagcttacactatgctggcgctatgctcccaccgacaacggagccaccgactaggggaggaagctgcaccggggcaacaggtttcgatcactgaagctatccatggatgagctgctccccgcggagcccgttggtgttacgtatcaggcgctgctcaaactttccatcgtagatgccaccgagcttctcctccacttccttcaccatgcacggtgcccaagaccctccctcatcccctaagcgtagaaccgccatcgtcactgccactggccattagaggatgatgcatcggagaaagaagaggacggacgggatgtgtatctgggcgatggacaacgaagacgcaacgggacagcgaatgtgatgccacgttaggggaggaagacggtgtatggaatggcgcatcgccggctccctcgcttccctcctctcctcctccactgctatagaccgccttcctcgccggctgccaccctcactaccttgaagtcaatagccgggaatgtggacaagttgacacgggagcatcggcttcctccgacacaaccttgaggttattgggtcgggaacagggacgggttgacacacaagcggttgaggtggagctcggccacacagacgacagatgcgaaggggtagaggagaaaggtgaggtcaatgaggagcgcgaggaagagtaagagtaggagcgggcgagaggaagtggatgaggatggggacgaagaagaatgtcagcggtggggaggtggtgaaagggggagagagaagaaggaatgagaggggggtgacatatggatcccactattatttttttaaagcttgtactgctgactcagcaaaaaacgcttcctaaccaatgaaagagctgatttgcactggtttttgaagttgagagatgcgttatatcctattttatggttgacggatgcatttttggatcaagggcaagacagaaagatgtaaaatagacttattccctcgagtcatatggaattgaatgcccaaagaagtaagtcacgtatgttcaactggatcgttgggccgtccaacttgggctcacttgtgacgaggataacgtaacacttggaataagttcatctaaggtcccttaactttacactaaatcctattttcgaccttaaaccccaaaaccagatacaactggtcccttaactatcaaaaccagtgcaaacaaagtccctcgacggtttgtaaggcggttttgactgacgtggcgcctacgtagctggtttgactaggtcttcatcccacgtggcattgacgtgacgcttatgtggcaattctatcccagaaaaataatagaaaccgtgggctcacatatcagtctcactcctccatccctctctcttctctctctgttcttcctcatcctcactcccctcttcttccctctcccctctctctcttcttcttcttcttcccggggagtgccggagcggacggggcgggtgggcggcggagcaggcgagcgaggcgggctgtccgagctccggcggtgggcaacggcgccggcgacgggagcctcgaccgggggagaggaggcgccgcggtagccggagccggggtggtcggcactgcggcgggtgaggtggtggttggcgcggcggcggagagaagctgctgctgcatctccagcatgatgcagactctgctttccggattgcttgctattggaagaattgaggagtcgatccctgctattggaagagttgagctagataacatatcactgacagttaagctatagctatttttttctccatatcttaattttcttttgttgacaaaaccattgctatgcggccagttcatagatcatcaggcacacgttcaattcacaacaagtacttttctttgcgaatccacaatccccgctacgaccggccgcctcgccatgccagtatatgccttggcgaccccttcccgaccggcggcgtggtggtcggcgccgccgcggggtcttgcgccggccgcatccccgccctcagtaccgctgccgccgctgtcgaactccatatccttctcgagcgtgacggcgatggcgccggagtggtcatcctcgtcgtcggagcccgcggtcgagcgctccgactcctgcggctactggtccagctgtcgcgtgagcagccacggtcaccaccacgaggccgcggaagacgacgacccgtcggagagtgaaggcggcggcgagggcgccgcctcgccgaggtcgctggccgcagtcagtgtccgaagaagagagaggataatgggaagaagaggagggcagtgaggatgacatgtggggcccacgtaggtcccaccattttttattttgtgtgtgtgaaactgacacgtgggtctcacgggttttattattttttcggatcgaattgacacgtacgcgccacgtcggtgccacgtcagttgaagaccgagtcaaattagccacgtagacgccacattggccaaaaccaccatgtaaaccaccgagggatctcatatgcactggttttgatagttgagggacccgttgtatctggttttgcggttgaaggatgaaaatcggattcgttgacaagttaagggacctcggatgaacttgttcccgtaacgcttcgctatattttggcccgcaaaagcccctcggatttccttctctgattctccctcgcaacctcctcgtccgcatttttgggaacacgcccggacgttcccacgcatggctcacgaggcatgtgagttgataactgataaaccggttcgtcggagcccaagtacgagctgaccaaggaggttctccgaaaccaccacaccgagaaccaccagaccaccggtggaatcgccgaactccacgccagcgacgaaaacaaaaatactcggtgaagaacgcgcgcgtcgacgtcagtgagcagcaacgggccgcgccgcgcgcgacgccatcgggaacaggggcagcgcgccgcgccgcgcgcccagctccgcacatgcgcgcacgcacgcacgcacgaacacgggcaaccgaactcgaggccgtataggaaattcccacccaaaaaaacaccacaagtagacgatagaagagcttagcgcgcgcggagtcggcaccacccaccgttgctctcgcggcgttcgcgcgggggcgggaatctgaagacccgctcgccgcgtgcggacaagcgcggcggcggcttatgcttgttcctgcacgcgcggcgagctacgtcaccgattaccgaattaccgaccgcggtcaaagaaagttctactgtagggctgacgcgtgggcccactcccaagcggtcctctggtgggccctacgtgccagtcgctgcgtattgcttctctcctggggatttgggatgattaattattggatgacgcacttgctagctaaaccatcttggcttgtttgtttgttgtcaagatggagagcatatatgctcctctggtttcactgcctcctcctagctaatactcctactcctaccattttatgtaatcctaaaagttggcgctcctgttgctacttggtactacagtgcttctgatctgatgagtagactaggatgtgatgtgagcgtgtgagcgaccacatccaattcagggtggttcaaattcaccaagatgcctaagcgatcaatcagcataaagctgtggtgtggttggccatacaaataacagcatctagcacatgcaaatttggcctggatattgtttgggtcaaactttctacttctctgaaagctatcgttaaaacattgatgtgatgttacagtctcgcgcacgcagacctgcaggcgtcctttggcactatggatccaaaccacgggttcgcttgcaaaggttgcatggtgtatacaattgcagcaaccgtgttcccctttgggatcagatattccaaacacaattatgaactcccaattttaacatgcgcaaaaccagcgccttgcccccctgattggatttcagaaatttgttgcccgccgggccgtttgtgatcatgagcatcgaaatggaagaacaatttttagaacctaggattgatcgatcgttcaacggtttcttcctgacttcctgacactacagttattcataacacgagcacatatgcatttgatggcacgatcgatatgccaattcttcatgtaaatacaaagtagacttaactgcaaaccaagataacacgcattaatgccgatcgctcgctgcatctcctaactacgtacacctctgctctactggcctcacaacgaacgagttatagcttggttggctaatcaaacaaggctttggtcgatcggttggttggccactgtcactgatcagtgatcgctcactcactcctcgccgaagacggcctcccatacgtcctcgaaggcggcgaggatggccgggtggtgctgcggcgagttgagcgagaggtacgaccccaggagctcctccatctccggcacgctgcagatgcgccgctccacgaccatctccaccatcgagctccggaagtcggcgtacgggttgctcgaccgcttcaccaccgccatgcccgcgccggcggcggtgtcgtcgtccgtgcccagctgcctcttgatcgccgtctcctccttcttcttcatgtcgttgtgctgcttcttcgtcgccgccacggataccaccggccggaaggcgtcggccgggtcgctggtgatcctcgccgacgcgcgccgcgccggcgggcggcgcgccggcgcgttcttgtggcccttcctggcgaggctgctgctgctgttggtgtggtagaactccgaggtggagtcggaggagaagctgagggacgagaagagcgtcctcgtgtcggcctcctcgccgccctcctcgtcggtgctgaacggcgcgagctcgtcgtcggtcaccgtggacgacgaggagctgtactgccccggtgcccccctcgggagccgcgcgcggccccaggaggacgacgggcaatgccgcctggatgtcgacggcgaagagcgcgcctttctcctcgccctgctctgtttcctgccatccttcgtcggcaacgacgacgagtacggcaggaggggcgcgtcggagtggacggagcggcggccggaggtggccccggccccgccggtgcagtcgatggagatgtggaccagcgacgcgctgcgtcggcgtcggcggggacggccgggggcatcaagcttgggcctctggtaggtgcagggggtgcagaagtacggcgagggcggcggcggcggttcttggtgcgtgtcggcattggtcttgtcgaggctgacgaaggccgtggacgaggtggtcgttgtcgtggtggtggtgttggtggtgcaagtagatcgcactaggatctgagccagcctctgcttcagccagccaccggcgcccaagccgtcgaggcggcggtgggggctcttgtccacgaaaggcgtgtgcatcgcggtattctttgggtgtttggaaatgggttgaggaggggagagtggagtttttttttggtttatctcacgtcgcggcttggtttgcgcctccttataagcttctcgggagtgtggtttgcatcgtgtgaaatgtctaatggagattgcatgagacagagaatgcagtaggaagccggtagaaggggagggggtagaagtgtacaaagtgtacatcgaaatttctcggctatgtacgcacgtgtagtgatgcggtggagtggtggggttaggcaagagatgtgataagagaaggttgatttgcacatttgcaatcaggtttcatatattcatgaatatatgacatagagtactaagtaggagtatgtactttttttagataatgaggagtatgtacttgcattacaatggtcaatgggtcaatgctaataacattaaaaggagagtgggtgatacgtggatttaacataaaaagaggattttttttatccagacatttctttttctgcttttctttcacgatttttttttcggagcgcaccattcgttttttttttcttagcgtgcgctacgtgccagggggagaagtgggaaggacagctagggtgatagaaaaagaccgaaccaagagaccgagaccgagaaattcggtcatcaattcggtcatagatagtgaaagatgaaattttattcggtcaattcggttagtctcttcggttaaccaaatagacagaaaagaccgaattatcaaaaaaatgtctaaatgcaacctacaatccactatgtttaataggattaaactctaattttcacgtacctacttcttctaggcatgcaacctaataagagtctttactcataagtacttacgaattttttttgtgatttttgtgttgaaaatttccattatttctttgcatatatggaaatgttgttgaatttcggtcgagaccgagaccgaatttgtcggtcctaacatttttttcgctgaaattcggtcttcactcttttcaaagactgaaaccaaaattttcggttagatcgaatgtccgcccctaaggacaacgacgattgtgcttttatagttgtagatatttgctgctccaccattttgcatgacgggatgatgttagctgtcaaaacaatttatacgaggaaaggcaacaatgtccttttgtttccttgacttggtgttatcctcaatccttcaatcctaaaacctccattccagtctctcgcatgaaaaatatattcctcttcttttttttttttttgcaaaatttgatatatgacacccaaagaacgtgtatcttcttgttgatattgtaaaaatgtggtaattagttactggacacccaccgtattattttattatttccgatggaaacagagagagaaactttcataacagacaagtttgcccacgggccatctgtataattgatgtcattaacttcttagttaacattttataagtcgggcccactcgtcaatctcatatctccttctctattcctcttctccctcggcagcaggtggtggtggagctggttagccgcgatagcggcagagtcgcagagcagtcgcggggagaagagtcgcagagcagtcgcggggagaagaaaaacccgaagccgtcgtcatcgccgccagtgaccccgagctcccaggtgagcagcacctcctcgaccacccctgcggccgctcccctggacagcgcgaggagcagcgccagcagcagcgcgaacgccgccagtagtgactgcgcgaatttggctagtggcgtcgctgaggaggaggctggtggccattgccgcgcgcgggggaggagagtggccgccactagggcctgggggccagttgcagaggaggagctatgacccgcggacggtgaggtcgccccacaggccggtggcgtcgccgaggaggccggcgaccatcgccaccctctgccgcgctcgctcgcagaagaagaaaagagaagaaaagagaggaaaagaaagaaaagaggagaaaagagacatgaactttcaacgctctttctctctctattttcaccggaaataataaaataatgtctcggtgtccagcagctaattaccatatttttacagtgcccacgagaagatatactttttttcacagcaaaggccacaagctttaagtgtcatgtagcaaattttgtctttttttatccggccggtggaaaaaaaagggctccgaccgatttttaataagattgaggaagttctagaacaagtgcaacatcgggccaactccaactagcttagggcctatttggcacagctccagctccaactccacctctcagccaaacaatttcagttccaccaaatatgggagtagagttgggtggagctctatcacaaaatgaactagagttgtgcagctgggtttaagcaaccccacaactctgcttcagacccaactcctgtagctaaatttaggagttgaagctgtaccaaataagtcattagtaaaactgtgctgcaaggagagatgttggcgggctccacttctattataagtgatggcaaatgactaagaacatgtttgtttggaatgtttccttcatcaactttctcgttatccattagcatgttttctcaaccactgaacggtgtatattatgtaaaagttttctatatagaagctcttaaaaaatcaaataaattcattttcaagattatagtatacgttaatgatccatcccagcggcctacaactacagccatacaaccgatttaaactcagcctaaaataccaagtaacattctttttagtgttatatctctaattaagcactttggtgtggtaaaaatgtgaatttcccaaaagaagctacttaagtgaagtactgaatgaaatagaattgtcaaagaaatgtcactggtggagtttgtggatgttactataatgtttttatgaaatttgtcaaactttcaaaaaaaaaataaaacaccaaaacttgttaaaatatggaacagagggagcaggtgacattatgaacttattgaaagtttcctttaggacgtgaggaactgaggactatttcaaagaaggcttccaagtttttattttctttcccaatcctttatatattaagtatcatgtatatatgccctgccatctctattgtccattggtagctgcggactgccgcgttttggccttggccaccggcgtccggatgggattatgggatgcggtgcggaccatgcggtcatgcggatggatgacggatgcacactcgcagtcacaggcagcactgcagtgccgcgcacgtcgttcagagcacaatcacaaaaaccagcaagaatgtggcgggcccgacgacgccccgtacgtgccaggcggctggtcgaggcagtcgaacatgctggctgccggccgcgctggtggtggtagcgagcgccgagcgcgcccgccgcccgtgtaggtgtcgggtggctgtgcctgtgcgtgactcgctcccgttgacctctctgcgcgcgccggccggacggaccagcggtcggagccgcgcgtcgcggaagtggaggagaataagatgtcctcatgcgcggcagccgcgggcacgcggggttcggtggttcggtcggtggctctcgcgatcgtccccgtgatccggcgcgtgcatggtggtcgtcgtacgtaccggttcatcaccacgcgcaagcagagcgtgatctggcccacctcgcgccgcgccacggccacttgccgcatattccgccctggtacagcgatggatcatatatatcccagccatttcgctcatctctctcttaaaatgatagagaattcattgtggcatttgtttcatagaaactataggagtactatacaaagttgtaggttgaaatcggacgaactacaaaaacaatttaattaaaacaagaaaaaattttgaaacactagtctaaagagagtcgtaacgaacctccatctacgcggaactatagtggcttaagttacatgtcgtttttgttttcctcaatctataaaacagaaactccgaaatcagcgggtaataattgtgccgattgaatttcactatattgtatgatccttcttttctagtctattgctgctactgactctacaacgggttttacctagcactagggtttggtaaattttatttgagaattcaaaatttccaaaaaagaaaagaggataaacatttagaaaatttgatgtaagtagtatttaaattgtagtgttatctagtgaaaaaatttcgtgaaaaaaggaagttaacatcatatttttgagccaaagtgataattcaaaaatgacaaagaacaaacgagatttttaattgcttgaatgttaaaaataaagcaaaagtcataccgagttttcctatgttacattaatatatggcatttctacatgttctaaatgtcccctacatacttttgtaattatcctgaatttccccttaattttttactgcttttcattttttttctttcattttgttttcttacaaacagttagcggtaaccgcgtcttatactgtacagttcccaatagccgtcgaaaaagttgaattctcaagccgtgaagaacgattgtgaaggcattacaaatttacaatacataggattaggagtacgttgatcgggtttaatataatttacgagatacccctacttcgtcgctaatgtctggacttgctcggtatcacgactcacgaggcatcttaaggtgcaggataagcatacacatttcacggcttattctctctgattgatgttccactgaggccgagaagacattctgacctcaatgtgcaatgtttcaacagagtagacggcaccaaacacaaacaaacattctgccttctagccagctatatatattcagtactactccctcacttcgatttcaaaccaaagtacgggtttaactaataatcagtacaaaaccaacggcctaatttcgctctcacctaggtgatccttccaccacaaagtttgtaaccacatgattaggatgtagcggaatgtttcatcctcccaatgcagtaggaggcagcctaattacagcatcgtcagtgtacgcgtcctcctctaccgtaacacgacgaaaggttaggcatgtacagatctactgcaaattaaagcaaccatatgcatataatctcatacacgtacaaggctaagtccaaggtggagaaattaaagatcaggtaacgaaagaacagttaaaggctgcacggtccttgaatcttgaccccgtggactgaagtacaatgaaaaagaaaccaaaaggtcttcgtagatttcaaatgcctttggacttgatgtgtgtaatggccaagaacaaagggacaggtgatgcaaaacaagcgttgtgttttgcagcgtaagcttgctgtgccagttacaggagaaatggtattaacttattatgagtactatggtaggtaaggggatgaagggatagtggctaattatgtagtactacgctggagtggtgatcagtcttggaaaaggctctaacacagcgattatattatgaaagagaagggagagggttttgttcctttctcacttgtcttgttatgtcacaggctgaacttaggtgcagtggtgcatgctagagatgctcctcctggagtctctcatctctgcatcaacctactcatgcatctactaaattccaacttgccatcacgttgtgtatagcttctgacattggcatgtgaacaaagataagagcgatctggctgacatgattgcgagcagtcataaaacgcaccttcttaatatgagctttgattgtataaacgcccagaggccctcttccgtacttctgctccatgtataccacgttggaattcacaacttgtcttctaaaaatctctgttatctgacacgcatatctagctacgtcattggtcagtgacatacttctaccaccataccatagcaaatcaggggtcagtactgctgactaccttcttcacctgagccaaagtgccccttgacgtcttgatcatcaatcggagctagagtagtgtcacgcagagatatctctgcgattccggcaggtgtaccatgcacgtggaaacacaactgaacggggccaatgtacgcgctggctgtggtcacacacaaacacaaggggagagctactccagtagactgtgtcgcgtaacggatccggtgcagatggggggctaccaattccggcctagctaccactgttctggtgccgatccagatgagcatgcaggcgcatgataggtgagtcactgctcaaacgaatccgagcgacaaaaagaaggttatccatatacggcgcacgtctgtacggccgagggtgagtcttggaaaggttcaacgaacgaacaatccgaacagtcgtacgtgccttctggccgggccttggctagtcatccacctttgtgcttgccgctttgtggttgccgtcatccaccttcacggtgcctccaccgtggagagctgatgatcgagtaagatgatgttcatttctatactaatggcactgcaatggacaatcctagctatcggtgatactactatacactgattgcctctcggtaattcaaatattgctaaatggcaaaatggacagatctcttgcttttgtgatcagatagacgaaggagctcctgttcggaatgaggaatttcacaattaagaagattcatagggatcaaaatagagttagtcatgaattaacaagtattgcttgaacccagaagatgtcaaacttctagctggatcatgattgtaccctcaccaaacagatgatcattcaggatcagtctgagattcatgattaatgaaatccccttttccccgtaaaactaatataaagttagaacatacaaaataaaaaaccattatcgtgtaattaattaaatttgaattactacaaacttttaaaaatggatctatctaatattttaaaatagcttttatatatatataaaactttcacacaaaatactttggtttagcagtttaaaaaacgtgttatcgaacacgaggtgaaatcataaaagaacgggcctaagggattgtttggttaccagccaaactttgtcatagtttgccatacctaaggttaagcaagtttgatcacattggcaactgtagttgtgacaaaattctctttcaataaattgggtctcacacatcattggctcaaaaagtgttggcaaagatttccttaaacttggaatttgatctttaagatgtagctaagaatttgatcatctcaacttagataagtataacaatatttgttgataaagagttgtagagtatagccgagaatgcgagaaccaaacacaacctaaaaccacgttatagactgtacgagacgctctcccccttccgagaccactcctgagtcctgacctgagcagtgacttgctttaccgtgaataatgtcctcgattgggggcctttggatgctgacgcagtttacgacccttttcttctcttctgctgcggcatatgtaggcgtggatctgcgtcgagcagtagcactgtagcaagcaacagcagcggatgactgacagtcgctgcaaggcggtacgcctgcctgaagtcccatgggtgcccggcaacgtgggttgctgaacttctcatgatgcgcggctcccgcggtccggccgctgcaaagacgccagccagtcagtcaggcacacagacgcacagttcaccgttcgcttccaaatccaactggagtatcacttgccactggtttgagtataattgagtataatcaatggatggaaaggaatagatggatgcatttgagagcctacgagatttgccagattgatagacgcatgtgatctcgcaaggccctgcatgcttaccgggcgcaattaatgaacgctaacaaaaccctggttctgaaatcaacgtctccgccgctgagtgcacggccatatacacgcgacttgtaggatccaggtcccagctgtagagatcgcgtcgttggctcagaaacatcctgtcatcttcctatactacaatagccataaatagcgacatccaaacatgtactaattgcaatactagtcgtatatgagacaatctatgtcgattggtgatcaagtgtcaatatagctgaaatcgtcatgatgtttcggttatggatggatgcgaatat

SEQ ID NO: 58461 - DNA, 2337 bp, Oryza sativa
ggacgaaaaggaagaaaagacagacacccattggaaaaactttcacgtgtccacaatcaagcactaacactgcagtagtgtgtgcgatgtaactgggcagatcagatcctgacccattccacttatcagatactagttcagtcccccacaaaattggtggttcacttgtgtacaatggtaatagtaagcacaagaagttgggagtgggacatgtcaatgagttggcatcacccaacacacttccatccccagatgggcatatagaaaagagaagacctatggagctactgtgatttactataccaggaagcactctctttcagtctactatgtatggtgatttaggtagggtaagataagccttcacagtttcactgtgatctgccccaacacacttgaagaagataagaactgtgcaaaacaggaaggaagcaggaaagacgaccgagaaagtgaggcagtcagctacatcaaatttcttgctattgcagggcatctatgcggaaagtgggaactttccattatcacgattcacgaatgaagcaagctccagtgaaaataaacagtgattggtcaaacagaagactgataataaattttacagtacatatgctatttatttcaactacagtttacagaagggcctcccaactgttctttttcaactaaatggacatgccatcgttctgcaaattagaatatttgtcatttattagagagtgtgcttgtcatgcaaattaatccattcggcacaactgtacgttgtgagaataaaagaaacaaaacagcattctcaggcatgatctcactctagcagttcatgctggtaagaaattttgtcttcatcaacacatatggaaaatgcaatgttcttgatatataactattgtctgcattctttctattaccagaagatggcagcagaattttaaccttgaagtttaagcaggatgatctttttaagaaaaaggggtcagctgccaggccattatactattcctgatccatatccgctacctaattgtttcttcaaaccaaacttagaagccatattaaaattctcaacaagctaaccagtcaatacaagtatgtcttccattggtaattgcagtatctgctcagctaaccacaatgcttgacggaccaatgttttaaagacatttgcagactcagatactgtaaactataaaagttgcctttgcatgtaatattaggcttaaaagctggagcctaattagtaattaactttcctgatccagcctccaccctggagagaacgaatttacattacaatccattcatcacaagtattattcattatgttcaaattccgctaactggacttatcatcatatagaagtcaggaaaacaaggagaaggtcaagaaaacatacatgaattcttaacactgcaagcttataaaagattcagaatctatattgccaggagtactttactccctctgatctcaaaaccaagttgttttggactttccatggtcaaatatatacaacttcgactacctagttctttagcacatattaaaaaaaaggttacacaagtgtaatattatgaaagctcttgttataacaaacttgaatatcatttttatatacccaaaatctatactttgaatgatttttatggtcaaaattaacttgtgtgactgcacgcattcttaaataacttgtttttgagaccagagggagtactagctacttaggacctataaacttttgagaattgaaatgctttgagaaaaataatatgctgctactgcagcagcttctaagaattccttagcttattgaaaatgactaatgagtacttattctgctgtagattcacttattgagtggtcttgataaacacatatacaaattcttcactcattcctgtactgccaatagcatcttccctagtgaagtcaatagcattttaagtgagatactaacacatcattctaaattttattttccatacaaactagctggaaattaaccaacaccccaaatgtacagaggtgataacaatacaaaaaaaccaacatctgaattgacatttctttaaaaaaattagaacggtcctctagatagtagaatttaggcactaagacaaacttggaaataacaaatttggttgtaaagtaggtcatgcgtgtcctatagacacatgctaagatggaacgatacaacgcggattagagaagagaataggagtgaatacagataagtatcacattaaaactttgctatcttccaaaaccatgaactcactagcaaattaatttgtattagcaccattcagtacccttgttgcatatagtctagaactcta

SEQ ID NO: 58462 - DNA, 2192 bp, Oryza sativa
catctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcaaaaattcaaaaattacagtgtaacttacaaaagttacagtgtaagttttataaattacactgtaacttacaagaaaatgcactgtaaatttgagtgagaaaatcgagtgagagataagaaaaaatctttcgagtgagatatagcaaaatcgggcctgtctctttaattctgatggaaagtaaacaaaaaaaaatcgttgaccatttatccatgttgaatttttctgcagacctcacgagaagcaaggaccacagaatttgatcccgctgcattttttttttttctaattggagtgtcacgtatacgtaaaattaaagtcacattggattaaaaccggttgaaccgtgaacataccatgtagaccgaaactgctatcaatattatcgagggattagatattattggttttagaagtcgggggaagctatacacggtacctggtattctgggatcgagcagatgtgcaatataaactctgtacctgtcatggcaggtaactctcaaagtcaaacttttcttgactggcttaacactggttatctgataatatcggtgccatcatgttctaactgcctatcaatcttgggaccactatgtagatgaacagtataaccaggctcatcgagctccactgatgatggctctcactgtctggtatctgggctcgtagctgtcttgtctgggcctgtactctcacgctgggctttgggactcttcgtgagccactcggtaccgctgtctagaatccgacatcgaaatctgcaaacacccactcgcctaacgttttacccaccacaatcatgatatttttacctttggagacgaattgcagttatgaaagctacattttagccttgtatttgtgcttaaaattttgaaacgccaacttgtcgaataacatatatgttttaaaagcaacaccgaataacaaattttcgtgagtgggtacacatatatatatgaatatataattttgggacatattcatcacagtacctcctgtcttgcatagttccatgcatgatctgaatggttgacacatgcacgccaggttgatttgcaaatatatagtaattttcaacagaaccagtacgtgtaaaatcaaaattctagcaaagaccgtagatatataatactccctcgtttcatattataagttcgtttgattattttcttagttaaacatctttaaatttaatcaaatttatagaaaatataacaatgttttcaacacaaaacaaacatattatgaaaacatattcaataatagatttaatgatattaatttcatattttagatgttaaatttttctataaacttaataaagtttgactaggaaaagagtcaaacgttttataatatgaaacggatgaagacacaacatgaagatcaacgacaatgcatcaatccatggtcctcacatatatatcggcagtggtagagtttgatctgctgatcagttacacgaatcagagcacaaacgtgctgtttatatatatatatatatatatatatatatatatatatatatatatatcatacaacacacacaatatggcacaatggtggcaaggtctgtttaatttgtgcacgtacgcaattacgcatgcagctgatgagcagccacaaacgctagcttgcaatgcatgctgacacatttttttttcacaacgcctaatgacaatactggttatgatgatctgacgaacacatagaattactgcatcgatttcttcaggttgatcacgctgttacgtagccgcgggtatcgacgccttcagatttcatctgcaacagatacaacacactttcagatttcaactacaagagatgtaagaaacagttactgagttaattattaagatgaatgccagtaatacatatactcccttcgtttctaaataactgacaacatttactttccatttgaatattgaacattgttttctctcaaatgttagaccaaagtgaacaaaagtccgatgcttgtatttaagatatagcacactttaataaca

SEQ ID NO: 58463 - DNA, 1196 bp, Oryza sativa
gccatgaaattacgatattggtctaatgaacaattgcatgtgatccactggatcatacagaggatcctgactcctcagagcattggttggctgcaataaccgctgtgtaatgcccataactttctgctcaggatttcttgtctgaagattttgctcagagaggtcatgcatgtttgcgtttgcacaacagtaactagtaagaatgttgaaagttctatagcatttaaagattgctcttactgttattctgatatctatatatgtccacatctcggagtcaattcggaaaatttagtactagttgaagaatgtagactgaaagaaatgacatgatgttacctgggcattgacttctgcaactgtgccagagttggaggtgtcactgtttgccttcttgtacctctcaacggtggatttcacactgcaatatgaccatgattagtcaagggttatgtttaatcactcctacacaagaaattaccagtttcagaacagtatagccaagacgactgcgaaaaaaaaaacttactcgctaggcaattccaaaaaagtttttttttctagaacatataattttcggcaagctagctatgagggagaaaagtatgataattaattgaatttactatcccgaaattatcgtataagtattggttttaaaagtttacacaagaggcaactgagcatagcttgtcagcatcttcatgtactactaaaaggacgaaaataaccaacatcaattagtaatacagagaatacagtataaataagtgcagtagaaagttgaaactgacattaatatctagtattccctccatttcatattataagtcatttgattttcttttctagtcaaactttgttagtttgatcaagtttataaaaaaatttaacatctaaaatatcaaattagtttcattaaattaaacattaattattttgataatatttttgttctatgttgaacatactaatatatttttctataatttaataaacttaaagaagtttgattagaaaaaaaaatcaaacgatttatcatatgaacaggagggaatacttcacatttagaatgtggcgttcaagggcaaatgaccatagttaaaacacaacatagcacattggtccgaatcgtgcgctatcacaagtcatcctcgctcattcatgaactactgcagagtagcacagtggagtac

SEQ ID NO: 58464 - DNA, 2424 bp, Oryza sativa
aaggttctccaaaaatattcttcaaagatcttctgttcatgcatgctactgtgaagtgactgctagctagctcatgtcttttcactacaacctttgaaattttcctttgtccaaacataaagcgtgcaattgctgcataaaatgactaacagacaatcatatcaaggcagcgagcactatcaatcccctccaacccaaatgaagattttcaggcaagaaattacttaatccctccatcctaaatataaaaacttttttcacctgctcctcaatatcaacctaccacaattatttcctattttatttcacctactcgctgtcattccttagaatttcttatattttgggtagcaaaaaagatgtccattatctaaaaaaatgcaaaaaagatgtcacattacagtggtaatgtaccagtaaacatattgttcgaggaccaaagaaattggagtaatggtagtactgaagtacagacatcaatcctactatcttcctggcaagaaagaaatgaaaccttaggattctcgagaacgctatttggctgcccaatgtgaagctgggcacaggatttcacatgattgggcagcaacagtgagactggttttaacccaatggacaaacgagggcaacaaggcagcaacgcacacacagagactacactacacaactgtaggcttttacccattcccattctgaccaaagccaccagcttttcttcactcctcttgtagtctcccaatacaaatgcaggcccagtagttgtaccattgctgccacgccattggacgccatttctactgcgacagtggctgcatggacacgtgtcatccgtacaagagaggcttctttttctttctctttttttttttttggtgaggatacatgagaggtttctgatccccatgtttaagcagtgcaacaaaacgtatatatgtgcttctaatttcgtttttcaaggaggattgattagtcgcgaagcaaaaaagaaaaagtcaatatgttttattaattgatttcaaatacttcatgcagaccacagtttttcagttttttcttcaacataactagacaacagtggccatgtgtgtaattttttttatgcctgcatgacatgttttcacataacattgaaactgatattttggtacacaaattttagttttctttatttgatgaaaaaacaaataagcttatcctgccacttttttatttacatgcatacgacacataactagaactaatagtcataacaaaatcatttgtaaaaaaagactagctaatatttttatataatcacattattcagtatgtatagcttatgaggaaagggagacatgcaaaaaatatggaacaatcatctttgtgtaaattctttcagtaaatcaaacgcatgcatatgtactcccctatatactttactgtatttttttcatctttactgctgtttctttgttggatcccttctttgtgtttggttcctgttcaaaagtacagtggtgctgtcaggcatcacctgccctcgtgaagttgctcgggactaaaatttgcaccacacagccacacacactcatgagagagagagagagagatgcacatggggatgaagccctaaccctagcagctcattggttggaaacaggagatgatgcaaaagaaactggaacacaagagagagagagagtgttatatcatcagctgcttgtttatccctctacccttatcacctgatcaaacatacatacactaacacttggcacattcatgtacaaactaactactagtacatcaatgccatggccaaccatacacactctccttgctatctagagatctgcttctacacaagcaaagctacacaaaagggaaagatgatgaatggagccccaggatgctctatattttttgtgcaaatatgtgtgtgatcatacacatcatgaggtgtgagagagatcttaaagctcacctctctctctctcttcatctatctctacagctagctctgccacacagacatacaagcacacagcttgccacagtggagagagaaaggaaaaaacataaatacagcaagaaaagagcaggaccaccaagccaaagaagaacatctctctctctctctcatctcacacacacaagagagagagagagagagagagagaaagaaaggaagcagcagcatactacacacagcaagcactgtcctagatctatctcaaacatctagctcacctcaccagaagcacaaaggaaagcagcaaaagaagctagctagcacacacacacaagcaagcaagagagaaactgttgcgattttctttctttccccccagaaacaccaaataacacgagacagttaataacagaagtaacaaaagatgcatctcccatttgaccctcccctctctttgcccccatgaaagctat

SEQ ID NO: 58465 - DNA, 1002 bp, Oryza sativa
  unsure (1)..(1002): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttttaagttgtctcacaagcttcctgtctttgccgctcatgaactgtgttgctatggttcttgactctttgagcccctcaagtatgggagtatttcttcttttgggcttaggagccacgtggttaaatagacatacttgtgattagtcaagtttgatcaagttatacatttgttgtgttttcgtagtatcgagtgtcgcaatgcagttttgatcccatacatgcaccagtgttcattgaaagcatggcgtgggttttatatgcaactaaagcgtgactgatttttattgttaaaggttggcaaatctagacattcttatcatattaaccaatcaatcatacagtgtgagcttattgtggataattttgctattctctaccgttctctccaagatgatagtcgctaatatcagcaagaaaattattatatatagccctcatctagaaatttggcgaacaatatgccaatgacacaaatcccttcttgcatgttatctaggggtcctacttttacaaactttaaattcgacatttctttatctataatcgaagcctatttacggaaaaccttaactttatttgcttaacttgttattagaggagagaaatgtgaccaagaggaatcaaggtattgacatttacctccatttcaaaaatatccatccttcaaggtcctcaaatgcaaaaggacatagagagaagccattaatcagaaacaaccctgcaaaaagttacaaacaaaaccacgaaattagaaacaggtccctcccctcaaagacctagagagaagccattaagcagaaacacccctgaaaaaaattacaaacaaaaccgagaaattacaaacaggtccctcccct

SEQ ID NO: 58466 - DNA, 9397 bp, Oryza sativa
cacgattgaatttgatcggtggttgtaaacggctgcagtatatatgaacatgctctattttgattgatctatggttacatgtctctaatttatatataaccatagtatcaatcaaaattagagacatgtatgagttgtacgatcgtacgtgtattagtataagaaaagcgtagagaatgtaagacgaagactagtagaagacgacgttgaatttacttctcttggattgagatggaggtgagagtggtagtagagcagtggtgtggtagtagtagcatttacaactgtagcgtgtctcgctccgtccccatgacaactttaactactgttgctcctcagaggcagtgaactaaatgcgcattcatggccgctggatctaacactcgtactactactaccgcgctcaaatagtcaattctacctcagctcatggtcatcggtgacatcaaaaggaaaccaaccgaacgatggatgaccaggtggcgtttgaatctagggactttaactttagtccctttatttagacactaatttagagtgttaaatatagactacttacaaaattaattatataaatgaaagctaattcgtgagacaaattttttaagcctaattaatccataattagaaaatgtttactggaacatcacataggctaatcatggattaattatgctcaatagattcgtctcgcgaattagtccaagattatagatgggttttattaatagtctacgtttaatatttattattagtgtccaaacatccgatgtgatagggacttaaatttgtaagcagagagaaatttgtaatcccattatgttcagataccacctcaaatttgtttcttcagatagttcagattatgttgggtgagagaagagggagagacaagcagagcaagccggccagccactggtggtggtcgtcttcaacgtcgtagtacgtacgtgcgtactctaatggcgccggccggccagccggacggccggacgggcaggcgagctggcatacggcgagatttgtcaggtcggccagtgcaagcaaaggctgctgctactgctgcagctgcagctgcaacgacgatggagagattgctactgccatttgcgagcaatttgcaactgcaaattaaaatatggccaaccgcgtggcccctccatctatctatagggtgtgtttaggccgtgtttagtttctcccctatttctaactttacatcacatcatatcacattataaaaatttttatacacataaacttttaattttttttctaaactcctaactttcttcaaactttcaattttttcaggaattaaacacaccctatagatagatgggagttggaagtttgaaaaaaaaaagtttggaactaaactcggcctatctaccgatgcccttgtttagttcccaactttttcatcacatcaaaatttttctacacatacaaatttttaacttttccgtcacatcgttctaattttaaccaaacttctaatttttgtgtgaactaaacacagccgatattcatcgatcgatcgatcgtcttctgactcacttgttactgctcatcaccgagttaccaacgcctattgccgatgcaaaaatgcaatgcagtaattcaatcgcgtgtactgcgtactgtcgcatgtgtatgtacgcgcgtactgatcgaaccgttcgatcggaagagagatcgagaagaacagatcaccatgcatgttcttctgatgtgtatctgcacggccggaaaatcgatcggggatctgtcctaccaagtgccccgggccctctgttttttaagaaattatagagacttttaaaacgattaagaatgagaacaaaaagaaaactattataaaagaaggggttgaaggtagaatggaaagaaaattaaactacgggtgattaatgtactagtactactaatcttttatatttgtgtacaaatgatgagctaccatgtcccttttattgtgaacggatagagtattttggatgtctctcatcgtctgtttgtagtcatgatcaaattttatactttaaaactttaattttgaacttaattttgatgttttctcattgtagttagtttttgtgtcattcactttttaaaccgctaagaagtaagaatacatatataaaattttatctataaattatttttagttatttagttcatttttctacctccgtagatcaaactatcatagcctagatactaaagccatgcatgcgtcggtgcattctaaggtgctgatagataatatattaatgataaaaactgagtttatgacaattattcgagagtaaaaacaaatgaattgaattttatgaaggttagtaaagttgatttttaaaagttttctaagaaacgttgacgaagaaagttttgggatgaatgagcttaattagaaagtgtgcatataataatccataatccaattaacacacacagattgctgattaacttgagaaagaaaaaaaatgcattgagagagaaggaataatcgaaaggactcatcttttggcttatgtgcttatcaactaaaatttgaacacctttaatttgaaggtgattttggagtttttcactgaagtttattttccagcctttacttttagatcgctaagaacacatatataaaagttttattcacaaattatttttcgtttgtaaatatgccgtttgacttatttcacagataaatcaaacgatggaggccctgttcttttatccaacaaaacttagattaaattctggatactcatggcacgcttttcaaactgctaaacggtgcgtttcgtgcgaaaactttctacatgaaagttgttctaaatatcagattaatccatttttcaagtttgtaataattaaaactcaattaatcacacgttattacaatctcgttttgcgtgaaatacttaattttcatcttcatcttcagagcattcaaacaccagtgtactacactattacatgcagtgtgaggtaattgcttggcaaattcgatcgatcgatgggggtgtgtggttaattgcactttcagtcttgcactactacacaccaaggactcttctgattttgtagagatagacgcatgtgaaggccacatggagaggctcgtgccactgtaaatgtaaaatgcccccacaaaccaattcaatactctactcctctcttcacacacgcatatgtgcgcattcaatgggatagatggacttttgtgagatgctgctacgtttgattttgattagcagggacttgtccttgggtagatggagttcatcaacagagatttttcagtgtttgtcaccagagaaaatgccatcaagagcaaggctttctttcttgattcttgttgaaatataacaccagagctaattaggactcatgctaaaatatgtttcgttgttggattattgctatgattgttaattaatttggagaatgaccagtggtaggtcactttatgaacgagcaacacacgagatataaccaaagcaagaaaaaggtaattaattatcaggacataccctactaataaatgtcatgtacctgcatatgccgttggcgaatggtgatggatctagacatttttggagtgtccgaaatatccgagaatgttgtgctctagagagtgacaaattgacaatccctttgcactgtttctttctcttttttttcttttgcaattatatgacagacagacgcatacgcaatgactgtatcctttaacatatgctcatagagatgtaaaccatcggcacatttctgatccaattgaattcctttaaggtccatttgcacgtgcgtaatattcataagcatcaggatttgaaccccgataagtttagtcatacacatccataactccaccaccacactactggtgctcccctcccccaggtccactaaatctttcctattcttgctatatatgcttgattcactgttgttattttgatttgtcacggaatttatcacctttgttcttgataatttgtctttctttctttcctttttgtattcaagctataatgggatgcagaaatttaaaacaaccacgcatgatatttacggtaaaaaaatataatgtttgctgtgaaccgtattactgcatatctcacaacatgcatgttactgtactgctacaaattaaaatagccataattgttccaaacacaggcccagagctttgcaaatgaaaacaaaagccccaaaacaacacacatatatatgtggagcccagaaccagacgaccacgtacgcagtaagcaacaagcaagcgaacagcactacagctaaccttcattaacttgatctgcatcaatggctcatggtggctcttctagtacagaccgatggcgacgccaagtcatcaagatctcacgaccagcacacaggaacgtcaacttgctgtcgatctgcaggatcaatgaaactcctacttaatttgctaacttaggacagccatttcagtagtgtaatgcagttaatactcccccaataacaaaatataagcatttctacacggtctatttatagagcttctgacagctacaatttctcttataattaaatgtctctaggttatttagcaaacactaggggttgagaaatggaaaaaaatttccatttcaatcacttgagtgatccaaatttgaatgtttaaatttcttagatttccctaccaagcacctaattggcgaaaaatgtattgatttccgtgcattagaatcaatgcctctgaagtatttatagtgccatacaaatttgaaatctaaaaatattatattttgaaatggagggacgtattttgtgtaagcatcagtcaacatatgtataggtggattgatatttcagtccgaagaattggatgtaatttgacagattctgtagtgaaatacatatataactgaaaactaaagcaactctgttttttatttagaaaaatggactaaaatccgatctccacgtctaaactggtttattatcacccgtcacggataactattagtatcgactgatagggacatgacacaggtgagtttttcacataagcgatcattctcctatgatcaaatacccaccacccgtcacatatacaagggttacgaacggttgcagctctaattgagggctttgtttagttcatgaaaagaaaaattttttgtgtcacatcggatgtttgaccggatgtcggaaggggttttcggacatgaacgaaaaaactaatttcataactcgcctggaaaccgcgagacgaatcttttgagcctaattaatccatcattagcacatgtgggttactgtaacacttatagctaatcataaactaattagactcaaaagattcttctcacgatttcccctctaaatgtgcaattagtttttttaatctatatttagtgctccttgaatgtgtccaaaaattaatgtgatgttttttaggaaaaaatttaaggaactaaaccaggccttagttgtgcgcggttgtgccttactagatcaagactccatgggaccgagctagcatggtgttcaagcgtgcttaatttggtcaatgtgaccagtagaagaccagtcttgctcaaaattgacaactcatggaaatggacgcatacacgaagaggagaaaaggctgaacaaaatgagagcttggcctcaagaagcaaagaagttaaagccataggagaagatgagcacagacgagtccagctaggtattgctagctagcttgaccatggctagcttctcttggatgcaaagagagaagagagaggcagcaatgaatgccctccccaaccacccgctgtgtcatctgcgacctcaatttaagctcaccatcaattcccatggcgccagctagctagccactctgttgtttccccctcccccgctatttatagccgcgctgtccttcccacgcttcactccaccaccaccaccccccatggcggcagcaaggatgaagaacaccaccatgggttgcgccttcctgctcgccgcgttcgccatggccgccgccttcgtccccgtggccgagtccaggaccacccccgtggagaagacgaccaccacccaagcaggtacgcacgttcatggcgtagagagcttgcattcttccatggttggtttgagtggtaatgtgtgttgttcgattacagaggatggtgtcaagaagccggactgcgtgccggcgttcgacccgcgctcgttccccggccacggcggcaccacgactccgacgccgatcccgggccaccacggcggcggcggctcatccgggaccacgccgtcgcacggcggcggcccctccgggggcgcgttgccttccccgtcccacggcggcgcggcgccgtcccacggaggagggtacggggcttccccgccggtgacgccctcccctggcggcggctacggcggcggctccccggcgccgtcccacggtggcggcgcctacgggagctccccttccacgccttctggcggcggctcctccccgacgccgtcccacggtggcggcgcgtacggcggcggcggagctccggcgacaccggcgtcgcacgacggccacggcctcatccccaccacccccgggacatgcgagtaagccacgtggcacctcacaaaaaaaatactccattaaatttcgttgctaatttagtcgctgacgagtggggcccctccatgcgtgcagctactggaggtcgcatccgatggagatgtggtcggcgctggggcggtggccgagctcggtgggccacttcttcggctccggctccggcggcgctggaacggggatgagcatccaggacgcgctggccaacacccgcggcgacggcgccggcgagctgatgcgggagggcgccgccgcgctgctcaactcgatgacccgctccggcttcccctacacggccgagcaggtgagggacgcgttcgcggcggcggcggggggaggctccgacggcgccgccgcggcgcaggcggcggcgttcaagaaggccaacgagggcggccgcgcgtagacgacgacgacgacgtacgcaacgtacgcatccgtgcatgcatgcatggcttaattgtttaattaggcgggaaaattaaaaagtacgtgtgttaaattagttgtgtggttgatttgatggtgatggtctggttgtgtacgtgtggttggtgtgtttatgcgtgtaaaatcatgtgtaatcactctcgtgtttaagtttttttttttttgctgtttcaaattcgatcggtggcaaatgaaggaagtgagcttatccttacatggttactgctggtgaatatttcttctggatttattttttcgtgttatactattcaactgcagtcataaattaaattgtcttggactggttcggtggaggtgaattgaaattgaccgtacgtgaaccattatagggccggataagtatcgctcgaagtgtcgtacgatacgagtgaattctgggccatttttccccgtgcaaagatgccctccggttagaggaaaaagtccatattacacaacgttttcttagttattaccaatattgattcatatttatgtcccaaacagtttcgatggtgattttatcataagtggttgactattgaaacccatatgtcaaatgtgagaagttaagaaatgtctatttaggagagtaagattacgagaaacagcttgttagtagccatctttggtaatatgaaaagactattttttcagcttatgccttctagttcattttctgaatagtacatctatatcttttgaaactgtagacgaaacactgattattttagtgagcttctaattttgatagaagctacagctgccaaaaactaaatgacattgagacctttgcacttaacccacatagcgttggcccccaccttcaacacatacattatttgtactatccttgtcatattcattgaactaagtcgcatcatacgtaatatatcattttaagctccgctctccttatattggagagacttgtttgggggttggcattggtttttccaacgagactgatttcgagaatctgaacatgagcggtagattgaacacccacacaatctcgatttgacataataacacttctcatgtggacaagaggaacagagcaactagaacacatagttatcgatatgttaggctacgacttaaacatagattcttttacccaagtgatcgggactcgtagaagtatctaatatgattaagaggggacagagctcggacctgcagtctccagttctcatgagcttgatgggaaactttaatttctcctgaaattttccaattttaccaaaagaaattcaaatctggggaaaaaggggtccaaaatgcaaacttattgaggccgaaatattctgaaaatttcgaaattctttgcctttcggcgacacatatagaaccctacacatataaccttcagagatcattatcattatgcgcttctacgcaaggggccggaatcaccaaattaacacaacaattaatcaggcaggcaggcaatcacgtagtgaaaggaaaataatgacgccagagccactacgatcaacgacgcctgcagcaacgtcgacaccgacgccacccgcgactccaccttcgtcctcgcctactccggtgccttcttcgaccggcgagcgcctcatctgtcaccaattagccaagtcagctgccatacttgttactttctccgtttcataatgtaagtcattctagcattttctacattaatattgatgtaaacggaggaagtacgtacgtactccgtagtaattagctagggtgatgggcccggctactaccaattctctgaactcaatatataggttctttgtcaaacatatgggccatgtaaatagggttaatttaccatacatctcagtttggattggcctggcccaaactagtagggaaagaaacagccttggttcttgggagaaggtcaggcctgctagctcaggcttgagctcggtgccactaagctcataaaccaaacgagccgagcccaaactttgtgtgctgggctcgttaagcttggtgcgagggccttgcgatggagctcctcccctaggctcctttagtttatccctatctcctctagctcattccttggataccgtaggtttcttttttcgcgagcgcgtaaaaggattgcacgccaatatattagaagaaaagagttatagttacacgacgcaattagccagaccggcttacgccaagggaaggggaaaaaacaaaggaaaaagtacgaattaccccctgaagtattgggtgagtacgaattacccccctaaacctgaagaccagtaatttttcaccctcaactatcgatatcggatgaaacccccccccccccccgaacagctt

SEQ ID NO: 58467 - DNA, 11860 bp, Oryza sativa
cagtggagggtgcggaggagcttgaagcggcgggaggaggggtagtgaaggggacggcggagctcgaagcggcgggaggaggaggcagtggaggggacggcggaggatggagctcgaggtggtggtgggggtgcctgtagccgacagcgcgcggctcgtcaaggcaatgttggggacgcctgcagccagtgacgctcgaggaggtggagaaggcggcggaacgagccaagggcggcggccggcggagcttgggcgacggaggaggcgctcgctgccgccggcacgcgagccgtaggcaccagcatctgatgagagagaggggggtgagagggaaagagatagagagaagaaatatctgacaggtgggccctattgtttttttaataaaaaaaattgctgactggactgccacgtagaccaaaaccgcttgcaaagttgctcgggggagtttttcatctggtatcgatagttgagggtgaaaaatgtctggtttttgggttttagggggtaattcatactcacccaatacttcaggggggtaatttgtactttttccaagaagctgaagcttaaaaaactatgacggctaaacacaaactccaagcagcggaaaggggccgagccatgttgtactcccaacaagtccccaaaagtggcaatgccagctaaagaccacaaatggccctctgagtggatggactccagaaccactgagaccgaagagagcgcagagtcgaaaaccctagagttccgttccttccacagctgccaagagactaggaacaccagggagtcgaagccggccagcgcggagatgctcaggtaagcaggccctggaggatggccaccagtcctagaactagctgccacggggggagagagggcagcccagctaggcggcgacagcacatggagtcagacctgatgagcaaacacacagtcgaggaggatgtggtaccgcatgttcctttagctcctcctcctcccggttattggctgctctagttcattcccttgccttcttttggcagaggctttcgaaccctcgcgagccaattgaagccaataaactatagccgagccaagcttctgccctagcttgttttggtaatcgagccaatctttgacaccagggagcttttacaagttttcaagccctagcatatggtgtacttactaggttgtttgatatgttgcatgaatcaatggtaatatcaaaatttcgtaaggtaaaagatatcgatgatacgatttggttctaagtcctagtaaattttggtggagttaattagagtgtgaatttctaaagttaccaaaatttgatggagtaactatagcaaaaacatgtttggtctattacttaccaagattccatatgttagaatttgtaatttattcgaacaaagggacccctgttgtaacataaaccaatagtagttctcaagtgtaaacaaagaagaaaaatgtccgtattgattctcaaagcccttataatgtccccatagaggtctattgatagccataagattaggttttacatatgcttttatatgtttactctttgatggggacagttataagaatgtcatagtactctcatgtctcattggttttattggacttatgttaagtcttaacaggccttggtctactctatatagggccttgctctgaagatcgcctggtaggccggctacaagatggtctcggccattttaatgggcttagccatcaccatcttcatgggtattcgccaaatgggtgctcatggctctggcttcgtcctttccaccagcctttgtaccgaacgaaggggagtgaggccgccagcctgcctcgaacaaaccctagataacacgtgacaaaaagcccaccccacatcttatatttacttaaaccattggatcagctttgagattcgtgatactctcgcaaccctaattcccacccccaccttcgatccctcccccacgccgccactcctccgccgccaccaccgccgccacaattttttgtcaaatgaagttaaaacaattccattgaacaaatcgaatatactcctaggatgctactggtacatttacagccttccataggcaaaacccccctcaccaaggaatggtgtgtgtaactcctccatgacagctttacccagtagcttgaaacggctgtcacagctaattgctccaccacgaattcattgatccaacggtaacctacaaacattcttgtgtatatatacacgacaacacgatcacgcactccttagttcgatcgtgtctctctcctcacctcactcgcggacgcttcgtcttctctacacggatcaagcagctaatccaccatagatctctctctctctctctagtccggcgtgtgtagtggtgtactagctagctagctactagtagaagcgtacgcgtagtggaaaggcaatgacgcggcgtgtcgccggcgtggctgcggcggcggcggccgtcgccgccgccgtcgtggttcttgcggcggcgagctgctgcgaggcgcgcgacttctacgtgggagggcgcgacgggtggacgaccaaccccgccgagccgtacaaccggtgggcggagcgcaaccgcttccaggtcaacgaccgcctcggtacgtacgcggattcgcccgaatattccggcgatcgatctcgccggcggcgtgcgtgttcgtttgtgtgttcgtgtcgatcgaccctgtcggaattttttgttaaatttggcgcgtttacggttattgcagtgtttaggtataacaaggaggactcggtggtggtggtgagccagggccactacgacggctgcaacgccaccgacccgctcctccgcgacgccggcggcgactccaccttcgtcttcgacagctccggccccttcttcttcatcagcggcgaccccgcccgctgccaggccggcgagcgcctcatcgtcgtcgtcctcgccgtccgcggcaacgcaaccgccacgcctaccaccccctcgccgccgccgccgccaaccgttccggcggcccccaccccacgcccgtctccgccgccgccggccgcgggaacgaacggcacggcgagggcgccgtcgccacccgttccagcaccggcccctgcaggctcgccgccgccgccgccacctcctccggctgggggaaacttcacggcgccgtctccggctggagggatgaacttcacggcgccggcgccggggacgaacgggacggcggcgccgccgccgcggccgtcgtcggcgccatcagtgaggggtggtgccttgctgatgctgctcgtcgtcgcgacagccggagcaatggctctcgtttgatttgttggtcgaacggtctagcctagctagttgcaaattatgtttccttttttgcatgcattgtgtttttgtttttgttggtaattcgtgtcagtttgcgtttgaattcggtaggatttgatcatcgggccaaaataattcagattgttgctttgcttagtcgtcaaaattaatctctcatctgtagcaagtggagatatatgtgtaatgttttgattcataggtaattgcattaaagaaatgttgtttatgcgtttttgctcgatcaatctttacgtctgcctgatctgtaaatccgtcaagtagggcaagtagctggtagtaaatcttaattaattcatatacattcaatccgatttaacatctctttaattttcttccattttaacgtaaagttgccgtttatcctccaaaatagtactgtaggagtttcctcgataattaattgacatgaacactaaaaacccatattcccttaaattccataatatccataatccatagcactcacttaatttgtgactgcatgtttcaccgtagtactactaaatatttgcttattaatgtattggatcataaaaaatgattatgttatatatttgtggacaaattttctgtcagatgtaaatacagtatgattataatgtaattatattataacttgtatctaactacaatgtaacttgtatataacttaagtataattttaaaccgttagatttacttcaagatttgtacaagttgggaagaaaaaaaagtatagcacacatagagatgaggagaatctgtccgacctgcgctttgcaaaaataatatattacatacaaattgtaatgtagttatgtaagttacaatataactacaatgcgctatatttatatttcataaatatttaggagaaaatttgtcaccgattgtatagctagacccaacaaaaaatgaggtccaatatgaatatgtaactggtcgaatacacacaagattgaggcccattaaggcccaaaatggtgaagcccatttcctccagtgataaataaagcccatcgtgtaatgggcccgtcccaaaattagccttcgaacactaattcacaggaggtattccgtgatgtttcagctaatgtttcactaggtcattttaaagtgttgcacatggtattattttgatgttataccaggtactttgtgatgttttagtaggcattttgtggtgtttcaacagttactataatataaaattgtttcatatataatataaaaatgtttcatatatattattatgttgcactatttcatttgtaaatgttgcacatggtattcttttgggtgtttcagcaaatactatatttttttatcaacaatgacaactgatttaaaaatatttcaataaaattaagtatatgccaaatatatatgttgtatgctttgtatgattttgtttatgtttcattgatagttaatgtcttgtgtactgtttataattgttgcagtcaataatttttttatatattgtatttcactgaaacgtttcatgaagtgcgctgaaacatttttacataggtgatgaaacatttttataagtagtgaaacaatgaattttttttgacacacgtggtatgtgtatatgtgtttgtcgaaatataactatgtgagatcttgtcacaaagatttaattataacgaatgtaaatatgtaatggaatcatatcttgcatatgtattttaggagaaaaagtagtttaaaacacataaaaagcaaggacgtgtagtatgaaaaggaattggagacatagtagtgagatagcacgtcactgacctgcatgtaacaaataaagacaaagcaacgcagcaagcatccaaatgcacatgcgcgaagcaacagggcaaccatccgatatttggtgcaatatcggacgtccgcgccgtagctctctcccaggtcgaggcatgcatggcagagaccgccgccgcgcgtcgcggcggcaccggccaccccagcgtgcggccgccctggttcgtctcccctcccctccatcccgccgcctctcctccttatcccctccatcttctccgccgcctcctcgtctccctcctccttcaaagccaaccaagatttcatcagggtaggctcgcgtacatcgcgcgcggagggagatcgatcgttcgttcgtcctactcgtatccatcgatcggaagaatcccagtcgccggcgcccaagaaacacaccgaacgctcaggtgatcacaggcatggcgccgcctctcctccgcggcgtgcccgtgctgatcgcgctcgtcgtcatggcggcggtggccttgctcccggccgcggccgccgacgacatgggcggcgtggtggcgtcggcgtcggggcggaggaagatggcggcggcggcggcgacgtgcgacggcgccgtgggggagtgcgacgtggacgacgaggaggaggtggaggagatggcgctgatgggggcggcgggcgccgcctccggggagacgctgatgcggcggtcgctggcggcgcggcggccgacgaacaggtacgtgagctacgcggcgctggacgccaacaaggtgccgtgcaacaagcgcggccagtcctactaccagaactgcgcctcgcagaaggccgccaacccctaccgccgcggctgctctgccatcacccgatgcgctcgcaataccaactgatcatctcctcttcctccgccgtcgccgccgtcgtcgccatcgccgccggcggcggcggcggtggcggcgaatacgctgctgtcataagtgtatgtacatatcgactcaatccaaagcgtatgtgatgagcaactgctgctgctgctgctaaaaaatcttcagtgctaaaatatctatacaagtggtagcatgcattctattatttgtcatcatcgaattaattgcgttttcaaatgttggggaaatattttttttgaagagaatgtactgaggatcagttcatgcatgtttctcggttgcactattgaaaaaagagagaatttaagcgggccaattttacaggagtttttttgaaggcccggataatgggctttgttgatgggccgggccacacgggaacatttacaggcctttagttgctgacctgaaagcaccatttttcttgttctttttactgcctctaatacttgttgctttgagttttttttaatttttgatcttttgtcttatttaaaaaattatggaattattatttattttgtttgtgatttgttttattatcgaaagtactttaagtatgacttctctatttttatatttgcactaattttttaaataaaacgaatggtcaaacgctataagaaaaaaagtcaaagcgactactaatttgggacgaaagtagtatatcaaccttgcttaatctgatcgaaactgttacttccatcccagaatcgtcccagaatatccaataagttaatccgtactccctccgtccaaaaaaaattctaattttaaagatgaatcgggatacatttgtatccacattcatctctaaaattgagttttttctgggatagagagaatacgaaatatgatacagtatatcctaacactatgtccatatttatagtactaaattaacttattctaggacaggtgtacaccggatcccattgcatgctttttttatatgaaaatttttacatataaattatcgtataaaacttcttaaaataggctgaaaacacacgtgcactaaataccaatcccctaatcagagttgtttatcgaattctgtcacctcgcacaagtgacaaccgtgtactgaacatgctcctcctgatcattgcaatggcaacatcaaagtcactttttttaatctcccttaccaaaaaaaaaaaaggccacaccttttttctatggaaaaagccatgctgtcactttgtcagcgtctagtatgaattcagattcagacattgcatgcagatgcaggacgctttctctgctcccatgtccatccaatcgcccatgacagacgcccgtgtacattcctgcgtgcactcaagaacaagcgcatgcatgcatgaacaaaaaagactcctcattaattaatcactaaaaaactactccctccgtcctctaatataagggattttaagtttttatttgcactgtttgaccacttgtcttattaaaaaaatttggaattattatttattttttatgacttactttattatccaaagtactttaaatacaacttttcgttttttatatttgcacaaattttttaaataaaacgagtggtcaaacaattgaaacaaaaacttaaaatcccttatattataggatagagggagtagctaagtaggcccaagaaaaaggtgtttaatcacaaaaaaaaactaagctaagtaggtccatatgatgtctgtttgtatagtgttaattaagtgtagcttgtgttttgttgttttctgcatctgttctgctctcagcctctccttctagccttgttgagattatcatattgatagtatatcatagcttggttatgtttaattagtctcgatggccacttgattattcagctcgatcggcagcagtagaagctactccagtagttgacagaacgacagtaactcaccttgttgattttctacggtgcttgtagctgcaaaactctgcaatcagtgaccactgtgttaatgtatatctaaaggtgattataggtgaaaattggatgatggttttgcgactctaattgtttcagttttaaaagctgcattgcctgcatgcctccgtccatcacgctgacagagttgagacgagagagtgtgcagatagattctctcctcctttttctcgagcctaaagtctgaacgctactgacttttttttccagaatataagcatttatagcacgaaaaaaatcttgagataaaaataatttaagaaagtttatgattgattagaaaataaagtagataaaaaaattaaataaagaatgattttaattgggtaagagaagtgagataggtggaaaaataactttattttaaaataaattattatattaaaattagcgagtacatattttaagtatattttgaaatagaggtagcctcgtcctttgttttctccgagctagctcctcctacattgcacaggagtacagtagaaaacgctgagctggatttcttttctcgcctcggatatcgtgcctgcctgatttcagagagtgttcatgcaataatgtctgaattctctgaatttctgacgaagagaaagaaagcaaacgaaagaaagagaaaagaaaagaaaagtctggatgcgtgtgggcagcagcgggggagcccacgatacaaatagagagagagggggagagaaacacaacacttcaaaagtcaaatcacacactggcgcacgttgaaaagtacgtgcttttattgtcccatctccacgctgatagcattgcctacggatcctctgctatgcgtaccgcagcttgtgtacacgcagggtgtgtttagttcacgctaaaattagaaattttgttaaaattgaaatgatgtgacaaaaaagttagaagtttgtatgtgtaggaaaattttgatgtgatggaaaagttgaaagtttgaagaaaaattttagaattaaactcggccgaaactgaaaagagtaccggatgctgttgttggagcgtatctgtcgatgctcgatcattttcagtggaaggactagatgagtacttcttctacctagctagtatccgtctttttttcttttctcatgcaaggagaaaaaagatatgccgatgtagcctcaaatatctttgtattttgttatgagatactcttgcatttttacgactgtctgataggcatgctacatgtgatgctcatttgagagcatataggctagtatcatatggatcaattgtaatgctcgttttccattgagaatagttcattgtgttgtctatggccaagcctcgaaccttgaaaattgagctagatctaatagagcatctccatatatagcctcaattgataaagcataaaatcagtctagatttgttcggtgaaaaatatatagccatttttctacacttatcatattgaatttataccataaatcagccatattatactctctattcacactatttatattgtaagatgttttggtttgttacaagtcaggcttctctaattttgattaagttcgttaaaaaatacactgccatttgcaacatgcaacatcaaaatagttttattaaacccaccaaaaatgtgttttaatagcatatttcactggtttcatatatgttaatatatttttctattaactaagtggaagttaaaatttttgagttagtacataccaaacaacttagagcaagcactataagagtaattactttaagcattaggtgttacctataaaaaataccacttgcaattatgtgatgaggtaaaagagagaagtaaagccaacccctcatgtaaaggataaacctttatttcaagagagatgaaagaaaatgatcaacagattaagatcaaacgatcaaaataaaattattatatatgttgtattggggcaagcgtggtagagataaattttgtactatatattatatatcttaattaatgagtagatgatatctaggaaactatacttagggcttgtacgaaacaaattatagaaaaggaaccggaatagaaaaaaaacgtaagaatatgatatggttgcacgtggaaatggaggataagaaaaacagaggaatatataggatcgaattttcagaacacaggaatagaaaatagagcattagaacacatgattttatcctataatagccaatgataaaaaagaaagagagaggttggagtggatgtttagaattcctgtgtgtgtttacgggaatgctacaatattcctctaaaattcctttgtgtgattcttacaatccgaacacatcaacggtagaaaaatcaaaggaatcattaatctaaaaaaaatcccgtgtaataaaccctttaatccgaatacgctcttatcgttacaatacggaaaagtgaagtcgtagtactcccacgaaagaaggtactccactggtgtactccaatatgtgcgcacgcagcaaatcatgctcgtaggcgggagcacccccgagaagaaagcatgacgattcctttccttgggatctgattagggcacgcacacacagacaaggaggagcagaggaggtcttctccaagtcaagggcccatccagttttaagccgcccccaaatccaatccaatccccccatgccttcacaccatgcatgcaaaacatatgctgcccactactccgaggtaacctaaaccgactgaaaatgtggcaactcatcccacattttgctattccttttccttttcacctcttcctgctcttcgattcattccagattaatttacaatatcatttctctactatttaaaaagcgcaatcatccatcctccaaaaattcagaaaaaaacaccaaacaaccgccctttagggggggaaatgggaccagtagaaaaaaaaaagaacattacggacaaccattagccctcctgtaaaaaccattgacacatcccgttttaatgtaccggtataccctagtttatttaagatgtgagcctccaacgtgatgaagagtttcacgaagtttaattaatttttttcaaaattcaacacaaaccaagcggtttagggtagctccgaatttcgtgcggagagactcaacggaatttgtgaataatgtacgatggactttcactgaaaaaaaaaaagcacctcatgtgtatatagtactagtagtatgttttaggccccgttcgtttactttgaccagaggatattttcagcacacataaaacgagaaaacttatttaacacacgatcaattaagtattaactattataaaattgaaaaatagatttatttgatttaaaaaaacagcttctacatagaacttttttttttttgccaaaaacgcatatttaacctttaaaaagcacactaacaataaacgagaaagttgaagtttaaagttgagaaaaataaatgggccttattaggagttgatgggatccttttggattgtagtttgttgagatctctataataattatggttagtaggaaactgggtaaagccgtaaaggtgcagcctttgaaactacgagacaaatatggtggaactaattagaaaccatcatgcatgggtgctaatacatctagcaggactttgaggtcaatccaactgactgactgactggccactcgatctttctaaatctgcttgacatgctccctaattattttttggtcgacttagtgcactgctgtgacagtgacatgtgtgtggagatgatcagcaattcattctgaaattgtagcgatgttattgtgagtaattaacctgtaatggcaaaatctacaagtaactgaaccatggcagtcgatatcaaagatggtagtatgttttactgctagctgcacacaatgctgatcttgattaat

SEQ ID NO: 58468 - DNA, 5708 bp, Oryza sativa
gtgctacaataacccacatatgctaatgacggattaattaggctcaaaagattcgtctcgcggtttccaggcaagttatgaaattagtttttccattcatgtccgaaaaccccttccaacatccggtcaaacatccgatgtgatacccaaaaattttgttttcgcaaactaaacatgcctatgtcactactagaattcacaagtatccctagagccaaaaactctagggaacagccaaaatactctagggatcgggtttctctagagtgaaccctagggaatggccccctagagaagcattctacgggaacaaattggttcccttgggttttcttggtagaatctagggaaagaagctttccacgtgttccaaaaggtagggattgaatgccacctgaacagaaaaaatccaacgtggaaagtggtacagcaccctagggaacatttttattggagtagttcatttagaaattaatgcagattaatttagctcttgattaatcgttgattagttttatttgtttattttatttcttttgcaaacaaccagtaagcattccaatcatattttcgtcaactgtcttgaacaaaaaatatatatactgcattacaaagttaatctcaacagtaaaaattgggagtacatgcagagttgcccatcgaaaaacaaaagaaaaaaacacacacacgcagagggagagtacatccagagttgaaaattgacgaacacttaatagattgtggctttgctctctcaaaagtcaaaataaaacacaaatatagccttctgcagtagttgtatccaattgaaatggtacgtaatagcacttccagaagtcatcaagctgcaaaatgagtaggaaggttgaagaaaataagtacttatggaaatctgtagctacatacgtgggattctctatttgttcaatataataagcacatgatttctagctttgattactaaccgcagtaatatgattcatttatcaagttttgcaagcatagctcaagttcttgacttctcggccttaccgatctgcatcaagcacataattcatcaaaaatcaaaacttcaaaatatgcacagaaaaatatctgctcgagtacctttgctaaatgctaactagagagcagctcggcaacaccacgctgcacaggtcgccgtggccttgattcacccctgtcccggcgtcgcctctcacccgcaaacagatgcaatcagcccacgcccaccacggccttcaggagtgctgctgcaaccaccctcgaaggtcgaagctcctatcgatctctactacttgagggtagatttggtggtggagactggagagggagttgatttggggaggaagagatgaaagaacatgttgaaggaagaacaaaggggaaagtttagcagcttggggtactttattactttccaatggaaagagaatatggtgcacagtccaaattttggattcacaaggcgggagaaactattacaacctttccacgtggttggtttctgaaaaagtcaatggaccctgccaccgtggttctcctatcagtgccaactgtactagtttccctaggagcaagcaaaaactctagggatcatctcagttcccttgagttttagtttcggctctagggaacttattatccccttgggttctaattagggctctagggaacatttgaaaaccctagggaccccgtggaattccagtagtgtgtatacctcctccacctttccattctttttaataaagcttgatcattttttctcatgaggatcaacatgctataccgtgttacgaaaatagaataaaaattagtgttaacaacatataattcttgaaattattgcacacatatcatggagtaaaaatgagcatgtttcacatgaatccattcaaatgacaactcttgtggacccaatgacgacagaatttggcgggttttcttttaggtactatcaagctgtaaaaaggagtgtgcaaaccatccatgcaaccttgtatttttcaaaaagcttgatattttcctatggagatcaaactaatgctaagcattgttcaaaatagagccaaaaaaatattaaataattacataaattgttcaacgcgtattgtgagcaaaaagaagcatgcttcacctaaacccatacaaacggacgctcttcttgtggacccaattgaaaatataatttgatgtgttctattatcatggtgttacaatgagtttgaaaattgtccatacattgtgtcctttataaaacaacatgatgttttgagaaccattaataaggcttagcaggtaaatctatctttatttttttacacataccgtgaagaaaaagaagtacactttatgtgaacccgtacaattactctcttcttatggacccaatgatagcaaaatttggtgtgtttcatactatcaagcggttacgaggtgtttgcaaactcttcatgcattgcatattttctaaaacaacacaacactttgaaaaccgccatagacttagcatgcatctctggaatgttgtaaaagtccattcaaaagatagaacataacatctaaccaaaaacttgcatgaatttgatgaattcaatttctaattcttgtgcccatgcctttccgtaggcattgatcttttcatccgaagatcaaactcatattaggcaatgttaaccatctatgcacctttgtctttccaaaaagcttgatattttcctccggagaccaacccatgctatgcaatattcaaagtagagtcaaaagaacaatattaataattctagaaattatcatatgcatatcatgaataaaaagaaacacgcttcacataaagccatacgattgaacactcttcttgtggacccaatgccagcagaattttgacgtgttctaccatcgagccgttacgaggaatttgcaaaccatctacacaccgtaccttttctaaaacaacacaatgctttgaaaatcgccccagcttggctgacaactgtatcttttgggattttgcgaaaaaacttttcaaaagaaaaaaaacggaaccttcaattaaaaacttgcacgaaaagaatgagagaaatccactggcgaagtatgtatattcacccttacttaaacaaccatagccttttgattgcaattacaaacgtaaccctcccttacaaacacaataaaaattctccttgcattaagaaaccacagcaaattcacccagccaaagaacaacaagatccaaaccaaacccaagaattcaaacacacatccagctgacctgtttggtcatccagcacaacaagaactgatcttctgagttcctgaagttatgccaccatcactactactagtagtagtactggtatgaccacatttcttcaagaggtcaggtcagaattcagatctagcccccacactcagccagccaagtcactcacaagcattttgccaacatattccggagaggagaaaatccagatcccaaagctcccaatttttttttatttcaccttccaaaaagcccaataaaaccccccctcactcttctctcctctatcctcccctcactctctctctcccttgccaaaggcgacatttttatcatggccaccacctccacccacgcgccgccgccgcactcgccgctgccgctgccggcggcggccgccggcgacccttccaacccgttcccgaccacgttcgtgcaggcggacaccacgtcgttcaagcaggtggtccagatcctcaccggcaccccggagaccgcggccgccgccgcggcgggcggcgcagccgccgccgcgccgcccccggcggcggcgaagcccgcgcccgcgccgccggggccgaagaagccggcgttcaagctgtacgagcggcggagcagcatgaagagcctcaagatgctctgcccgctgctccccgccgccgccgccttcgccgcgggcggaggaggggggttctcgccctcgccgcgggggttctcgccgcgcggcggcgggatggaggtgctgtccccgagcatgctggacttcccgtcgctggcgctgggcagccccgtgacgccgctcccgccgctgcccgggtccgacgaggccgccgcggccgaggaccgcgccatcgccgagaaggggttctacctccacccttcccctcgcggcaatgccggcgccgccggcgagctccagccgcctcccaggctcctccccctcttccccctccagtctcctggtcggcagtgaccatctcgccatcttcttcttcttcttcttcctccttggtatgctctgcttgtctggttaatgatgctctaattacatggctcatggagggcgatttcatcgctggattgtccaaatcttcatcttcatcttcatcttcagtctctcctgtgagctctgggaggatcgaatcgaatccgtgtatgtcagtcatgttgtaatcctagtgtttgtaacagtaaatttgggcgcttaagagagattaattgatcgccgagcttaaagtaactgttctttcctcttttgtttttcttttcttcctcatcttgatggaatttgcataggttttagcttgttttttttcctttcacttctcttgcttcagaagcttgctttggcaatttgacttggtagagtaatttggtagtccaaatcttgtacattaaagttttctaaattgagttatatgcgagaggcaagtggatgctcaagttgacattttttttatggcagctaatatacgcgtattaaaaacacacgacacttcactcttgcagtactttccttagaactggtctcatttcaaacaaatcaaatgcttaggttcagggcgaattcgtcatgccacatgctataaagattacaccctcttttttttttctgtttgtttctaaagccagccagcattattgattactctcatcaagatcaggtaagagttttgatctgaacagaggagctcactgacacttgacatttgagctaggtttgctgagttgtttcaaggaagtggcagctcaagaccataatcagagctctttttctgaggaagaccatcaataattgctctccatcttcaaatcttggcagaatctggttgaaatcgggcatctggaggaggagatgcaaacacaaagtgaaaacaaatgctgcattttcgcctcccctttttcataataaaatcagccatctttgctgctgctagtggagatggtggtggtgggagtgggaatatgagactgatcaaaaaggagaagaggagaggaagaaaaaaaacaataataaatccggtggtggtggcgagtgagctccaccattttgcatcggggaggaggcattagtgaaaaaaaagaagctgaatttagggagaaaggtgacagcttttggattggggaaaagaaattctgcatgattttttcaatttttttttttagaggaggaggaggaggcccacatctgtcagtgtctcgaggtgagctcagttcttgcgcccacaaactgaatctgtgtgagtccatcatcatctctctctctctcaaatgcgttgcgatgcaaatgcaatgcatacatgctgtagcaggaacagtgggctgtcagaaatcgagccgagagagagtatctcagatctgtctgctcgcgtcgcagccggactgaagagttcatcagctctgcaccatcgccagcggcgggaagaagaaagatttgggg

SEQ ID NO: 58469 - DNA, 14209 bp, Oryza sativa
atgataggaaaagaattattaagtgtcaaaattttttgaataagacgaacggtcaaacatgtactaaaaagtcaacggcgtcaaacatttcgaaacggagggattatatatttttcttttcacgtctacagtgtggaccatgtgcttacagagagagataacagtacggtgttaatccacactgttgcgaaaattcctaattactactctgtaaaaaaaatcaaatcaaatcctaactacgaagctgaacacgtatttgtctagatttgtagctgggattaggtttctttgggacggaggggtacttcatatccaaattcgtactagtaagacatgttttatctaatcaaaatctttatattttgggattgatggagtattgtattttgcaaatgttttaagcattatatttaggaagttactttttatagctatagtggtgattctgttattggcctaccacccctactgtataaattagtccatgatattatctaatattatgtaataatttaatatttatttaaatcaagtgaataacatatattcaaaatatggacattttactcatagcaaagcatgaacattttactactactctaggtaaaaataacattttactactacattcatatcagaatataatattttttaggtttatttgaacacggttattaagaaaagtagaaagaattaaatgagagtaggttgcgatttaataagaagtgaaggtagatggaaaattgaatggtagagggttgtgattagttgagaaaagaatgttggtcaaaaaattattatattttaggacaaattatgaaggctaaaaatatattttggaccggagggaatagtgatatagaaataaacaagcaaccattagtttttttaaaattctcaatagggtaccccatgactgcttttaagaatatctaactactccctaaacagagttcacagtaaaatgctaccaagatgcctttagccctaaatcatttttgacagaataacacataataactctttccttcaacactcaatcgctaagggttcttcatgcttctaacctaaagcttttttttagacatatttctaggtggcttttattggtagtagaatcttttatttttcatcgataaaccgtatttatttatactaccacctattgatacactttagtaaaatttaaaccagagttcaatcagttctaactaaattttaaaatgtgcaataccaaatgtatggatggactcatcggtgactccttgatatgttaacaaagagaacggctttagggatatactgtatttccatattatgtttagcatgtaaaccatgcaatgacatgttcgcatctatttttcttactagttggagcaaagctaccactaccaagagaattgaacataacttttccatgtggtgattgatgttgtcgttcattatcatattcatcgcctatgatgaaaacttcgtcaaggtttccatcatttgtttcctcccttagcatagtggtggatctgccatgagggcggcgagggttcgagccctcactattgacaagagactataggagcctcaccgagctctctaaaaatttctactatacatatatgaaaaagaggttcgagttttgtttagtttattcaacctctactattttttttcctggatccaccctagttagcatcacacctaatctttctttttttgttatcattcacaaactagagctcctatgcaaccacaaatataagcgcaattgcacaaaccacctcgcttagtttgaggaaggtaaaatgaacggttttaatcaaatgccacatggtttatgtattttacaggttttcttttttcttttttgtttcatggcttccaaaatccaaatgtttggtgcagtaaaccgatgttacccttttatggaaaaatgttgcaaggatgaatcatatgaaggcacaaacagtacatcctatgttcatcaatctgactgtcattgcattgcacagacaaaagattgcagcagtactcgatcgatcgatagctgcagaggaagtagaaccgtacgcagagaagagctgatcggttattattagttgggttcatttccggccagattattattgctcctgcactgttactgctccctggcaccgacagtgcacacacgtacagtacagccgcaatgcaaacctttacgttttcacaaccaaaccaatcgatgaatcgacgcatgtttcagctcagtttcagaaatccgccgaccgaccgagcgttgcttccgtataaatgggaatattttcgattttaggcataaacaaaattatcttttcttttagtttgtttttcagtatcatactgctgccagcactaaacagttacattagtaaacgtaatcaatttaagaattgtttccgaagaaatgcctaccattttcaaccgaatttatcatgcaaacgtcactactgcacagttcaattgcacactgctgcggttacggctggtcgtaacagtttgaattttgaatgccataagctgtactagtgctgtttaccgcttgctattgctagtctcgcagctacaagacgtgtattaatttggtgtgtttatgtactaatgtggtgtgcactagagtttgtactggccaattaaattggtcggagctatagctagccgcaaagccgttgctgttgctgtctgcctgcccctttgcccgttacggggatccgatgttaccgactgctcggctcagtaacctacagtgcacatgtgtttcttaccgccgactatccaagggcatgcttcatttgtcctagtatataagggattttaaataaatatatatgacatgtatattccagtattacgaatctggacatactttctgtccagattaatcaccggtcgttattgttgtttactgagcgatggtcgaaatcaatcattggcaaagtaaaagatttctagaggtgactttttcctgttctttttctttgtgggaggtcaagcgagacttcggtgctctctaattgctgtacgatttaattaattaattaattaacagtgtggcatctgatccttgtttcccataacaacgaaacgaggcagcagaaaagaaagaaaaaatttaaaaaaagaagaaataaagctgccacacgccgtctacacgagcgagtgagtgagaacagcagtgctgatcgacatgatgcaaacgaaatttgttcaaagcgggagaagatgtgttcggaatatctcatgtcagcaagcacccacagcgacagaaacgattgccatacaaagcaaactcaaaaaacaaccaaaaggttaggcaaagatgccacatccggatccccttgggattattgttaggggggagcaaagccactatctaggttagatcgcgtcaatctgtaccgtggatcgagatcggatggttgaattacaccgatggtcgaattcctattttatatctataactagattgccaattgatcactgttcgattgctagattacaccctttaacacataccagatatgtatataatctctatcgacggtcaattcatgtaacaactcatattgcaccttttacacctttaagataccaacagtaagtcagagaattaatgagttaccaatggggtaagaattaatcttgtgtttgttgtgtgcctaatagttaataatcaatatgtttgacttgggaacatcagtgctgaggtatatgcccacatttgcacatcggtttaacttttgattaaattagttgatgcatgaatccccactactgatgcaatggctcgcacggttttatagagagtaaatggcatccttattattgatgtcaagtcaagggtttatttatcaatttttgcagttctgtggcgtggtcccaaaaattctatcaccacagctaccgcataatatattttttatatattatctctacaatatcattttcttatccatcagtacgagccttgtgtagttgtgttactaaagattaactgcaaaagatataaaatcatttttatacttaaaacatgtataaaagcaaataaacataagggatacttaatgagtagtagtttattaatatctattcaagtgaaggaaataaaaggcatacccaggtttgaaaatttctctagttcactaatagggtctcttacattcatagaaaaaacatagaaattttaaagtattttaattttataggatattttcctatgaaggccatgaaacaaaggaatgaatcatattctatcctttgaaattttgaaattcttatagaatggacaattcaatagagattttgaagcaaacttagcaagagctctaatctttttgaaaattttctttggttcatctttatcatccgattccaatttttatcccgcggttcagtcaaatggttattgttgtgttttttttattttgcaatgccttattttgtacttacatttctgttagaataatgtgttttttctaattctccgttttttctatgattcaaaagtgccctaagttctttttaaggaagtgaagatctggctagctaattcgaagcttccggagcttttaaacggtaatacaattttcttttaaaaaaactatttaaaatatattttttatcctcaaacggtgatcataaatcattcagccattcggaaaaataaaaaaccaccaaaccccacgcaaatcgaaattcagctatgccaaacaaaagaagagtgtttttcccaaaacaaaaacttttcatctatcatatcgaatatttgaacacatgcatggagtattaaatatggaaaaaaaaactaattacacagtttgcgtgtaaattgcgaggcgaatcttttaagcctaattgcgtcatgatttgacaatatggtactacagttcacatttgttaatgacagattaattagccttaataaattcgtctcgcagtttcctggcggaatctgtaatttgttttgttactattagattgcgtttaatacttcaaatatatgtccgtatatccgatgtggcaactaaacctaaattttttccccaactaaacaaggccttagaaaaaaaatttgaagattggattccagtaccatacgagatatcagaaggaaactggcaacggcctgtagactggatcaaacgtacgctatgaatgctggcttctagtacgataaattccggggagcagcggctttccaaggacgtctggtacattgcctgcaacgcacttaagcgtacctacgtacagcaaaaaatttaaccgagtcgatctttgcaacgtctacgacgaccttttcttcaggtactctgtgactcgaaaaggatgagatatttctcgatttctcaacggtagatgatgcgaatgatttcgagaaacagctgattgataattcagtttttttaagatttaaaaatctgggttttttaattgtggtttctagtttatttttcgaattctacaactataggtttataaaatctgagtaaaatttaagttgtttagaaagatgaagaattggtagaaacttcagctgcttagaattagctctctaaacaggtccaaaggattttgggacctcggagtctgatggtgcgagcactactacagtgtacagaaatctgtcggtggctgaaattatccggcacgtttcattgtgtatgtgcatggttaactttaattacaggtcggaaaggagatggagaagaccagccgtgtgttgattcccgtacggaatgtgaataaatccgtcctaaatttagtactgtaatcaatagcaccaacgtctaaaaacattgcatttcaggttatatatctgaatatatataatacttttaggacaaaagtaatacaagacaacacattgagcatcgcgatacatcacttcttttttctttgtgaaagatgaacaattagcaacttgcatagatcgaaacaaatgtaactcaactggctagctttcttgtgattgaatcaatccgagttcaagctgtagatttggcacgtgtacttgtttttacagctaattattcttttagtagtaggtgatgtacctgtcgatagcgagacgttcgtgatggtttcatcaatgcaatatcaggatatgctaacccaatcttccgaagatgcttgtaacggtaggagtacgcatgtgtatttataaggatgagtgtgggtgtattgtgagcgcctacttttgtactgaatttctaaaaaaaacaacataaataggatatcaaggcatataatcagtatagtgaaactcaatacaacaatgatctctgtcctattggaagttaagcagcagacaagtcagcggcagagtttacaacacccaacacaactgttgggttcttgtaaaatttagagatattttgagcgaattcacaagccacttgataaaccctttggctgttttttattaaaaaaaacaaacttaatttcaaatatatggtaaacgtgtccgaatttcactggcttttcaactgtttttcacataaaccgaggaaaccactaaggaacgatcccataattagcaacaaacatttaaaaccatggcaagaaaaagatttactatttgttatcctttcaaaatgtcaattccaatatttactattttttgaggcaaagtgagggtcagatccaagtcagccggcacgaaagtggggctccaagctgaaccgacgctgccacgcagcgcaggagccaatgcaagtgccatattgccgtgtgacaattgttaacatcagcagcagctagccctgccggctctgtcaaatccttctcctgcttggccgaattaacactgcggccctgtttaattccaaagtttttttttccaaacttccaattttctatcacatcaaatatttcatgcacacacaacttttcagtcacatcgttccaatttcaaccaaacttccaaacttcagtgtgaactaaacacagccgctgttgttttgccatatcatgatgtgacgaagaacggatggcaaattgttagcatcggccagtttgtcttggaggaattagccaaatttagtcactgtttggtaattggtacggtagaatttttgttttccctttttagtcacggagaattcattcaggtgagaattgaaatggttttatgtgagaatcctgcaaatcaaagtgaactcttgttactacgaaaattgggccatagtgtacatcctgatttatggcccataagcgatctgaggatgttatgggtcgtgaaaggaataagtctatttcgtatccctgtcttgcttcttattgaatcgtctcccttaaccgcaacttcgggtgtaatgtctcccctatctttgaaaatcagtgcaaattgactctttcggtggtttaggaaatggtttgtgctgacagtcaacctgccacgccaatacaaactttttttttcgtttatacaaactgctttccaaaccactgaaggagtacatttgcatctttttttgaagttggagaaggtgttatacccggttttgcagctaagaggatgcgatttggtcaagggtaagagactagggataaaaaaatggtcagaacagacttattccgtcctgaaatgaactgttactgaagcacataaatttgacaggaaactaggcctttcagttatctgcatcttcttcacttcctctctatctctcttcgtgctttgcttagcaagcaatttgtttcattttcctctgattttttagtaatttttgccttcctcttgaaattgagattgcaattgctgcatacctcagaaagcactagcaaagcagaatttatttttaataaaaatcattatcactacatggttctatggacgatgtgtttcaactttctacagccggtttcattctaccatgacagcttgacagtgacagtcgagtggtttcttaattcttctaataattgttcgtttattttaacgtagctgtttgtttgtttgatataaaagtcaggatcaaacaaatcatggactgataatatatttgtcccacgtttggtcggtcttgggttgatggagattggagaaagggggccgatgtctcgatgataacttaatttttgttgttatttagaaaaaaaaattgagtgaatcttagtgccgtgaggcatctgataatccctcttagattattggtaatatactaatatgccgagaggatttgggtttcgtctcgaactgaaatatggtcctccaattctccttgtgattttgttatgcagtatcagatgtatgttccaagatttttctttttttttcaaataaaccatcatccaatgccttgaaagaaaaaacaagaaaaaaggactgaaatttggcgaattattgtcgctgcgaagaactcagagagaacatgtgatggcaggcggttttcaggcagccgtgacttgtcgccgagcaaagttcagacaaaaatacgggagattcccatgtcgacgtgcagccatccagccaaagtttccttcttccgtaggcatcatatctgcactccaaatgccatttcacttctctgcctcattttctgctctttgtctgcatttatgcctgtccatttctgaagatgtccatttcagcctgaagatctatcagcttttggcattggatagtgtccactgggacagatgaacaaatgacaaagcaggggggtgtgctgagttttgtttcttgcagaagatttgtttgtttcctcttcttcctttctcctgatgatgcaattagaggtgagacaagcctgtgcaggggcataggaaaatgcttggttagatttgggaacaaaattaggtcaaatggatgagctgtttgtgatcttccatggcatggacccttgaggtgtgaaatggcttgcttgtaggtggcatgatcaggctcctgcaaatcaggcagaatggtttaatttttttttgatttgttggcatcaagtcaacatgcaatatctactccatatttatttggtgttagatggattaaaaaacagtgtaagtacagaggctattagttatatattccaccgctcatgtggatgatcaagtagtttaatctgttccatctactgaccaacgtgctattttgagctgcacttgtaaatttttcaatgcaactagacaattatccgtgccttgctaactgaccagtgtgccatgatatgaaattagcagtgtatcataaattctgtacttgaaaaattgcatatagcactaccacaaaatcgatttttcttgacatcaccttattattttctctggcgaccatacgcgaaaactgtcagcgaaaatacaacatgaggttccgagttagtaaccgccattgaaaatctatttcagccaatatagttttgctaattgacatgagctgaaaaaaaaggttattcaaataataaatatatgtatatgtacaaaagattccatggtacgttggtaaaatgcatggtactgggatcgcaacctcactaggctagattcatttataatagtagagacacaaatagattgattttaatctaccttaaagacccctcccattaatttggctccaagcctccaccactgttaccaaatgggagttacaactataactataatatattgaagtagggggtcttttttttttttttgaggggagtagggggtctttatttgtagctataactataatatgggagtttacaaatggatgtatgagtacagttatggttggaaataaatgtgtcttgggtaatatctccttaccttttcgtaaacgagataccatgtgttaactgatattttttcgtgctatttttctgaaccttcgtggtccttagtcaatgccgagcaatacaaaacttctttagtgattctcaacatacctattttattcctatatagttaactatcccctatgacttccttgctcatgggataatcaaggatgagaaggaagtggagaggtggccattgatgatgtttctatgcaatttttaggctaggaaactagtctcaatgatgtttctatccattttttttacgagcacccatccacattaatggacttgtgcctcttggattcattgggcctatcattcccctatgacttcattgcttataggagaactagagatgagaagaaagtcgagaggtggccgttggtcttaggctaggaagctagtgttgatgatgtttctatgcaattcttcacgagcacacatccgcattaatgggcttatgccgcttggattcattgggctaggggtggatatcgagccagctcgactcggctcggctcggctcgctaccttaacgagccagctcggcttggctcgttagtgctaacgagctgaaatgctaactcggctcgactcggcgagctggctcgttgagcttgtttagcttgttaactgaccagccggcgctccctatccgtgaagcagaccagcagggtgcgggaggagcggcatggtcggtgtcgtcggcatggcgctgcggctgcgggaggagcggcgtcgtcggcgtggccctgcgggcctgcggctgcgacctgcgggagaagcggccggcatcgtcggcgtggccctgcggcggcagaaggagcggccggcgtggtcggcgtggccctgcggctgcgtggccctgtgtcgtcggcgtcgttggtgttgatggtggctgcgacttgccgcctgcgagcttgcgacctgccacggtgccgcctgggattcagtgaagcggctgaaaagatagggtttagccgtaattagggaagacaggagttggccagttggggagagagtttttactgggttggtcttgggccggctgtggcctgtgggcctgtggatgtgggattcttgggctatgcgagtttaacgagcctaccaagtgactcgcgagctagctcaggatcagctcgttagcttaacgagcaaaactgctggcttggctcagctcgttaagactccgagctcgagtcgatcggagccgagcctgaaacgagccgatctgagtcgcgagcttcgagcttttttttccaaccctacattggacccatcataaggtggacgcagcttggaaacaaagatggagcggagatgctcactcgataagaacaaccaagcaacacataccatatttatgttgtaatttataaaaaatatagttcaatcaataaattaatgcaaacaagaaagtatacctttaattttaaataaagtaatattctttgcaccataattcatcatacaccatatcaagtcatcgatcaattcatcgaacctcctattatgcaaattggttctgattatattaatagccgagaaggctctttcaacatatgttgttataacaagtagaagcaatgctaagttaatagggtgatagaccaatggaaatcaatgtccttttgcatttcaaccatcttcaaggacaaactaccaagatcatgtgcacatggcagtgtcgatgtccacgtgggaatcgggatggctttggccctagcggtgccgacgccttggtggcatgaataaaagacgaaccgttcaatccaagacttaatgatcgatgggactgatcgaggagagacgagacgtcagcatttctattttctttcgtcgcttgtggccttccacctacagcgtgaatacttgatgggctggtcacttgtaggatgcttatggatagaatctggtatcaagaagcccaagggaggatataggagtttggggggaggggggggacgcaggccatagctgggcctatcgacctaccctacccatgggtggttccgtccctccatcatgtaatgttaacggatgggcttgaccatcaaacaccttgataccatttcttgtgatcccctttgttgtggttgggagacacttgttgtcgcctcttcaattgatcttatcatgctcggaggctatacctacccatagctattttttccatcctctacgtcaccactagcttctacctagatatttgttgcatccttatcctacatatctcttgatatcgtcgccaacattgactgaagacttatttgttatcagccttgtcttttgctatatgatgacataacgtttgtcgtcgaagatcaaggccgagtggagggaagtagcattaccatagacacaagtgggctagagaacctatttcaagcaagaattagttagcatcaatgactaatttctcttcaaacttaggtattttgtgtgtatgatttctaacagttttctagtttgatgttgttttattttattgaaacctttgaaagttcaatggttttgttgttgtctccctttggtagcattacatttgtgttacataagtttatttgggatagaaagatgaatttgcgggatataatgaatcgccatcaaagtcaactaaccaagaaaatcactactccctccatggataaactaatgtttgatgctcctacaaaccattttatcctacctagataccctagtagaaaacattgtttgcatgtccattttcctttttggaccacaggaaaaaaatgccacatgaatagaacaaacttaggaatatgaacaaaatataggtgcaaataatatattgcaaaagcacatgagagtgtagggtgcgggcagggaaatttcgaatggcatcacatatgttttctatacgcacaaagattgatgatttttcatatgaaaaatattcatcaatcctacatcccaaatgttgatatagtgaaagaatagtatgtcgaagaatcctttacgttttctccattccaaacgggccgactagtttgttgtttctaagcatagagctataaaagatacaactagtatccttactatgtctctctttttatgtcaccatttatggttgatgatttgttgtttccttgtcctacttcttggtatccccccacatgttgaccttaagcttttttttttgtcgacatccttataccttctatcatctttgtctcgtgtgaccgtcacactagtcatcaaatatttaagcaaagtttggagggtgtatgtaaaaaatatcatgtatttgccacatatctaacccacaataatttgctaatataatgcttgtgtcaattgtatcgtgtcttgtaaaaatatagtttgacgacttttatggttatccgccttgataacattattacttttgtgttacattaatcaaatcatgcaaataagatggggaaaaggggaggaatatttttcaccatcacatatagctaactaagaaataaatattttcctgcaaaaaaaaaggaatagccagtgatggagggatgcaatatgcatgcaaatagtaaaacaaacaaaaaccaatgcatgaacctagccatggaggatcccaagcaccaataatggaagaaaagaacgtaggaaaagaagaaaaaggagagggccaatgtagacttaaaaactccctaaccactttttgtgcaaagctgacattttcaattctgctgtccctctctccacctctgcctgcatgctaccagccccacactccaccacaacctctcttcccctttcctttgcctgcattctgcattttgacttctcctcctcctcaaactcactcatcacttctgttccttgaatttatttgtatttccatacacaccctcatcttctactactatcttctagataccattctaaaaaaaatatatgaatttctagagttttgcaggtaattaagaaaatatattgaattaaatggagaacggccatgattcgtttgacaaaaattaaacaaggaaagactatgattaaatgagatgaaggagtaggtgtttaaatactactcctatatttcagggtaaatttagataacgagaaactactatattttgaaacagcaagaaatagtaataatattaattactatgtttccattcatgttcatgcacatgttcactgttcacatttgtttatcaccttctcacataggggctgcgtttagttcacatcaaaattggaaagtttggttgaaattgaaacgatgtgacggaaaagttggaagtttatgtgtgtaggaaaattttaatatgatgaaaaagttgaaagtttgaagaattattttagaactaaacacggcgaggattacacgcatggtagtaccagatttgtagccctgagaagtgaatgaaaatccacagtttcccccaaaaaagcctcctctttttacttacctgaacttt

SEQ ID NO: 58470 - DNA, 830 bp, Oryza sativa
tccaggttcttatctgggtccatgctcctgaattggtttaggcatctttttctctctctctgcgattatgaaattttaggagttggatgttgatttttcaatatatgaacaggagattttttttgtttggtcgtgttaagagaagtcgtaatctaggtaggtctctagtgctaattatagcaaaaggaagagatgtctttctctccagagtttaggtttcgttcaaaaattttgcgccgtattttgattgacaaggagagatgagatctgtgcagtatgtcaatcagtcaagactaatccagatgctgttcatgtcttgttcttgatctggtcataaccttgcactttcagtttctgtgatgcttcaattgtcaaaaccagcgtgttttagcactgttccaccatggcagttgttctccaacgcagctaaaaaaaagtcaattctttagtattatattgcagatatgtttgtctaccatttcagtctaataataataaatactactcgatttgtctctgtccattgaaccaaaacatattctatgaccaataattgacaatacaatactgcctgttgctaacccagttcagtttatctttcaggaatcttgagaagcctatgcaattgctggttcttcatcaaccttcgcaagttttttggttccgtttgtagatattagctaaccatagatcaattatagtttagccatcttataaacaagctgttgtgagaatttgacttcagatgggccaaggagttgcggctattcctggccttgggtctctcggaggcgtctcctgcgacaaattccttttctcctttgcgaaat

SEQ ID NO: 58471 - DNA, 8032 bp, Oryza sativa
acaactgtctgatatgagccaaagccctgatttgtgttcaaccccagtgtcctctgataagcacaagtctctaaaggatagctcatggactaggagatattttgataatggtggaaggaggagggttagtgcagtggacgctactgaagttcggaggaaccgcggggttagtatggctcaggcagttcaaactacagttgattggacacttgatccatctaagctgctcgtggggcataagtttgcatctggggcatatagccggctctacaaaggactctatgatgataaaccagttgccattaaatttattcggcaacctgatgatgacgacaatgggaagatggctgcaaaacttgaaaaacagtataacagtgaggtcaatgctctatctcacctctatcacaagaatgtgatcaaggtaacaaataaccgcttttcatcttgcatcttgcattattctgccataatcaccatataaatctatggaagtgtgttcttagattttacttgagttacttctaatgaccatgaagtctggtattgtgatcagattaaattaatactgtagcctttatttcataaaaaagaacacttaggataatccacaaactctgtcagacatttcagcttatgttctcttctcttaaggtatttgatcttatttgattaacactgttctataaaattcccaggatattcattcactttatatggttggcttgattgattgacattagctgatcactgaataatctctgaaatactcaatttttatgattttgctaatggcaaaccttctctgatcttatttatgtaatgcagctagtagcagcctataaatgcccaccagttttttacataattactgagttcctccctggaggttccctgaggtcatatctaaatagcacagagcatcaccccatccctctggagaagatcatatccattgctctcgatgttgcctgtgggttggagtacattcactctcaaggggtcgtgcaccgtgacattaagccagagaacattctctttgatgagaacttctgtgtaaagattgctgattttgggattgcctgtgaggagtcaatgtgtgatgtgctggtggaagacgaaggcacttaccggtggatggcccccgagatgatcaagcgtaaggcatacaaccggaaggtcgacgtctatagctttggactactcctatgggaaatgatctctggaagaattcctttcgatgacttaacccctctccaggcggcttatgctgttgcaactagggtaatggtttctttctcaatttgagtatacctcctaagagtaattttgttgctccgcagatgtccaaaaacttatgcctcctttttctctccgtgtttaatttttcagcatgcgcgaccagtaattcctccagaatgtccaatggctctgagaccgttgatcgaacagtgttgctcattgcagcccgaaaagaggcctgatttctggcagattgttaaaatcctggaggaatttcattctgttctctcccaaggtggctgcctcgactcactgaagagcagcaacagccaggatcagaaaaagcgacttctgcattggattcaaaagctgaaaccctcacatagcacctgagttcctgtagtctctagcatcctttctgccagatgtttttatccggttctgtatgctcagtagcttagcataagattttcatttttgttcagaaaaggtgaacctgtgttctaggatgcttggacatgtttatcaggtgaattgcaagtaggtttacagtacctgtatattgtgctacccttctgctctcttctctgtttttgtgaaatttagtagcagatcattcacatgcaggtgtctctaattataaaaaaggtagcattattggcctagatatatcgtaatcactcatttatattaagattttaaggcaaacctatgcagggttgactccaggccgtcagaacaggaaaatggcattcgttaatacaattattgtatcttatattatggagtcatcgtaattatgatgcgactttgagaaagcaacatctctgcttgcttgaagtctgctttatccttgtgctgtttttttcttgaaagatggatgtcagtttctgggagtttttttgttccgtagcagcatctttagctgaaaacttggttaaagtatgggctctccaaaattcgccatatgtgggagaagttggttttttttttcttttgaaaagttgggttgaattttgagtgtatatgaagccttttctcttcagatctccatcagtagtttgctgaatgtatgcgtatcttgtaagctctaccctgaaagtctgaagttctgaaacattcagatcactgtaaagctttactccgaatttttcttcttgacgaatctttctattgttcttggcaaagcagcacgactgcaatgaaatgagtgaacaaaatgccgcgtagtttagcacactaattacaggttcaaaaactctgaaattgagtatagagcattttcggcggagcaaaaactgcgcactgtcaccatcgaaaaactgtagcagttcagcactaatttcagcagttcttcaggcagcagcatcaccatcagaaaaagagcagacaactgagatagcagcacataggggggccacattgaaccgtttcgatctcgcgtagctgtaagcatgtaactgatgcaacaacatgtttaattagcagacaaagcaacatttttcccccatcttgtcgacgtcagaatgacagaatggacggtgcttagtactacgaaatgcaacatttttccagcttgcgaacgtcaagagtttgtgtgttggtgtgaactgtaagcaagaaccacagaaaacaccttgtcctttcgagatgggataatgaaaatggattacagttaattagtactagcaagtactatatacttatctctctctttctctctctatctctatacatatatatgcttttaagttttaacttgatgaatttgtacaaacctgcaagtaaatcagtagggtaaaaaaaaagaagaaaaaagaagcgaattacacgatgcagattaagattaaccagtgagtgatttatctcactcgatcactctcgcagctaagctaagctagcttagctacttgcactggctgttgacgaaggcctccgacctgacgatcctgtccatgagcttgtccagccgcgcggcgccggggcccggccggagcacccagtcgtcgccgacctcgtcgcacccgccgccggcgccgacgcaccacccgccccggacgaacatgtcgccttcggcgcccgccgtgccattgccattggcgcggccgcggccgccgagcaggtcggcgtcgatggcgtcgagcacggggtcgtcgcgggggaacttgcgggcgaagggggcgccgctgcgctccatggcggggcggtcggcgagggcgagcgggtgcgggtgctggcgcggcggcgtgtcccactggatgtggtggaggtcgtggttcgccgccgtgggcacgaaccgcggcgcgttgcagagcacggtctggaagtagccctccggcgaggagacgaagttggcgtagtacatgagcagcgtccgcggcaggttgtcccacccccacaccacgtattcggcgaaatccctgctcagcgccacccacgccgaccccgtgaacagcttgaacgccgtcggcagctcccgccgctgctccacgtagaagatgtcctgcttccgcgccatgtacagccccgggtccacgatcaccggcctcgccctctgccccctacattgccatccagcctcgttcgtcagaacgaagctgtaatataataaactaactagtttaccaaacctcaaaaggtgtagtaagtacttactccttccatcctagatagccggtgtgctcgatgaagttggtgttcctcgggatcgaggacaacacgtggaggatatctgatggatgaatggttttagcacacgaagtcgtgaagctcacatgtcagtgactcaaagttagggggacggtcgtcgtaccgtcttgggtcatgagagggtagtcggaggcggagaggttgatgaaccagtcccagtcgcggctgcgtcggaggaggacggcgcaggcgtggagggtgttggcgaccatggtggggccgcggtaggtcaccatgttggagcggcggatcacctccacgttgccgactcgccggaacatggagctgttcgccacgcgcgccgccagctcgagccgctccgacacggcggcctcccggtcgaggtggacgacgtagaggtttcgcgggtggtagagcgcgtggagcgtccgccatagccggtcgaggtcgcccttggagccggacaccaggtaggccagcctcgccacgccggcgcctggcggcggcgacggcggcggcagcggcagcggctgcttggcggcggggaagaaggcggggagcgacgccgcgacggagagcgacgaggtggcgaccgccagcgtgacggcgaggaagaggaacacgccgaacgccgccggcagcgcccaccggctctccagcagcgccgccgcgccgctcggcaggacggacgacgccgccgccgacggcgacggccagcgcggcgactgcttcgtcggcgtcgacgtcgccagcgcggagtagtccccccgcggcgtcttccccgacgtcggcgagtgatgatcacctcctcctcgacctcctccgccgccgccgcccatggtgctcgccggcatgacacccaccgccgccgcaccacgctacagaattttcatggttcgctctcaccaaaactcttgtaatttatatggaattataagcagccaagaaccaatctctctcaaagaacttgcgaggaatagggagacccgatgtgaccgatttcaaagacgaaaaatcaaaaatcaaaaacaaaataaaaatcagaatatgatcaaaatatcgatcacgaccttaaccaagaaaccgagtggaattaaacgcgatgctgatgcaacggcgaagaccttatcgccaaagagatctgaacacgcactgctcctccttgacccagtagcccgggagatcaatcaatcaaaacaaaaaacaagaagaaaaaaaaaatcaaaaagaacacgacgacctcttcaaaacacgaaatcgaccaaccaaacaaccggaatctgacagggacagatgataatcagatcagatatagaggcagctgcaactccatgcatgtgtcgcaattaataatgctcgatcgatcgagaagaagagagccgagatcgatgagaagaatataagtggggtgtgtaattaatcgatcgatcaagagagagaggtgaggagatcgatcgagcagataacgcgggaaacggttgcgagtttgtggagggatatatatagaacacggcatgtacatcaccaacacgacaggtggcaagatttgcgagacacttcccccggctaacacgggccataacctatccctaataatgtgtatacttaattaattagtatagtaagcagatgagtgcttcttcttcttcttctctcgtcgccgtacgcaaatggcgatgtgcgtgtgtgcatgcaagcgtcgtcacggattggtacactcgagaaagttaattatcatgtgacagcgacggagattgaggagaagtttagagtccatggcccagatgatctgcttgatttctgcagtttccggtattttaatcatcatctctgtgtattatcttagtttatttttacgatatggaagtataaattcgtatttgcaccaacttaaaatatgtactggagttgtataatggaaaacggaacaatgaattaatgtgtgattaattattattagcttaaaaaattaaaaaaaaaataaattaatatgattttttaaagcaacttttttatagaaatttttacaaaacacataccgattagcagtttaaaaaatgtgcgcagtaaacgaccgagtaaagttgggaagttgggaacatggacttgtgaagttgtgagttgtgaacacagcctaacaatcacagcaactgtgttttatccaagctaattaattaattaaatctgatttttgatccggtttgacttgattaagaattgatagagagagataattaagctggcagggggacatctctggtaagcatgtcccttgtcaccaaaccctggcacaaatatgtcattttttaagcgataaattaagttgactagggttaatttaaggctttaagcacctgtactgaagggcaaacaacaagaaaacactgaacaaaagcaatcacactactacgtgtttaagaaacggaaattaaagctactcctatcaaacattgatagagcattaatatattaaaggaaaaacgagagtaagaaatcgtcttagagcatgatcaataattcaatatgtagtatgaccaccaccgaagctaggaaattaatgtcacattagactgacacaagaagtctacattttttttgtctagagatttagctaaagaaaaagataggatccggcttcacatacaaaagttgatttattattttataatgaaagaagtactccattcggtcacgaaattagtgatttagtgacgtgttggacagtggcatggtaaccaaaaaattgattattaattactaccaccaataaataaagcacagtcataatattttgaaaccttttttttgaaaaatttaaccatattattttcaaattttgaatcaaaatatttgaagaaaaattgatagtcaaagtttaaacgtgctgactacacgtcctctaaaatatcacttattttttatcgaagggagtaacaaaatcccagaccatgcaatgtgccaatgttcatctcccttctcaagatgacaaatggccggggtctgatcttagattttttcactcacaacggtactcattgagtcattggagggagtaattctagtgtttaggtacaggtacaaaggttaactctctgcgatcccctcttagtagtactgatgaaatgagcacactcgagttgttaacaccaacatttgccaatgaagtcgcataggtataccacctgaagatatatgataatcaagcaaatctaaacgaggacatatctgatatgatacacattggtttaagaaaaagtgcatgacacaaccttcttcatatatactccagtttttaatagataacatcgttaactttcgactatttatcttatcaaaaaattatataaatatattttattttgctatgacttattttatcattaaagaaactttaagaatggtttatatttttttatatttatactaattcttttaataagatagatagtcaaatattatgttaaaaagttaacaacatcatctattaagaaacaaagtttcaaaattttcttttgatgggggctgtttaaaagaatttccctactcgaatttcctcccctgcgcatgtgtttaggcagactttttcatgccccaactagcatatcttgacacttgtgggacccaattttgaattttgttcggtcacacagtactacaactaaacacatgggttcagattcacctaggcattattgtttattgtagctgatgatttgatttcaagttacatgcatatacgtatcctttccatcatgtcttcatcaatcttgtatcatattctaacagtgtttcgatgtaataatcgttaaaaaacaattgttgattctctactccgtagaggctctgtgtggtctgtacgggtcttggctcctaattaacgttgttgcaaatatttcctacatgtaattaagatggctagctgcgttgataacacgatatgtatcgtttaaaacctaatttggtcctaaccctgtgtgggcccatcctgaatccaatgtgtagcggtgcacgtatatgcatatgtttacaatgagtttggcgagtactttctttctattgattataaatatatttttttgatgtttatagaacaatagtttcttaagtccttaatttaaaaaca

SEQ ID NO: 58472 - DNA, 4897 bp, Oryza sativa
tatatatatatatatatatatatatatataaaaataagatttttggactataaattatttgtttcgttaaccagtattacggagtacacagcttatacttagataaaatgcttgcatcacttcttgcattttaaaatatactccctccattccataatataagacataactaattattttaaaaaaaatgtttcataatataatatataggcatgtatgaatgcatgcaattaactaccacttctttctcactaaattattattttttgagtcctatatccttaatatttttaattctattaagtgaatgcattatatatatatatatacacgaattatgaggtgataataattactttttggtctttagattaagggtggttgagccttatattttggaatggagagagtagcagcttcttgcattcataatttgttgtaaaatataatttttttcacctatgtataggtttttaacccaccacgttactagctccgtcccagaacgtagcaacctaggatatgctaatgggtctaatctgaaatatgctcgtgtctagattcgtagtcttaagatagatctaatctcatcctaactggctacgttatgggacggagggagtacgttcttccatcgttcaatttccacacctacaggctccatcgccgtcgcaggcccggccacctcatgtaggtcgtgagatcatccagtacgtacgtgccaacgtactctagcttcgtcagcatctggtatgtacaaattttagatggggatgtttttattccgaaaatggaaagtctacggatcgttgggggttgagttaggccgcgtgaggaccgtccgatctgggatctgcggatcaggttacgctgctgcagtcaaacgttgccgtgtgatcatccgtgtcgaatttgtacgagcaaagcactgttgcagctacggtgaatcgtgttgtggtacttttcgaccaatgtttaatcattcattttatttaaaatgtttgtgcaaatataaaaatatttatgtcatgcttaaaggacatttgataatgaatcaagtcacattaaaataaatgataattacatagatttttttgaatacgacgaatggtcaaacgttggacaaaaagtcaacggcgtcatacattaaaatatggaagtagtccgttttaatttctttcaagctccaactgctcctccacttgcatttactctatggagtttgagatgagagcagtaggaagattcatagatattgtttccgtgaaatcttttccaaaattcaaatcctctccaaagatattattatgccttcgtttcgttccaactttgacagagtattaacaatcgactcattacgagtttgacatggtctctaagtagcttgccattagacctggatcatctgcctactataccaagtaactagtgtgttctctctctctctccaacctctgattcgcaaatcatcggtttataatttggaagatgctataacatttttcttatttttttcaatataggcaaccattgttactacaccgtttttatagtatcaagttattgttatgtatgtattgaaactttctagcttctctgccacgcgtattactgtagaagaccaagtccctcatggcatggttgtattcgatatgaggttgggaacccatctcctccgtaaaaaaaacggagcagtctattagcgcatgattaattaaatattagcttttttaaaaaaaaggattaatttgattatttggtttttaagtaacttttgtatagatttttttaaaaaaaacacaccgtttagcagtttgaaaagcatgagcgaaaaaagaagagagagagagagaggggggttggaaaaaggctcaaacgaacagagcataagctatagacacatcggttttccatagcttttctgtacgacctcttgtaggaagaatcgatgcaagctcacccaaaatagggatttcataagtcaatcctatcacaaatgtacaatccctgatgatgtctagcagagaagctagaattaatgaaatggaggaagggctacccgcttaatttattcttctttaaatcaaatttaggttgatgtggttgtcaagattaagctgagaggattcaaatatggtgaaaataaacaaactacagttagaaaaatttagatcaggtttctaggcacccgacctcttctcttgtagctccacccctaatgtctgtgtgattttgttccgggcgcacgtacttttgatgggggagtatgtgcgtcatcaaccttcgatgatgtcttgaaagaaaataaaaactgaagattattaaaagttgtatatataacagttatctacttatcttcgttgaatcacttgctatccaagaaaaatggtggatgaatttgtttaattatatgtcctgcttatcttcaatgtcttaactcttaagagaacgatttcagtcatctttgaccacgtgagctatgatttagtattctcgcctgaattttgtcatttatcaaggcaattatccatatgcaagcttgacacataagccgccttctgaaaggaatcagactctacttttaactttagtctagtacaagttaaacggctgcttaaaaccaagacttggtaaatgttgactttagtcaatcgaagaaaaaccttgcgcaaacagcaactactgaatttagcaatttcgattggtaatatcagaccaaattccattcactctattataatttgaagtatggtgaagcttatacttcttagaagaagactaccaaaaatggtagattttagcacatattttatatatataacattggtaatttcataccaaatttcattcactctattataatttgaagtatggtgaagcttatacctcagaaaaaaaggctaccaaaaatggtaaattttaacagatatttaatatacataatatacatttatgaagtacacataagactacgatttagtctgactcaacatttacattactcgggcacacaatttcagaatcataggactcacaataaccactgaattttgcaaatttgaccgaaaatgaataccctgagtgcaattggaacttgacaagttctgatcatgtttggttccattccacagcctttcctagcaagtactaggcaagatttctcatcaacttggccacatgcaggacgtacattcactgcaaccactgaagttttgcaaatttcactaaaatgaaaccccacgtgcaactcggaacctagttaacaggttttggtcatgtttggtcccattgtacagcatgtcttagcatggagtaagcaagatttctcaataacttggccacatgtagggcgtacgacccactagcgtggggtacactatacaaaaacaaggaaccaagcatgcccaaaacttcgtagatctaattcacacagcatacctagcaatctgaaatatacaattgagctagcatttcagcaaactgaaaccagaacatggagaattgccagcctcatgataatgacatctgtagaacacccaaattgccgctaaattaacaaatggccttcttccctctccttcaaagttttttttcccaattaaaaggcatttcacagctagactttcctgtacataacgtgatatatatcccccggaaatatgggggaaaggaagccaataaaacttctcttgcaaaatcacgtcgatacgaaattacttgctaagcattggccttactgctgcatagctcgatagctggagcggcttgaagggaagaccggggcagcgccaaagtcactgggtcttaggccaaactgatgatgcccatccccggagtgcccatggcctctccttgctcttgacttctcaacccgggttcggcggaagacttcttgaatttggcggtcattttccttcagcatctgatcgacattgcctgaagggcaaattagaggcccagaatggtggatcttgttaccctttgatccatagccctgttcagacaagaaatagtcaattagaaatctagacaggggaacaaagtaaagttatctgacatcaaagctagtgctataatatttttcggtttttccaaatgtgttaatcgtgaactacaaataatgctaggtaaacctcataataacctgctggaactgaatacataatatatgaggaccttggatttgctgaaagaaacttttcaatttgacaactgagatttgcaaaaaaactgccaactatgaattaaatggcataacaaactgttttcatacttttgctacttaggtctggagatacttacaatagctccatccaccctgctactcctgtcatctttctgctgaaatacttgatcatactttccactactactgaaacgctcatttatagattcagacagcctccgttcatgcggaaaggcttcggcttgagtaaccactgttccattgccattatctgaacgaatatttgatcttgttgatacaaccacacggaagtccgatgcgtttgcaacaccagaaagatgaatatcgccattttcactccgtccagcctttgaaggtttattttgattaactagaggcccagaatggaatgttcttgtgtagacacgttgagagtcttgagacgattcagcaggatgagttggcctgggtggctcaatcggaaagccagatgcagagtcttccttgctgggattgaacatctcactcctgctcttggcattgacttggttttgtcttttctgaaattgtacacaaaaataaatatattcatctaaaaaaatagaacaacttggatagcaagattgtagaggaaaaatacacttggaatgtgtgctggctattaaaggcttcatgtacttgtggaaaaaaaggagacaaagcgcacagctt

SEQ ID NO: 58473 - DNA, 1392 bp, Oryza sativa
tcctcctctcgccgttttgcatcaaactctttgcttgggggatatctcggcagacttgaaggattgcaagcatatggttttgttgcaaaaaactgaagaagacaataacaagcacattgttaatatcccaaagattgggtactatgatgattaaaagtaaaaaaaaaaaacttttgagatgtattgtgaaagattaacaacctcctctaacataacatctagtggatcatggtacacagaaatgaatagcaacagagcttttatacttctaaatccaaaaccttgatccaactaggacatgatgactttcatagacattagagatggttcagggggaattattttgcagaaagtatttacttccaaacaaatatagctgatctgaagtttctaaaaaaaaggaaaataacgttttaacagtgatactttgctattttaaaacttcaaacagcagaatatttgaatgcagcacattactccctctgttacaaatctctggtgtttctggaattgtacgctctccaacatgtgcctttgactgttacttttaatttatattctgagagagtgagagtattattttacagcaaatgtaatggtaaggctttcatctgattaatcttgatagtgttatgtgggttagcatttattgtctgagagttcacggcacacatgccatgttgacatacatttgtaaacagaggggacaattgagaattgaaatggagtaacgtataatcaaatagaatctctatatggattctctctcgaaataaaaaagaatctctatatggaaataaacaggaatgtctccagcagctggagaaaagtccaaggaatttgaatacctcactttgcaatgcagaagatgctgttcctcgatctgctggatcaactgaaagaagaacatccactaacgccacagcaggcggaggaaaatctttaaatgtttctgatacacgcctagcatatggatgctgtggcttaaaaattgtggcatgaggaagtttagacttcctccaatagtcctctgatggtgaaccacagagtttaaatattttatgtaactgctcaacctacaaaaagaaaaaaaacaatatgaacactatttcaagacaaattcaaagcattcactaatagcgtttactccctctgcccactaatataaaacgtgttttgattacagaaattcaaatttgaaagattttgaccaatgattagttactacctctgtcccaaaatataacaatttttagctatgtatctagacatacccctgtccagatacatagctagaagttgttgtattttggacagagggagtaccatacaagcacatttagtgtgtcaaacttatagcattagattcatacttcaaagtaatttcacata

SEQ ID NO: 58474 - DNA, 1449 bp, Oryza sativa
ttttaagtaaacagctacttgaggcttttttaggactactataggatgcaatatattcctttagtctttctttacagctaataagatttaataacgagtacagattccagaagaggtaatatcaatatacctgagactcagtaaatttcactccaggaaaagaagctagtccagctaggtcatgttccatgtactcaaaaacaagatataagctacaagacattcttgaagttactagaccctccagcttaataatatttggatgatcaagccgtcgcaaaataaggatttccctggccatgaacttcacactctcaggttccaaattatcaaaccgcactttctttagggcaacaatcttctccttttcaagatcgcgagctctgtaaacattactgtatgttccctgaccaatctgtataaacaaaataacaacaactgaacacaccatggtataaagggcgcaatcagtccaggtgcaaagtaaagtttaacagtgcacaatctagttacaaagaaaaagggacataattgtcaaccaaatagcagttcctaaaattttgaagttcagagaaataaagtatcccgtagcaaacaaaacaggaaaccgcggtattataacagctaaacaccagtgattcagctaaactgaaactggatcaactgttagcagaatatattacattattactattactatttaaattttaaaccaagtttgcaggtgaaaaaaaaaagttgccaccatactctcagatcccatagcaatgtagtactactactagaatagcattgttcaccccaccccattaatagcagggcatgagttgctagtaatgcccactgttcccaggttccaaggtccaccaaaattatcaagaaatccaaaataaagaaaatgccaccgcattttcgcatccaacgtaaaaggtgcctcccactaataacagatttgtactgtttccagtcgtcctagctaccaagaatccacttaatagacaacccaaataaaaacatcgcgatagtacccaccctcatcaatcgtcagtaaatatccctgtaagaggggtaaactccccacattttacagcccaattttaccttttttccttccattagagaaagtatgaaggtggggagcacattgttaatgcatcaatctatattctcaacgagaaacagaaatccaaaagggggaattcgcagcccgcattgctccaaattctcgccgttccaatgttccaaattagagatcaaagatgagagcagaaaatgaacagagccaaaatggagatgtagagagagagagagagaggagaagagagtgtgtgaccttgtcgagcttctcgaacgactcggcgcggcgaggcacccacccgcgcacggcctccgcggcgacggagacgagccacggcggccaccccgccgccacctgctccccctccaccg

SEQ ID NO: 58475 - DNA, 9630 bp, Oryza sativa
ttttctcattatgttttgaaggagttgagaagatagtggagaagcgatagatcgtgcatgcacggatagcaagaagcaacagatcgatcgagatgactttgtggatcagaatgcaagactttcagagccgtccctagcttagaaatcttgcagcatttaatttcgttctttgcttaagagagatgacaaaaatgcatgctcgaatgtaaaggatatgtgtttgtttgtttgtttttgttaaatcttatacttggagaattgaggtagtgtttgatctagctatagtgggtaaaggcttgtcaaaaaagttggtcgtgtctgtacaatggggtgtggcatcaagatcatgcctaaaggaaggttatgtgccttttcgcaccttaccaaatgtcacttttggatgtggttatgtgagtggatgggattagacacaatctcttcagattggtaaggggactacgtaactacgttaaatatgtagtttctctttcgatttgaagaatgcggtgaaaatggatgattgagatttatttaggcaatgtaaatgatggcgtatttggttgggggcaatggttaagggtaatagtagtttgagggggtggagactgttaagtctattgtgttggttgaagaatgtgggagttttatttaagagcgtactcccacatttttaatacctggttagggagaggtaattgggagggaatttctttctaagtatgacgagataaatctgagccggacatcatcacttaaaattcaattccccttcatactccccatgattctcatctctattaccaaacaagggattggcagtaaaaatgtaagtcgatcccatgaccaatccctccaactccctcctttaaactcccaatccattcccatctcttgccaaatagccgtgaggaatcgtcaactcctacggtcctacccctactcacaggtattaaaattcaggaagttcatccctcaattctcattcttcaactctgatgtctcttaaccaaatgaagcaattagtattctcttccctctaaactcctaatccctcctaaagactcccccaaccaaacacatgaggggcaaaagtaattcaatccctagggtaaatcttaaaactttgtgcttaaacatcctcctataaggacatacatgaagtttaggatggctgatgttcaggtgtgtacttcatgtgttaggagcggtcgaatttcacgttcgcgattatgttagtacaattattgtatagggggagggggtgatttgaatatagccttttttacaacataccccaaatattcccgaaagacgttgttcaatttctttttcaaacctagctatataagaggtagatccaaaaaggaaactgtgaatcatccaacaaaccttgctatctgaagctagaccaattgacgatctcacaaatcatgggcatgtacgggttgagagtgtgtactactcgttcacggttggcagatgcctatcgcaaacacaatgcaaagagagaattcaaatgcagtgcaaacctttgactatttgagtttgcttccacgctagatcaagctaggatcaaaaacttgctcagctaggattcagccttgcgggggtcagcttaattggaagataaatcaaggctgcctcataatcataagatggaaataccattcaaaaagaaccaaaagcaaacaagttcagaggaaagacacacaccaatagaccaaacattcgtttctgagcacatatttcacaaccttacctgcattagttacactccctcttatcgacatctaccaaaactccgaaccagttttctaacgaaaaagccaacacaatggtcaacttttcttgccaattttccatcacaaaatataaacaatcatatgatggattcaccctgcattaaaaattttgataaactttatccttttttaaaaaaaaaaccatggatatgaaggaagagcttggtatcaataatattaaaaacaaatataagtgcagtctcgagtcgagtgaggatggaaggggcgcttggtagctgccccaccaactgcgtatatttgcgattcatcctacattaagagcatatattatagtaaaacttgatcctaaaggggaaatgatcatggattctagggaggagcttggtatcaataatattaataatttgggatgtcaaaaggaaacatgagtgcactctaaagtcgagcaccagagcacggatggacgagacgcttggccgctgccctgccaactatgcatgtttataattcaccctacgctaagagaacaaattaataaattttgatttgtatgggaaaaaaaaagatatgtgagcgcaatctagagtagagcgcgggcggacgagacgctcaatggttgtccacaccaattgcgcttgtgcaattctcgttgaaatgaaaataaaatgctacatgtatttatgcgctctcgcggagagcatgttatatatagccacttttgattacatttttatgagggaggttgcacaagagtacacgatatatagattaacatgtaaatgggaacagattaaaatgaaacacaaacaaaatgattactcctaattaactaacatatatatattgcccttaattacatcccaacaaacattctagaaaattggcataattcatagcatctgcataagaaaaacctgatgtgtaccgcaactaattagtacatttcccgcaagccggttaattagtacatttattcctttcccaaattaataattaaatacccgtatattgtaaactgactcgtaaaaaacaaatgttctatttttcttttaatccattgaaccagttttagcttttttttgatgggcctattgaatcagtttgttaaaactacggtttttctagcaagaagacttggaactcagacgtgcactcgtttttacccccctcacacggtggtgtgaaggagagtaagaaaaatttagtacgtatacgtcccactcttttgggaaagggagatgcggtgagtggccagttcaccaaataattataactcatacttactagtacaaagaaaaatgtcatcacgtatatatatacctgtcggcgagatgcgtgcacgctaagatagtagaaacggtcgtgacagagagatgatgcatttgacacacgagtattttctgatgagatgagatggctcgtaccagctcatacatatgcctgcttgcagtcgctgcggtcatttgctgttgttgctccttgaggcaggcagggtggacgtcaccgccggatctcttcagattttgctgttccccccttgctgcgattccggatcaagaatccaaccaccatccatgctccatctcactagtagtactccctccgtcctaaaatataatagaactttctttttctttaagaaataattaagaaagggtttcataggtaatataatatgaaatagaatcagaccaaaggctaatagctgagaggaaccataattatttatagttcttttgcgaggttatttatggaagttaacatgtgaaattgatatttcctcgtttcatattgtaagaccttttgttgttttctaagtcatacttttttttagctttgatctaatttatagaaaaacataacaacatcttgaaatccaaaataaatatcgtgttaaaatataattaatgttagatttaataaaactaattaatttagtgttgtagagatgttgctactcttttctaagcatgatcaaacctaagaaaatttgacttaaaaaaatacaaaaacatcatataacattaaaacattataaaaccaaaggaggatcttagttatgatatcggcttttacgtacggtcaatgaattaggggtgaaaacggatcggattcggacggatagtagtcataccatatcctataccatattttttaatcggattcggaggtgatgcggataatgtgcggatgcggagcggattatttcggatgtcggaaatggtgcggagtcggtgcggactcggctcggaaacggataaaaataatcggatgtggcatgtatatacaatcgatacaacatctgatcatctgtacaatgagcaacaatgaggtaccaatatcacaattcacatgactcatgaaagcaccgatcacatcataatataatgtcgagttgttaacgattgacttgtcttctgtccaaaagcatgtaatcgacacatatagtattgacatcacgatatatcgcattcacataacacgtaagacatagaagttccacaaatattagaaaaaacaatatcacatgacataggtgatagaacattggaggtccacaaatgatgtccaattctcatacaatactactaataagttgcatattgcatatgacataataacacatatgcagctaaggtcagaaggagatgatctagagaagtagacttcaattctgataataacacatacgacagagttggtgctggagatggcaggaggcgtcgccggcgccgagacggagacaaccaggtgactttggggtggagagggtaggccgcggcgccggggtggagaaggcaggtggcggcggcggcgctgggtggagaagtcaggcggcggcgtgggaggactggaagaagagaagtctcgatgaaaaaattggttgacgcgacgccgacagagtcacggactgaactcctggatagattgatggataaggtggacgtggatgggctgaatctttacacgatgaaaatgctcgtgtcaaataggccaaattgagtggttatatgggctgtgaaattcagattatccgccaaaacgtttattggataatccgcttaaaatagcggataatccgtatctgtcggatataaccgataccatatccgcatccgcatccgcatgtaactatccgtatccgcatccggccggatatctaaaaacccttaccatatcctcacttcggacggattcggagcggatcggatcggataatatccgctccgttttcacccctacaatgaatgcttgtgctacatacagcatactagcactactgtacatgtctgcacctgaagaacagcacatactgttgcaatgcaacaggatatatgcaaattaaactgcaaaggcaaacctgaaccctgcgcgttgtgctttgctgctgaaatcagaccactggtttaactttaaagtgatctatccatgcatggtgtgcataatcaacagtagtgcaagtgtggatggagaagtggatgccaatgctgccatgcagatgcagaggcttcagttcagttcagctggcctgttcatcaactcaagctagcttagctagctgaaagggaaaggaaacaaacattgcaatggaccacatgaatgcgttgcatccatctctcacctcaatatctttgtgtccctttcacaaatatcatcatccatgcaccaccattgcccctctctcgctcgcctttggccaccgtgtctgtcgtcctcgtcctcgtccccgtcgccgtcgacggcgacggcgatggcggtgggtgaggtcctaacagaaaggcgacgtggtatgcatggtttccacggtgactgattatattggtcgagacatgagacatccgtggttaaacgatgctccctctctgatcatggatatttgttgtttaagattaaagtttggttgattaggtcaaacatttaaaattttgatcattagttttctattaattattattactctctgaatcatactgattattgtgttgtaacctgattaagccgtgcaggaactaattaatcgattttccaaatgtgacagctactgcagatgattctttaattccaaatgcgcccatggttatatattagttagtggacggcctgctgatcgtcttgcttaagcttttctcaacttgaccagacatttgttgcccttctggacaagtttcagggtctcttgccattccttccaatcagttataagatctttatgtagcttttgtgagcactcttctctcagctatacatctgaaaatttctcctagatggtacaaattcttttgcctgaaacactgaactgttgtcaaaattgggggcaatttattactactgtcatctatacagtttagtactttctgcaggtttgtgtagccatagctagctatacatttttttggtgaaaatcaaatcaagcatttggtcacagaatcaacatgacaacgtgtgagaggcagttatgtgtttaggaaagtgtcacatgtcaactggagtagtagtgtgtgtcattatgccagtctctttcaacaagaacaactattgcttaagggatgaaacctcttgcagaccagctaaagatctttttcttcatgtgggagcatccttatttcaggcaaacaatcaatgttgtcaccatagcatcttctccatggcttctccatttgatcatctcctttccatttagtgtgttcttgatgcatgtatatgcaatattgctctctttctttccacccataaagctttgtttaaagttgatggttatgtttaatgttctctgaatttgtggcctcagaactataccagaagtgaagtttgtcctctgatatgtggaagatagcattcatctcttcctcttcaccaaattattgatccacattaattattttctctgaccgtgctaattctgacaggaagactggaacaccgacttgctactttttcactgaagaaagaacaatgaaatgcttgaaagaaaacctgttgccatcaattgttcttgtgactctgcagtctgtggatcccaacacgtacctgaataatccaaagcctcaaagtaaaacagcagaatcctaatttcattttcatgtcttactctttgttagaaaacgataagcgaacaaacgataaataacaatagatcaatcacaaaagacacgagatttaacgtggaaaaccctcccaaaacaggagagaaaaaaccacgggcgccagccagcaaaatatattcactatatctggagtgaggttacatcgccacacgacggcttacaagaggtatatatacggtggaaccctatgctctggcccaagcctcccggcgacgggcctccgctccgctacggcagaagctggcctttattaagtgcaaatgaatttggatcacaactcaacactcttctcctagatgacaatatttctgcctgattataaactgtgatttttttccctgattttatagaatctggtacttataactgcaaatttatgaaactaataccagaatattaattcccagttaacaagcaagttcagtgtcattcatgtggccacttacctgacaagctagctagcaatcatttctgaagctgcagcaaaccccatgccttgccaatcaggaactagccctgcgttaccatccgaagaacactacgttgtgcctggatcaccacaggatagcacagtgctctaataattggctcaaagctgctgtggtgagccccagctggggctcaaagacctggagcctgcccttcttctcaaccatgaatgacggtttatttcatcagaatgtagtagtaaattcgccctcccgaaattaatgtgctgtcataaactgatagaaaacacatactgatctaattactgtgtgttaaattcagagcatgcattgcaacttttttttgctaaatcaattcagagcacactgcaacctttttgttaactttcggttggattagcatcccagttaaagcttcaacaacttcagtgacagcaggtggaaaacgagcaagtgtacaaaatacaggtacttcaaaagaaatctacttatgccacatggaattcaaactcaataggcctattatttcgaaaagagagaaattcaatatgcctatgaaaaactatatatgtatcatcttaatttggaatacagatcacacaaaacccatatttaattaaggtactagagatattaaccaaattaaataatctaatatctcaatcgcgtaatgcttatcattcatggatatgatgtgttctgaaaggaagctatatgactaggttctatttggtgcaatattagaaatgtagccaaaaagttcagcaatatgcggtctgaaagttcacagattctgatatatttgttcatgtttcagaaacactgacaactgatctggtgttgattccagtatgtaaaatctatccatactgtatggtttcctcagctaagttaaaaatcatagcatgagctttcattttactcctaatagttcaatttacatcataactaggcaaattaaactctaattcgtgtctaatgggcttcagatttgtagacaagaacccaaaatatcttccattgttccagaggtacctgcaattaatatagcaagtttgcccaagtcaaccacctcaatctccactgtttgattggacgtttaggtttcatatcaccaaggttcaatcagtgtggagtacttttcagtccttctggcctgtgccaaatgtagaaggagagccttttctctgatttgatccattcttgcaagctacaggtaagttgatttgattccacatagaattatttttcttctttgtttttccatgccttttcttctctgtcataaactcctaatttagctactataattttttcagtgaatcctagctaagagttagtttattgttctttttaggtactgaattttggtacatactagcaaattgtcatatacagcaacaaggatctagtggcatgagactttggcaagtgttcttgcagaaaccaaaatcagagctgcctccatttggctgaataattctggccatttctaaccgttcctcattgcttttctccttatgcatatactggaaaggtagctctgcaaaagtcaggtagacaataacactagaagcagttatatatgcttgcaaaaattcacaacctttccaaacaaaatttatttcttacaccattccaccaggaatggaatttcaatactaccttgccaagtgcagttacaaaatgttcaccaaaacgtccaaaccttcgctgcaactttaatttggacataattcatatatacttgctagtatagcaacaggaatgctgcatagtgacaacacatctaggatcatgtcccaactctgatagatccattacaccaacctatcttgagacagtgccaatgcaggaactaacctctcatggaaatgcatggtagctagctccacaatgtgacacatgtaagtctcaagttcaccgtgcgaaaaatcacgatgcgcgaatcgcccccccaatttcgacaggtaagggtagatcttcatcgatcggccagttgaaaacaacaacggcggtacaacgatcggccatcatcgtgcaccgcaccgcggcggtggcccagagccggtgatggggatgtatggacggtggagtgagtggagagagggttggcagcaagcatgatgcatcacattatgtgaggaagagataggggccccatgagagcaactgaaaggactgtgctgaattaataggaggctgctgctggtgagtacttagccattatctctgcatcctatgtgacaaacagaaactggacagtgtatgtggagtgtcacatggttgtatatacatcatacattaaatcat

SEQ ID NO: 58476 - DNA, 832 bp, Oryza sativa
tactacgtaagtagttagtagtagtaaaaacagactatctgaatttatacactaactccatcctatttcttaacttatataacttaatttgatgattctatcccagcacagtaagctactatagtatgaaccttcagactgcactgatgtttttctgctagagtggtgtattgcatacagtagatttttattgaaaaaaaaacttggcctgtaaaatttcttatagctaaatctgagagatcatgtagttttttgtgaagaatatgacgtacgtaacataaaacttttaaacaaagacatgtttaatacataagtgaaaattgaaatagactaattataacccaaacaggagtttttctctgcgaatgttcggttgaacatcatttcagctagaatatgttttcaacataaactttatgtactgatgaatgctatcatatatgctgcaaactgcagcactaccagcaggagtcctccaaactgcgccaacaaatcagtagcttacagaacgcaaacaggtaaagattccagatacgtatgacttacttttgcaccaatataaaccaaaatgttctgtattgcagtctaactcggcttgcctaaatatctctagtaggaccatagtgggggattctatcaacaccatgagcctcagggaccttaaacaggtagagaacaggctggagaaaggcatagctaagataagggctagaaaggtatatagtgcaactcaatttaaagcattatataacttatagtatacatcagctatttcttcatgacttttgactaagtgcaaattctatgttctttaattccatgcatgagctat

SEQ ID NO: 58477 - DNA, 922 bp, Oryza sativa
tttcttcatgaacttgatgaataaggtgtttatggaatacctagacaagttcgtggtagtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatctttttggtactcgtacagaggtgtataccgatcacaagagtttaaagtatatctttactcagccggatttgaacatgagacaacggagatggttggaattaattaaggactatgacatgggaattcattatcacccgggaaaggctaatgttgtagcagacgctcttagcaggaaaggctattgcaatgctacggaaggacgacagttgccattggaattatgcaaggaatttgaaagattaaatttgggaattgtc

SEQ ID NO: 58478 - DNA, 903 bp, Oryza sativa
cttctggaactcgaagacatttctttaactgggatacgtggaacacgttgtgcacatctgcgagaccttcaggtaactcaagctgataagccacttcgccacatccggcggttatggggtaggggccgatgtagcggggtgctaacttgccggacatcccaaacctcctcataccacggagaggtgatacctgcaggtacacgtggtctcctttttcgaattcaaggtcacacctccgattgtcagcgtaattcttctgacggttctgagctgtctttaaacgttctcggatcagcttaacttgttcttctgctgtcttgagtatgtcaggaccgaataccagtgcttcgccaacctcattccagcacaagggagtgcggcactttcttccgaacattgcctcatttcgcgacatctgaatgctggcctgataactgttgttgtatgagaactcagcatacggcaaacaacgatcccaagtgccttcaaaatccagggcacacgcacgtagcatgtcttctaggatttggtttactctttctgtctgaccatcggtctgcggatggtaagctgtactgaaatttagatctgttccaagagcttcatgcaactgcttccagaaccttgaggtgaactgagtgcctcggtctgacacaatcttcttgggacagccaaatctacatacgacatgggtcatgtagagttctgctagtttctttccatcaaaggtggttttcactggcacgaaatgagctgatttcgtgagtcgatccacgattacccagatggagtcgtacccgctaggggttcttggcaaaccggtgatgaaatccattccgatctcttcccatttccactcgggaatcggtaggggttgcagcagaccagctggcctctgatgct

SEQ ID NO: 58479 - DNA, 5509 bp, Oryza sativa
actgtcaagctggcagggacacctgactgtccacggttagccttaacttctccaattctctgcacaggcgaccgtggtctggccatatttgagcttcattgcaataggtcttgcgacttagcgcatccgcgaccgcattagctttaccgggatggtaatgaattccaagatcgtaatccttgattagttccaaccatcttctctgcctcatatataactcggtctgtgtgaacatatacttaagacttttgtgatcggtgttgtcggtgacatggggccgggggtattgtgactagaggcttgggaagccgcggtcacccacgtggcctgaccccctcgggggggtcgggcccgaggatgacgtggccacccctccctctgtctccccgaggggtcggaccgctcccgtttcggccccgagggccggggcgcccccgtttcggccccgagtgctggggcgccccgaccccctgtggttttggcgccacgcgtgtgggttaggtgagcacagcggggctcacctaaccgcatttatagcaggattggacgagcgcgccacgccgcatttaatgcggcgcagcgcacgcttatccggtccgcgactggtcacggtgtgtgaccggtcacagaccggtcagatcgcgggttaggtggcaacaggcggcctgtcacacgcctcgccccgtcccgtcggaatgatgagagcttcctgactctcgtcactagccggagccggcgtgctaactcctggagttggtatgtcagtcccggtcagatccattccaggcttcagcgcaagtatggcaaggaagtcgctggtcattaaatgaagcttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctagaaaaaaagagggagaagagaggaggggaggggggactctggcgaatggtttctagagcctgaactctctttcgctctcggcctctctgtattccttcatgcacagatccactagaacacaggagtagggtgttacgcttcttagcggcccgaacctgtctacgtcgcccgtgtcttgcgcatttcctctctcgctgacgttcctcagatcgagggcaaagaaactcacttagcgcccccggccgaaccggcaaaggggggcctgcgcggtctcccggtgaggagccccacgctccatcatctggcgcgccagtagggggcgcgcgggtctttctaagccctcgtcctctttcgtgtgcgccaagcttcgcccgctcagcccaatggccgaacgggcagtggcgcacagcctctctccgaacgctagcggtgacgatggggagcagaacccgcgccgtcgggctcgcaccccaccgtccccctctcgccgaaatcctgggcggggggaggcgctcggggaggtcggacgatccgcgacttcgccgcccgcgggcgacgggggaggacggcgagacagggcgcgtcgccgcctcgtctacggcgatggcggcacgccccagggcgcgctccaggctgcgggcgcgctcttgcgtcacccgcccgtcgtccccgatccagagactccagcccgatgttagctggatgacgtggccgacttggtcatgacggcgcagcggcgcctaggcgccggcgggcggtcctccgccaccgaggcctctggcgctgccgcagccggctccatgtcgtcgaggcggagggcgcggcgagcggcggccgttacccgccgttcgtccgccattccctcgtcaacgcctccgacccaagaagatgtgcgtggggggccggatgcccgcctcaatatcgagcgccggcgcgacgctcgtcgcgccgcccacgcaacggagggcgcttcctcgtccggagcgccacttcggttcgggcacgggggccggccccccgtgtccccggttggcggtgctggctgtcgagcctttgtggcgagccttcggaacgtccgttggcccccaagattccggcccaccatcaccgaaaaatacgacggaagcgtcaaccccgccgagtttctccagatctacacgaccgggatcgaggctgccgggggtgacgacagggtcatggcgaattacttccccatggccctgaagggtcaggcacggggttggctaatgatcttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcaactttttgagctcgcggaccgtgtggctcgcaaggaggaggcctggacctggaactcctccggttctggtgtggcagctccggccgcccccggatccgccgctcggtcagggcggcgggacgggaggaggaagaaggggtcggcccgttccgacgacgagggtcatgtcctcgccgtcgagggcgcttcgcgggccccccgaaaggggaggcctgcgagcgacaaaaagaaggaggccggtgctcccaggtgggagcgcccaaccggcaagtggtgtaccgtgcacaacacctccctccacgacctcgtggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccgtggcccctacccatgaggcgacgcggcgggcgcggtggtcggaggttgccctcaccttcgaccagaccgaccacccgccgtgcgttgcccagggaggacaaatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcaacctcccggtcacctttggtggttccgccaacttccgcacggagcgggtggacttcgatgtggcggacctcagtctgccctacaacgcggtcctggggaggcccgcgttggtgaagttcatggcggcggtccactacgcctatctccagatgaagatgccgggccccggtggccccatcaccgtccatggcgacctaaaagtcgcgcttgcctgtatggagcagcgcgcggaccacctcgccgcggcgtccaagcccgcgggtggcgacgagaggctcgccacctccgtcccggccgccccaaggcagcggatggtcacgtgcgacgaggtctcggtcaaggaggttgccctgggcgacggcccgtccaagaccacacgaatcggtggtcttctggatgacaaataggaagacgcgctcgtctccttcctgtgggcaaacgccgacgtcttcgcctggagaccggcggacatgcccggggtccccagggaggtgattgagcaccgtctcgccgtgcggcccggcgcaaggccggtccggcagatagtgcggcggcaggccccggaacgtcaagccttcatccgcgaggaggtggcgcgacttctggaggccggattcatccgtgaggtcatccatctggagtggctggcgaacccggtcgtcgttcccaaggcgaacggcaagcttcggatgtgcatcgactacaccgaccttaacaaggcatgtcctaaggacccttaccccttgccacgcatagatcagattgtcgactccaccgctgggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagtggatgcgccccccagcaagcttagggatgtgcagtgcgtcaccggctgcatggccgccctaagtcggttcatatcgaggctgggagagaaggcactacccctatttaagctcctcaaacgctccaggccgtttacctggacggaggaggctgagcgggccttcactcagttgaaggcgtacctcagttctcccccagtcctggtcgccccggagccagatgagccgttgctactctacctggcggcaaccccgcaggtggacagcgcggcattggccgtggagcgcgacgaggacaaccctcactccgcgcatccccaccctgcttcgactcgacccgggagagagcagggagcagaggcccccgagccgaatggcggcctaaggcccccgacggccggagctggccctccgcctgcttgtccgacggtgccaggcgcccccgacccccaggatggccccggggccactgcgggaaggccgcgcctgtcgccctccgaccccgaggtcgtcggcacagaagccgagtgcgccccgcgtggcctctcggacgaagagcgtcctggagatgtggcccctagcgaagaggatcggccccgccgaaaggtgcagcggcccgtctacttcgttagcgaggccctccgggacgccaagacccgataccctcaggcccagaagatgctttacgctattctgatggcttcaaggaagttgcgccattatttccaggcgcatcgggtcacggtggttacgtcttaccccctcgaccaaatcttgcataaccgagagggtactggacgggtggtgagatgggcaatcgaactctctgaattcgatttgcgctttgaatcacgccacgcgatcaagagccaggccctcgccgactttgtggcggagtggaccc

SEQ ID NO: 58480 - DNA, 3562 bp, Oryza sativa
atttgcgctttgaatcacgccactcgatcaagagccaggccctcgccgactttgtggcggagtggaccctagctcccgagccgtctccgcccccgaggccagctcgggccccccgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcccagccgtcggcccgacccgaccccctaggggagacggacgcgcctgaatggcccccgaggcccgtcggagtccaggcctcgggacccgaggggagcactcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggttaacggagtcctcctgaagtgcattcctcgggaacaaggcgtcgagcttctcgccgatgtccatgaaggcgagtgcggagcccactccgcctcacgcaccttggttggcaaggcctttcgccagggtttctattagccgacggctctcaacgatgcggtcgacctggtctgacggtgcaggtcgtgccagttccacgccaggcaaacccatcagccggcccaggccctgcagaccatacctctttcgtggccgtttgctgtctgggggctcgatatcctgggtccgttcaggcgggccccgggcgggttcgaatatctgtatgtcgctgtcgacaagttcactaagtggcccgaggcttatccggtcgtcaagatcgataagcactccgcgcttaaattcatcaggggcatcactgctcggtttggggtgcctaactgtatcattacggataacggcacccagttcactagtgagctcttcggtgactactgcgaagacatgggcatcaagctctgcttcgcctcccctccccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtcccctcgggtcaccatgtattgcgaggctgatcaagatcagcttcgccgagacgacctcgactatttggaagagcgaaggcggcgcgcggccctccgagccgcgcgctaccagcagagcctgcggcgctaccatcaatgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtgggggtcgggtgtcatgtctcgggctcgggccaaccccgcacccccccgggcgtgcagggttggccgggggctaccacatgcatatacttaccttttttctcttccgtatttcaataaaagcattttcgatttcctgaggactgtgtctgtgccatcgtttccttttgaagaatcttggcttaaattagcacgctcgtgctcgaccctgccctcggtggcccgggccggctaaaatcgccaaacggggcccagaaccgagccgtgccccggggcgtggtgaactccgggggggaatcggcaaatgcccacaatcgggtcatccataaccctcggtcaccacgctcccggcctggccagtctcgacacgaggatctccccaggcactagccccgacccgcgccgtttgaggctgggacctgggcacgagcccttgttcaagccaagacatagaaggaccgcggcacagaccatcctcgtctcatacacacaacaaacagaactgacgcagaaatttcctctttacttgattgcagattaagtcagtctatacaagaagggggcccgaaggcctcggaagaagaaggaaaagttattaagattggcgggggcctgagggctcactccgacgcgcccgggtcgccggcctcgtcgtcgctgtcgtccgcaccatcgtcaccgccctcctcgtcggagtcgagcgcgaacgcgagccgaggggccgtaccctcgaagctgtggacgatgtggtcggcggcgtcccggacctgcgcacgcgcgccgtcctcggtttcgggagggaactcttccagcgctgcccacggagagaagtcagggtccctggcctggtagcttgccagtacgagctccaccgccccccgagcgaggtccctcgaggatgacttgatcgtctcctcgagctcctcggggagccgctcgagggccccggtcatttctgagaggcgctgggcgaggcccccctggttggcggcgtacttcgcgtgccgcccgccccagaggccctcctgccgcccggcgcggtctagacgggagacggcgtcccgaagcatgccgggccctacctcgctcgccaagcgaagggcctcgacctccccggcggacgagtccagcgcgccctgcagctcagcgatggtgtgttcggcggctgcgaggcgggcggctaggtcgccgtggcccgcggccgccccgccgctgtgcgctctcgcgtccagctccttcgcccgcgcctcgagctcagcggcccgctgatccagtgcggccctctcggcacgggcgccttccagattgcggcgcgcctgctcctcccgcgctgcctcgcggagggacaggctgtccgccagccgctgcgccgcggcctcggcctcctcgagagctcgcccccgctcggtgagcgcgtcctcgcggaggcggagtgtggactcctcttcggcgcaggcggcctcgtgcgccgccagtgttgcctcccgagtggcgacggcggcttcgcggtccgccaggtcgcgctccttcgtgtccagcgcgcgggcgtgctcctccagcgccgtggcgcgagcctcaagggcctcttcgcgctgccggaacgccgcctcgttctccgccgcccgccgttcccgggcaacggcggcgt

SEQ ID NO: 58481 - DNA, 21912 bp, Oryza sativa
ggaggagatgggccagcggcccatccgaaagaaaggaggaaaaagagaaaaaaaagaaaaagaaaaagaaaaaggatttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgatcttcaggggtttactcttgctttgcaccggtttttcttagggtcctttataaattcaatttttggcttaggaggggaactacagggtgtgacaaacctaccccccttaaacggaatctcgaccccgagattcggaggagctggcgaagaggtgcgggtgggtagctttcaactcatcttccctttcccaggttgcttcctcttctgaatggtgactccactaaactcggcaaaatctggtgaccttgtttctggttcttctttcactggtgtcaagtatacgaaccggcttctccacatatgtcaaatcctcctggatatcaatgtgttccgaatcagcctgttcttcaggtacccttaagcacttctttaattgggacacatggaacacgtcatggatgccgatcatgttggatggaagttctaactgataagcaacttccccccttcgttccaggatcttgtatggtcccacgaagcgtggtgccaacttgccttttgtctgaaagcggtgtactccccggagcggagtgacgcgaagatacacgtaatctcctgcctcaaaagtgagctcccttcgacggttatctgcgtagctcttctgtcgagactgggcaatcctcaacctttccctgatgattctgactttctcttctgcttccgctaatacctctgttccgaacagttgacgctcgcctgtctgatcccagaagaggggtgtgcggcacttccggccgtataaagcttcaaatggtgccatttgtagactggcttggtagctgttgttgtacgaaaattccgcatatggcaaacatctgtcccaagctccactaaagtcaagagcgcaagctctcaacatgtcttccaaaatttgattgactcgctcggtctgaccatctgtctgcggatggtaggcggtactgaaatttaaacgggtccccaattcttcctgcagtttctgccaaaattttgaggtgaactggctacctcggtcagatactatctttttgggtactccatgtaaacacatgatccttgcgaggtacaattatgccaatttctttcccgtataggtggtatgtactggtataaagtgagccaccttggtgagtcgatccacgactacccagattgaatcgtgacccgatgatgtccggggcagtcctgttataaagtccattccaatttcctcccatttccattccgggatttgaagaggttggagtaagcctgctggcctttgatgctctgccttcactcgctggcaaacatcgcaaagtgcgacgaattcggctatttcccttctcatgctgacccaccaaaatttttctttaaggtcttggtacattttggtgctcctgggtgaatggagtactgggtttgatgagcctcggtgagtatcagatctttcagttccttgtcgtcaggtacacacaatctttctcccatccagattgtgccatgctcatcctcaaggaaatcccgagcctttccgactctcatgttctttttcagctctgctatttcaggatcatttacttgagcggctctaacttgatcgacgagcgtaggccgtgcttccagagcggctacgaacccgtgttcaacaattcccacgttgaggtgctcaaactcctgccgcaattcctcacacatgccctcgatgcatagggcagtgcagtaacttttccggcttaatgcgtctgccactacattggctttgcccaggtgatagtgaatgctcatgtcatagtctttgattagttccaaccatcttcgttgtcggagatttagatccggttgggtgaaaatgtatttcagactcttatgatccgtgtatacctcgcagcggttgccgatcagatagtgcctccagatcttcaaagcatgaaccaccgctgccaattccaagtcatgagttggataattcccttcgtgtggacgtaactgtcgtgaggcatacgcaaccaccctgccctcttgcattaggacacatccaagtccgtggcgggatgcatcgcaatagacttggaagtctttcatctggtcgggcagaatcaaaactggtgcagatactaatttcttcttgagctcctcaaaacttttatcgcactcagctgtccatttaaacttctcatccttcttaagcaactgagtcatgggtcgggcgattctggagaagttttcgatgaatcggcggtaatatcccgcaagtccaagaaaacttcgaatctgcgacacggtcttcggtggggtccatttggtaaccgactccacgttggatgggtcgacggccacaccctgagctgtaataacatgacccagaaatttgacttccgtcaaccagaaatcacacttgctgaacttggcgtataactggtgctccttcaacttctcgagtaccagacggagatgctgctcatgttcttcttcagactttgagtagataagtatatcgtcgatgaataccacaacaaacttgtccagaaactccatgaacactttgttcattagattcatgaagaatgcgggtgcgttggtgagtccgaaagacataaccgtgcactcatataacccgtaccgagtggtgaaggccgtctttgggatatcctcttcccggatccttaactggtgatagcctgatcgcaggtctatcttggagaacaccttagctcccttcagttgatcaaacaaatcatcaatccgcggtaaaggatatttattcttgatcgtgacctcattgagtgcgcggtaatcgacgcacatcctcttcgtcttatcctttttctccacaaaaatgaccggagcaccccaaggcgaagtactcggtcggatgtatcctttctgtagttgctcatcgacctgcttcttgacctctgctagttcgttggccgccatcctgtacggtctcttgtaaattgctgcggttcccggtgctaaatcaatccggaattcaatctctctcttgggtggcatggtagtgaggtcttcaggaaacacttctggatactcacagacgatgggtatatcttccaatttcctcaagcttttctccacggtgtccactgggatttccgtctcgatctgattcaaagagaccccttgctttggtgagtctggtgatttgtacactaccgtttctcccttctcgttggtcaaggtgactgtgcgactcgcacaatcgatggctcccttaaacttggttagccaatccatcccaagaatgacatctaggtctttggattcgagaagaatgaggttggctagaaatggtgatctttgaatttctattgtgatagaagggctgaattgtaccgaagtggaactattccccggggtatgaacccgcatgggtgtgctaagttcctctcttattaacccatgcatcccgacaaacttctttgaaatgaacgaatgcgttgccccagaatcaaaaagtactgttgcagggattgagttaacagggaacgtatccagtacgacctccggtgctgcttgtgcctcctccgcagacgcgtggttgacacgagcctggataaaccttggtccggcacgcctgggcttcgggcatttgtcggcaaagtggccaagctcgccacagttgaaacaggaccccggttttgtgccagtctccttcttggcttgcgcggacggggctggctgtgctggtgccattggtgggcgtggagctgcaccacggttgggctggcctccctggtggttcggactgccgctagcgccctggtggaagttgctagagtggaacgggcggtgctgacggacgatcatggtggtaggtccaccctgctgtccgggagtgaaacgcggtcggtgctgactaccttggttggaccggaactgcgccgcctttctcttcctgtccattttgttgcgctgatcctcctgacggattgccttgtcaaccagcctttcaaaatcagcgtagtccccagatatcagttggttggtcagctcgtcatccaggcctgccataaacttttcctgtttctcggcgtcagtgcggacatcctccggtgcatatcgcgcgaggcgattgaactcatgaaggtactctgtcactgtcctgttgccctgatggagcacccggaattccctcttcttttgcgctacaaccccgtctggcacctgtgccttcctgaaactacggcaaaactccgcccaagtgacttcagcgcctggcgggcgggtggccatgtgattgtcccaccaagctgacgcaggaccctgaagctggtgtgtggcgaaagcgaccttctcctgatcgttgcactgcaggagattcagcttcttctctatggcatggagccagtcattcgcctccatggggttggtggtgctggagaaggtgggtggcctgacgcgtagaaactctagcagcttggattgagggggagggggaccaaactgctggtgctgttgttcggcgtgctgcatcatcctctggtgcatctgctggtgctgctgctgcatctgctgcatcatggctgccatcatctgagtctgatgtgccataacttgggccagtgtcggattctcgggaaggggtggcggaccattgccggaatcgctgttggggtgcacaccatcagcgcgttcttcgccattgctgccctcgcctgccgtgcggttgccagtcctggtgtagaccatctggagggagagcagacggggaaacggagaaaaacagatactcaggaactaagctttattatatagaaattaaactgcaactgttctgatctgaattaaaacactttaaacagcaagcaaaaatccttattgggacagccatatcataggcacatgatatcgaccgtcgactgaccccaaacaagcaacctaaacacggaaactaacaagcagaaactagacaatcgataaactaatgggaaaacgagcctaatgctcggaacggctcctgcggtcggtggagtcgaaggcgtcctcctgctcgtcaccaggtccctctgagcgactcctggaacctggcagataagtccctccgctgccggactgtgagccactggagctgctgccactgggagtagcagacaaccaacctccagtaccactgcctggacccctggcggctgatgctggagcgaaggagagagcggacgcgggagctggagctggagctggagctgcaggaactgcgggcggaactggaggtgctgcgggagctgcgggcggaggtgggttcctgggcgcgagctggatgcgcacgggtgcagtcgtcctcttgcggggcgtagtgcggatccggactcctcctggcgcgggaagacccttcaactgagcattctccctcttcaggcgcgctatctcgtccttcagagcgacgatcctcatgagcttcccatcattcaaggccttggtcgccttgtgcaggtccgagtgcatcctatccaatcccctcatcacagcacacatgtgaccgaaggtggtgtcgttctcgccagctgtcggacggaacgaactgacatcgtcgccgtgggctcgacgagggtggaagcggtacgccgtgtcgtggaagatgtagttgtggcgctcccggagtctggccatcatcaggtaggctgcctcctgacatgcgtggtctgctgtgcctcctgacgcctcaaccaccatgttagcaaggcaagtccccacgtagccatggacctccaagcggacacggtgaggaagctcgccactgagcggtggaatcgtcgtgtactccggcgcgttggggtagcctaccaccagtgtcatgcgtgccaactctgccacgaagtcaatcatgccctctccatggtggttgggtgggtgaccggccatctaaagaagacaaaggagtaggatcaatgcatgctcaaatccaaatttaaataaagcaataaaggactcaaataagagaatcgaataagagcaaaattttatgcataaatcattttgcatgagagcgaataaataagacggacttacatagaggtaaaataatggggaatttagatacatacttgtaattacaaataaagcataaataccttgcaacccatgttcctgagctaggacctaatacatttcacccatcaaatcccaactgactgacgaataaatcttaaaaaaatttttactaaaaccctagactgactcgttttggcaaatcccatttaaacgggcgacaagatttttcccttgaaccacaagagcagatcccaaattttcccggaataaaatccaattgcaaagaacttatgcaaatgaaaaggattcagagggctcttaggtttccatttggcttgtcctacggtcaaggtcggctctgataccaacttgtcacgcccagaaattcccgaataggattccaagcagaatgtgcattaaaacccccgtccaggaccggccggggtacacaaacgacaatgttgacatacagatccacgtcttacaaacattataaaagtcttacataaatgcagcggaaaacaaaagataactgaggctaagcctggacttgactgcagcgggaacaccactccacaggcatcctcgacggcacggacgaagcctactcctcggagaacccgccatttgacacaaactcaaactctgggattggggagaaatagagcaagacagtactacccactgtactcagcaagtcataccagaatgggggtatgatgcagggattcaacaaggaacagctaaacaggttcatttgcataaatactggcatttataaacaagggttgaatgcgaaaacagttgtaaaattaagcagtattattcatccactgtccaacgccacacctcgttgcaacaggcccaaccatccacctaaactatccaaattcattagactaaactaaggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgatagaggccgtcgcagggcccgccccgctccatcacgcccacccttgcctggatgcgtcagctagagaaaagctacactacaagcccagccgttgcccacgctgacttgtggtaagtacgatacgttcttccagggtttcccgcgaaccggtccttaattgccatgggcgtgactagcaaaaccatgcacccacagcccaccatgattattcattttatttaaccaacaccagagcggtggtaccgatccaacattaacctataaacctatagtctaggttttaaaagagatctccccattgtgtgctagttgaactaagcatggctaagcaattcctagtccaaagtctaatcatgttataacccaagctaacaaaggagcatggtatccaaaaacatggctgtaacaataggtaaccatcccatagtataattgcaaaacaaatgcagtatttgaaagaaaacattaggatatttgcaatataggatcaacatgatcaagtgacaagcatgacttgccttgctctgctgctggaggaacctcggcgactatctcgaagtacaccggagcgtcggaggaatcggaatctagcgacatacaaagcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttttactaataaagaaaaagtccttaattaattattgcgcaatatattccagggctgacgccagcacggggtggcgcggcgccgacaagcggggcccaccggtcagcggcacggggagagagaggggaagggcgctggtacacgggcccactcggcagcggctcaagggggggcacggctggcaagcgggccccacggctccggctccacgagccgatgtaccggccaggcccggcatcaagccggccgggcggccatggcaaggcggcggcgcgggcatgcgaccgccagcgacggcgagcggcggcgcgggcggcgggcggcggcgcgagcggcgacgaccgaaagcgacggcgagcgcgcgaagagggcggcggcgcacggggaaaaaaaaagaaggaaaggaaggggagggagacctcaccggaggggcggcaatggccggcggagaaaaacgagggaggcggcgaagaccggcgatgccgaggtgcggacgagcgacggcgacacctagggaaatagaggagaggaattagggcggaggaaaacccccacggcgaccatccacgccggccggagtcggaggggagagagaactcaccgacgacgcgagggaaatggggtttcggtggtattccggcgacgtagagcagcggccgggaaaggtcttgcggcggcgaagctagtggtggcggtggcttagtgcggcggcggctctagcgacggcggcacacggccggagtgcggcgacgggcggcggcgtaagtggcggcggtgcgagctcggtagggggcacgggatggagcggtgagagcggaaaacgagagaggagggcatggggagcattttataggcggagggggaggcggacgtggccgggaggcgctccgatttcgccggcgacgtgggggaggagagagagaaggtggggggggattcaaaatcgaatcccgcccctctcgtgcgctggcgcggccgggagacgcggggagagggcggcgacgtggcatgggcgcggcgacgtggcgtgggcgcggggaaagcggaggaagtgggtgcggcggcggcggtttcggcggggcggcgcgagcgggagaggcgggaggtgggagacgggtccgacaggtgggccccacctgtcggcgaccccgggagggagggaggcgggcggccggctgggcctcggcctgcggccggcccagcagggaggagggggaggaaaggaggagatgggccagcggcccatccgaaagaaaggaggaaaaagagaaaaaaaagaaaaagaaaaagaaaaaggatttttttcctggaattaaaattgcactttggtgatttttaattggttaaaattatttctagggctctgaaaattccactaaaaatcctgttagtgagtttcgacatgtagaactcaagaaaaattccacatgccaaatccgattattatttgcattgatcttcaggggtttactcttgctttgcaccggtttttcttagggtcctttataaattcaatttttggcttaggaggggaactacagggtgtgacagggtcccagtcccatttgcgcccctggtgggtcctcatgtagtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgtcgcccgccagctggagccctgcgccgggggctggctcggaagtcggaggcgcgcttcgtcggcgaggggggtgtagaaccaatcgctcttccagtcgtcccactttttgcggaggacgcagggaatgtagcggttcagcacctgcccccgcggctggaagtagcagccaccgactaccgtcggcggcgacaccggctgtacggtgaagaaccaccggaacagccggagagatgggcgcaccccgataaacatctcgcacaggtgtgcgaagatggccaacgtcattatcgcgttgggcgtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctctcggccggtggcagattccggcatgaatcggtgcggcagcccggcctgcctctcgctcacgatgcgggaaggcggcagcacgctaccatcgagcggtgcggagccccgtgccatgacgctggcggaggaggagcttgagaacaagcgagtgcggcgagggtagggcacaggaaacgaagagttagagcacaagtggcgaaggcaagggaagagtggcgagaggaaagaaacgaatcccttcctcagcgtctttacacccttgccaacgctatgcccggctcctcgcttcccgcgcccactacctcgccccctcgtttctcgcgcccacgcctccactaaccccactcgcccgtttgcggcgcacgcggcagatgtgcggccgtggcggttgagatggggcagatcgtgcgcgcgttaactacgcttgccaaccgtgaaaagcgccatcatcatgtctccaggcgaaatgaaccggctcgtcccgattcgcgcgctgctcgagtaatgtagcggtcttaaagaggccgctcattactgtcgatcggttttcccttgccgatgcgcgcgatttgcgaccgctgagtttctgcccgcctgtagggaccggccccacctgtcacgggcctaaggagtggcgtcacgcccgagcgcttccctcgaggggggcgatcaccctggcgtaacgccaggggctactgtcggtgacatggggccgggggtatcgtgactagaggcttgggtagccgcggtcacccacgtggcctgaccccctcgggggggtcgggcccgaggatgacgtggccacccctccctctgtctccccgaggggtcggaccgctcccgtttcggccccgagggctggggcgcccctgtttcggccccgagggctggggcgccccgaccccctgtggttttggcgccacgcgtgtgggttaggtgagcacagcggggctcacctaaccgcatttatagcaggattggacgagcgcgccacgccgcatttaatgcggtgcagcgcacgcttatccggtccgcgactggtcggggtgtgtgaccggtcacagaccggtcagatcacgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctagaaaaaaagagggagaagagaggaggggaggggggactctggcgaatggtttctagagcctgaactctctttcgctctcggcctctttgtattccttcacgcacagatccaccagaacacaggagtagggtgttacgcttctcagcggcccgaacctgtctacgtcgcccgtgtcttgcgcatttcctctctcgctgacgttcctcagatcgagggcgaagaaactcacttagcacccccggccgaaccggcaaaggggggcctgcgcggtctcccggtgaggagccccaccctccgtcaggtgtatacttcacatctgttcccgattaaatagtgcctccagatcttaagagcatgaaccacggctgccaactcgagatcatgggtgagatagttgacttcatgaggcctgagctgcctggatgcgtaggccacaacctttcgttcttgcattaggacacatcctaagccttgtcttgatgcatcacagaagatctcaaaatcttttcggatatctggcaaggtgagaactggggcagtggtcaacctattcttcatttcttgaaagccgtcttcacaggctgctgaccattcaaatttcttttccttcattaacagctcagtcatatgtctggctagcttagagaatccctcaatgaatcttcgataatatccagctaagccaaggaagctgcggatctctgacacattcttgggcgggttccaagcaagtacagcttcaaccttgctgggatctacttcgacaccgttggaggagatcacgtgtcccagaaatgctactcggtccaaccagaattcgcatttcgagaacttagcgaatagttgatgatccttgagctttcccattatcagcctcaggtgttcagcatgttcttcctcattcttggagtatatcaggatgtcatcgatgaataccacgacaaactggtctaggtattccatgaagattttgttcattaagttcatgaagaacgctggagcattggtgagtccgaaggacatcactgtgaactcatatagaccataacgtgttgagaaagcggtcttcgggatatcttcatatctgatttttaatttgtggtaacctgatctcaagtcaattttagagaaaactcttgctcctttaagttgatcgaacaaatcgtcaattcgtggcaacgggtacttgttctttatagttacttcattcagggctctatagtcgattaccattctctcagagccatcttttttcttaaccaggagcactggggctccccaaggggatgagctaggtcgcacataacctttactctccaattcttcgatttgtcttttgacttctgctaactcattagctgccattcggtagggtctttttgcaattggtgcggtgcctggtgccagttctatggcgaactcaatctctcggtctggtggcatactcgctaattcttctggaaatacgtcgggataatcgcagactatgggcaccgactccaaggaggtgacttgtaaacaggttaggatagaccgacttgcggtaggggtgttagaggtaaagcggacttgctttcctccaggtccttgcaaggtgatggacctttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattccttccaggggaatgtactatcattggtacacgtaaattttgggttttccaaccatttcttttcacaaaagcttgtgatatgaaagaatggaaagctcctgaatcgaacagaactattgcgggtacggagttgacagagaacatacccatcacaacgtctggagcatcctgagcggtctcggcttgaatgtggttcacccggcctcgaccaaagttgttggaagcacgagaaccttgtccacttgcctgagagctaggacgagactgagctgccgctagagtaggagttctggcagtgctaccattagcatgccctgagttggtgttggtaggattctgagggcactgtctggcatagtgacccatctggttgcaccagaaacactgaactgctgatagtcctagcggtgacttgaaagaggtaacactgtttggcgcagtgttgccacttggggcatgctgctgtggctgaggtgccggacggttcatctaaggacgaggggcgtagcctggctggcggttagcctgagtgaccaattggtgatattgcatgggttgaccatagcgagggcgtggtgcgcctcgggaagaattcccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcccttcaagaacttcctgatcttcttcttgtctgtgtccacttcctcaggggcataccgagccaacttgttgaactgacttaggtactcattgacactgttgttgccttgcttaagcctgttaaattcctctttcttcatatcaatggtgctttcaggcacatgagctgcacggaaagccgtagcaaactcatcacaagcaatgttagtgggttcagggtgtgcattgtagtaattctcccaccaatctgcagcaggtcctcttagctggtgagaggcgtagagcgtcttctcaacaggagtacactgcactaagttgagttttctatcaacatccttcagccaatcgtcagcctcaacgggctcgacggtctgagagaactctggcggtcgagacctcaggaagtctgtcagtttggatctattgttgcccatgtgagggtggccatttccatacgcattatgctgaaagccggctatggccgcggctaatccttgcaagatctgtgtctgaactgccatcaagtgttgcatgttgttttccacatgaggcggggaagggatgcgttcctctccagaattgtgaccggcagcgtggtgagagcggtgagactgttccatctctgcattacgggaagctgtgtgatgcgagcggttgctgcggcggggttgctcaacttctgcattgcgggaagcagtacggtgcgaacggttgctgtggtgagattgctcattagctgactcatgatttgctcctggctcaactctaccttcctcaaaaccaaagcgggctggtgcacgagcagcacggcgggggcggctagccatctaaactcccaggagagggcgaggtaagaatcagataagcacttaggagggcaaggagcaaagtaaataacaactcagatagcacgcactaggcataaactggatttttcaaatcataaaaacacctgatacaacgggtgtggacaagtcacagagctacgccgagcttgactgtacgcacaccacctaggagaaccagactaccaaacaacacccacatcaaacgcacgcatgcactacctcgccatgactccaaaggagttggcggtggaacaaaagggcctaacacacggacggctgctgaagactgcctcctctactcctcgtctgcctggctgcctcctgtagtcggctcctcagtcgaagaaacgtcgatcggctgacgcgaagggaccagcggaacctgtcgagagccgtcagcagcacgggccgctggcggtgggggagctgggtagtcgaagcggaacacggtggaagaaccaacaacacgcttccgcgcagtgcggataaagcgtgggccacggcgggaggaagcaacgggagtgtgtccgggggtgtaggaggggctaactgggtgtgggtagggggagtacactggtgagtacggcgcacgcaagctgggggagcgcgggccactgggagtgcgggcagagccgcgagagctgtgggaggataggtggctggcgtggcagaggcggcctgagtcccaagagacagtgtcaactgaggtgactccctcctcggccagacgggcctccagagcggcgtagcggcgggcaagggagcggtaagcctcgaggagtaggtcgtgctgagtggcctgagcctccgaaagctcaaccatgcgagtcagcactagccgagactcgttgtacggacaagggtacctggcgtctgcgtggctagaaggaaggcgtggaagctgccggaaggcagagcccccgagacggtggctgtagtcgtgggcgaagcgacgaagcgcagtccaggagaggtcctggtacgcgatctggagagtgggcctagccacagtgaagtggtgtgggcgaagaccagctccgtgtatacctccacgagggtaaaggtacacagagagctcacagcgagggggaacatggtccacggagtaccccgtgtactcgggacacgaaaagccaaggaagcgggcgaggtcacgaagctgagcgacgtggtgaccctcaccaaaaccgtgggaactgaagctggcgttcactaccatctacaattttgaaagagggagaaaagatcagtaaccattttagcaacaaactattgaaaataaagaaaccaaaaaaaaaagccttagcttttcgcaagtagttttgaacttagtatccttagggtcgtcctaaacgtcgggtttcgccctagggccaagcctgggctctgataccatctcttgtcacgccccgaactagccccgagcgggactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaagacttggaccatacatcacaggcgcgacttaggaactaggctgaaaccctaaaactcatcgtagccggcttgctcctggaagaactcctcgtcagcgggatccgcttcatcttcttcagcaactggggggggattatttatatagggcaaggatgagtacagaagtactcagcaagccatgggaaataagtgtttaatgcaggcttcaaggaaaggctgttgtttttgcaattgattttatttaaactcttttctgaaacaactaagtgagatcttctcaaacgacacggatgagacagtgcgtctcgcccggtcggagtatgtgcaaggtatcagtcttttgaattggtcaaggttggcacccggccaacgacttttaaacggccacccgggcctggctgatcccatcagccgcaggttttccaaacatcgaacccaaaccacatcagcaaatttcacaaagcagtagtcaaacaaaactacgctaggaatcacctcacatccgcccatgaccgtgggcacggctgttcgaacagtttaataacctctgcagaggggggtacactttacccacacgatattactaacccggatcatccagcccgtgcagaacggccacgactagagaccttaaggctttcacgacaaggcatttcgaaagccgacacaggttcaccatatgccaacgagagggatcccagaccatactgtgccaggaaacccgggggtcctccccgacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcggggaaccgtacacccggtacgttccccggtccgcgaatttggaaattcatttaggttcgcaagcaccgacccaggtgtcgggttttccaagtgttttgtaaaacccaagttttacccaagatgtttctcagattttaagtttgaaggcgaccgtcgatattcgtgcagagtgcacgattaccgaggcgcaactaggtggttacaagggaacatggtataataattacaatggaggggtcaactgcaacaagttaggtaggtccgccaatctgccttgcagacgagacatgtagattaagtgcaatcctatcaatgcataatatttttcaagcaacatacttaagttcaaatataggctcaagatgttcaaaggtggcttgccttgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttagaagttgaacggagtcaaacggacttacggttgagaagatattgaatttataagattattggatttttggtctaaaggaaaaggatttatttaaatcctttttggaaaagaaaagaaaagaaaagaagaagggagggaaattatactttcctcgggcggctagggcgcggcccgagagaaaggggcggctcggccgagcttaatgggccggccggcccaagaaggcggcccaaagcgcgcgcgcgggcggggaggagagagagagagccggtgggccgggtccatcccgcgtggtcccgggtgggacccgcttgtcggcgactcggctcaccgtgagcgaggtgcacgcggggcgtgctagggtttggggaggggaggcgcggcgcatgcgcgcggttcgaggaggacgcggatacggcgggcccacgcgcagcctcatggctcaccgcggaccatgcgcacggggggaacggagggagcagctggccgggtcagctcgacccggtcttagccgagctggcgccgacgtggcgcctatgtggctgccacgcggaccggcgggaggttgaagaagacgccggccggaacggacggcggacggtggctgcgaacggcggggcgaaccacggcgatacaggcgaaagcgagcacaccggaaggttgcacgggatgaggggagacgagccaacggctcggatttgccgggggatgcttgacggcggcggattgtggtagcggtaaccggcggagagagaagggggaaacggtgacggcgcgacgggagaccgattcgggcgagctagagcatctacgcgactccgggagtctgttgctagcgtcggatatggcggagctacgccgagcgaggccggcgacgaacgggtgctacggagcacgggcggcgacggcggcgagcacacggcgagcggcagcaacggtcggggcggcgctagctagctacggggaggctactcgtgctactacccgagtctaaggggaggagatggaacgaggagggagaacggagggaggcactaccgtgcgggggtgatggggcgcagtgaccagaggccgacggcacgggagtgatctctccgggcccaggccggggaagaggaagaagaccagcgcccggagtccccttccgcgtcctaacgcgcaccggctcctccggcacacgcaacggcgccggtcggcgagaggacgccaatggcgtgggtgaaaaacggggaagattgggaggggaaaaaagaaagggagggcgcctgggtttatatttcggcaatgtcggtttggaaaccgaccttgggcggtcaagggagcgagccagtgctcggcagtcgcggcccaaacggcaaccgggggggggggaggatgacgccggcgggagggaaaagggaaaagggaaaaggggggtggagagaaagggggttgcccccttgccactttgggggaaaaggaagagggagagacgccgatgcggcagagggggggaagctctgcctccgtcccttggaagcacgcgcgaggagaggcggggccaagtcgatgacgacggcgatgacggccgggcggtttggagcggagcaacggcacgggcggcaggcgcgggcaggcgctgacggcggcggcgactggccggtcggccaccatggcgcgcgcgcgcgcgggaagcaacgggcggcgcggcgatttgggcggcgtcgacaggaaacggcagcgagggcgaagggcgctcgactcggcgcggctcacgcgcacgcgggcgcagcgcacgggcagagcagggggagagggagagagagagagagagagggatggggagggagagggagatgggccgagaggaattcggcccatcgaacctgagggaggcgaaatagacttttgcggagggatttgatttgggaaggatttggattcgggattgaacttgacgatcgatcggggatttgagatccggaattggcacggacactagacaataagcaaggaaacagatttcgaaattagggtttttaggaattacattttcccgctaggcgccacgacggaacgggcgctacagctagatgtgttgccaccacccccccccccccctaaacatgccgcataagattggatgatgaggtggaagaaataagtgaggaaatagaaaatgaggcacccgtcatgtaacctccacacaaacctaaaaaaaagatgaaagaaagagtggatatggcatacaaataaaataaaatcatttgggttagtatgctagaggtagtgtaggtgtgatgtattgtatatatcacctctgatcttacatggataaaattagatgtggcaaccactcctattacaaaacttgctctaactattatatgaattggctattaaattgactatagatgatttggagccaatagctggctataccattaaacttgctctgagcagactgatgtctctgctatcgctggcaatggcaatgtctctgcatacaccttgaatgattgtagggatagcacagcaatcccctgtttagaacataataaaatcgtaggatcttatagccgtttcacaaattcaatttcggttggaatagggagaattttctactacgtttaaaatggggccctaactaggagttcatgttagcagacatatggatttgagaatctgtcattacgttttacagaaggcgccaacaattgagtcgactgcattcctgtatgttgctcggctgattgcgtcgtcctcccagaattcctgcgacctgcacgttactctcctgcaccccaaccaacgtgctgaccgctgcggttactccaacacaaatcttggtcatttaaactagtataaaatcttctgtccccaaaaaatcttcgaactgatttctcctgggttctccacttctccgtgccttccttgggcaaaccaaattcgtcaagtggctgtagttaacatgacgcctttcgtccaaaaaactcatgtgaatagttgtattctaagcaagcttatctcgtatcgttctgcaatcaacatatctcagttgcatgctattacctgtttgaaatagctccaagtccaagatttcttcgaatgagctattcttagctccataaatctaaatccacaattatattaataacatttagataaactattttgttcctaatttgacttataaacttcagatttaacatggtggatattaaatccagggatgtgctttatatatttgaaccacccagattgatccgggcgggtaagagatcaggatagctgaccagacggccaagtgcatggacacgcaagttttggcatgccaatttttggtaaggccaacatgtgtttggattgaagccaaattaaactaatttagctattgaaatggcctatgttatataggcatgccaaaatttggcttcaatccaaacatacacaattattgttgaggttgccaaaaaattggcaagcctaatttaggcctcaaaccaaactggcccgtaccgctcgaattgtgacaaaaatgtaatacacagataacacacagaatatgtgtatgcacataacaaaaacttgttcaaaccattctaatgttaacgaagcatgagatatttcttttctctgctttcaattccaccaccgatgatctgatgatcaacataattcacagttgctcaccgtgaccaactcttcacacagtgacttctttcttggatgttat

SEQ ID NO: 58482 - DNA, 12283 bp, Oryza sativa
tcttttatgcctctacaatacaaagagagtaacaacattatgaatgctttaacaattaatatttcacttgaaccactatcaaagcacaacatgaagtggaagggcacaagtgcagttacatctcaacactgatcaatagcacagatgcttgtaatttggtcagaaatatcaagcatgtatttatcttatcctgactctaatcctcacctcaattgaggtgataaaacccaagtaactatgttggtacgatatactagcacaaaaacaggttcccactttcaatattatattcccttccatttaagcaacagtaatacacaaaaggctgtgaaatacaccttaattcagagctctggtcctagcatttaccaacagtcatcccatagtaactagaggctagggatgtaaaacattttcactatctaaaaaaagtaactataactataaaatgcataataaaggaaatactggtgttagtaaaacagtgaacatatgtatagggagaaaatagcccatccatctggatgcttgcctcaagggactatctgttatatttctcttgtgaatgttgtactgaaaaacaccaatcatttaattgcttaaagatgatagcttgatgcaaatttattttccattcatattggttctacatggtacatgctcatcaaatgatttgaagagcaaggataggataagaaacaatcttcagcttactatatcttactcatatattcttgtatgaggaccctccatcttcttctttttttctcacttcatttttttaatagttaagattaattagtatgtataccagtgagaattctaatagtctagttccttggaattcgatgtcagataaacatagctcgtgatctcttaatgaaatgaccgtcaggtaacttaactactattggccataatgttcgtgtagaagtatctaagtacattcttttaggaatgtgacaccatagcactccctatagagtctagatcaccacaacgaaggcatgccaagaaaagggtcagcgcttccactttcggagatcatgagagttacacaagaatctgcaagaaaaagcagaccgaaaggaatctaactttatcctccatctgaaatgttctacaccatgttggggttcctaagcttttcctagatcctactggttaatcatactccactttgcccttacctctcacatcacactctatccttcatatccctacctaaataaagcaaaaacaaggaacatttcgtactaaaagatccatccagttacagtagccaaatattttcattcgagtttgtgcatagtattagcagattaaatcatcagaagtgaagtgtggaattagcagcagctgagagatattacctgtttcccctgatcttgaaccaggtctcggcgcactgcttatgggcgcaggagaggtcgtccttgcaggagcagccgaggaacatgccggagccggactcggcggcggcgctctcgaggccgaggtggcagatgcggcaattcctctcggccgtgtccgggctggccttgctgatctcggccagcccggcctcgaggtccacgtcgcccagcgagcactccgacacgcacgacttcctcctgccgccgccgtccgcgtccgcgtccccggcgccggagcggacggacgcgcacgtcgagatgaagtcctcgagggcaacggagccctggcgcgagtgcgaccgccatgagtggtcctccgcgtcggagaagcgctggctccccttatcctcatccgagctctcctccgcaagcccgcctcctcctcctccgccgccgccgacgtggcgggccggctccgcgctagaatccgcggcggcggcgggagcgatcgtcaacgcctgctcgccgtcgttcaccattgctcacgccaaacaaacctaccaaaaaaaaaaagcaattcgagaaaaaaaggaaaagaatcactcgaaattgcttctataccaaatccggacaagagcagagaagggagcaagcaaacaagaatcgccgaaagcgagcactaaatactcactcttgcagttacaggttactccaaagctgacggtgtgccaccacgcaagcaatgcggccgatcactgggagcaaccacccaagaaaaatccaagctgccagtagattctaagctctaaaaaaataacgaattgaaaatatactgctaccgacgaggcatcaggtgcctaaaaaagattggattttaaagctgtttcttgatccacagtggcgcagagagagaagcgagaaagcgaggaagagtcgcgtagctgggaagaatcgattgaacaaggagtaggcgaaagagagaaggggaaaaaagaaaagagaaaacttgcggagttgtggtgctttgtcggggacgaaggggaagagaagaggagaagaaatgaagcatatgagacggtctcttgggtcagcaatgaagtagagaagaccgtgtcatgtgatgggagagaagaaattgaccatccacgagtttttgcttcacgaaaaatctcgtgttggtgtacacagcccccgcgccaactgtgaatttgatcccgttcgacacctgttttgcctagaatttttatggttgacaacgctatcaccttttaatcttactctaatcattaagcagagttaacgtaaagctctacgtggataccaccgaaggccatattttagggaaacgaataccatcttttcatttatacttatacttaggaccaaaatttaaattttcactcaaatttaaagttgatttttgaaattttttcactaaaatttatttttctgcctttatttttagatcgctaagagtacgtatataaaacttttatttataaattatttttcggttgtaaatataccgtttcatttatttctcgaataagccaaataaggaggccggcctttcactcactcaactttacctgaatctagtcgcaaatcttttttattttttgagaatctagtcacaaatcattggtcgatggcgcccgtcacctggattcgaaacggagctttcagtgaagcagcagctaattaaccggtggcacttgggcaccgccaccttccgtcttcagaagttgagatatacacaacgagatatttctgtcgcggcgccgcccgaatcctcctcttttcgccgcccgcactatgcttttcagctctcctcagtcctcacagtgattcacagcgctcgccatcacactctcgtgcatctcgccgccgatcagatgcactggatatgggcaccgccgatatcctcggctatccctcctgtatatttatccatctttcgcgtgattccaacagcaaaaaaagattctgaatgctgggagtagctaggagaaagaaaaattgtcctctgtttattttctagcggcggacggtgtgtacgaaccatctataaatcgacctagcacaaaataagataacctctatttaaatatattgtagtaggttatatggcatcacaatctaagttaattttatttaggacatatatatttattatagtagattatatcacatcataatctaagttgatttattttaggacagagagtaagatagatacactgcttgatgtttgaccgatgatcaactgtacctacctaaaagacgcgaatactaaggaatgacctaatatcaaataattagaaaaggtgaggcttcgaactcaaatcgtctagcccaccaccatatgaagctagccagaagagtcctggaagtttcatgatggtcaactgtacctatcaaaatagggaaggaactgtgcgtgcaaacaggcttacatccgggcatgtttagatcacgaaatgaaaatttttgggtgtcacatcggacgtttgaccggatgtcgaaaagggttttcggacacgaatgaaaaaactaatttcataactcgcatggaaaccgcgagacgaatcttttaagcttaattaatccgccattagcacatgtgggttactgtagcacttatggctaatcatagacttatggctaatcatagactaattaaaagtatctatagggttttagctgtccaaagattcgatatgatattttttgaaaaaaaaaattagaactaaacagggcctcaggagtctatctacagccgacagctgactactagctgggtaggagtagtgccgatggtgagacaaaaatagtttcggcgatctttgttggtttctggtggagaacaaagtcgtctccggtttggatccatctatctatctattatattattaaaggaatagaaaaaagagcctccacgttcgctctcatggtctagaaattctcacattaatcggagaaaaagaaaaaacagagtccatatagaaatacaatttagaaatagctaaaattcggaattaaaaaataagaaatattagaagaggagactagagtccatatagaaatacaatttagaaatagtgaaaattcgaaattaaaaaataagaaatattagaagaggagactagagtccatatagaaatacaattaggaaataactgaaattcggaattaaaaacaaggaatattagaagtagagtatagagtccatatagaaatacaattatgaaataatagaaattaggaattaaaaataagaaatattagaagtagattatagagtccatatagaaatacaattaagaaaaaaaatagaaattcggaattaaaaaataaggaatattagaagtagagtgtagagtccatatagaaatttaaaactaaaattaaaagtagagttttgagtccgtataaaaatacaatttacaaataactaaaattcaaaattaagaaaaacatgggaagaagagtttaaagtcaatataggaatacaatttagaagtaactgaaattcgaaattaaaaatttaagaatattgagagatgagtttagagtccacatataaatacaattagaaataataaaaattcagaaatcaaaataaataatattggaagaagagtatagagtctatatagaaatacaatttacagaaaattcggaattaaaaatattaaaatttggaattaaaaaaaatattaaaaaacgagtctagagtacatacaggaatatatataatttacaaataactaaaatttgatattaaaaataattaataactaacacgtatataaaatacagtgtgaatattacacatttgtagtttcgtaaagttattgcaaaatttaaaattatgatgtcattttaatatatttgaataatataataagaaaacatatatgctattatacgagagaaaatataatgatgctagccgcgtaatctgcgcgggccaccatacaccatactagtttattattaagcttacaaaaccatccttatatgggacagaacaaagaacaaaggagaggaactgaactgacacactgcaagattcgtgttatcaaaaggctggaactggaagtgccttcggccatgcgcagcaccacaagtccacaattcaacccaactatacatatcgcaacttaacagcagaagattctacgagcaagatcagccaaaaccctatagacacttctgttggagaaaaatcagtacacgattagcaaatcatcactcgtagcaaaaaccagaacaatccaactggattgaagatgatgggcactgacaccgagtgaagaatgaagccccacgatcgcccaaaaatccaataaattatacttgctgatgctacctctgaactaacacatgcaaggagtgcaggaatccagggagatctaaaccatctcggctgggaaggtaaaatactaatccaactacccagcaaaaccatgaaaccagtctaagcagcaccctgtatccatttcctgatgaattgtgcagaaattttcgatgcacccagttatttccaaatcacatccatagccggtcccatgaaatacagaatctttatatcagcatgacaggatgcatatcctataatttgagacaggtcccccgggcctaccagtcgatgacaaagcaacaggctgcttcagctttcatcttccaaaagattgtatagcctgtacacacatcgatatttctcaccggttaaagcgaagatgggcatgataagggattaggtgcaaattctcccacagtcccactctggcatcaacaaagcaacagacaagtagaccataatccatgcagtatactacataaattaggctttgcaattttgcatggtctatctctctgaaactaccctttagtgtctaaatattgcctatggaacctcaagaaaacaaaagagttatttcgtccagcaaattcgtagtaaatccacagaaattacaggcaagaacacctgaggagcctgtacaatctgatctttatctgcctttgtaaactagatgtgtctagatcacctgaggagcctgtacaatctgatctttatctgcctttgtaaactagatgtgtctagatcaagagtgtggcatataaagttacagcaacatcataaatacaaataacagtggggcaggtccacaaaacgaaaggatttacaacccaggtcatatcatggatgtatttgcaaatatatcataatcatactaatgaaaatttcttgaacaacaagagatataattaacaataaaaaatgaaactatttgtcatccctcaaaaggaaagcgagcagtggtaactggtaagtagatggactaatggactactagaaggaagacgggagatgatcgcagaagatagatcaaaccttggcaattctggcagtgttcaatattttaactcctcatgaatgtgccagcattcatcttcccagagatatgaattggtcactgataaaaaaaaaagtaacagcacaagacctcagcaattatggaagacattgaacagactagggcaatacctggtcccaaatgaaaatttgaaaggaaaaaaagcgggatagtaaatgctggtctctatcctaataagtgcaaagcagaatgtacaaacccatgaaagcaagcctgaccagctttgtgtctattgtgatattgtgattgtactatcttctagtcaattatcacagttcacaaatcgataaccaaaaacatactcatctataacttcgtataactgataactgcatagaggaaaaagcatataacctgatagtcctccgcaattcaaacgcagtaacacttgacgaaacctgatctttaagaaacatggataactggtgaaccactagaggcatgaaactacaatttcagctacaccattattttggttttgtatacttccaagaaaaggaaagaccactcattttaagcaaagcgaaagatagaacactacatcatttctaaagcactactgcaaataaataaataaataaatatatgatagcaggtagtagataataaacgaattttaagtgaagatacttattccatttcaattatataatagtctggtgatgcatggttaaaagctctcgggaaaagggaggaaatcctacttgttctcacagacaggaaaggaattaaccctcaattttgcgcagcatatttacgacttaccattatagtattagatgctattatcagcattgaactcaaatatatgaatcacccctaaatcatgaaaaccaccatcattaagaaaccctgattcgaaattagcttgagaaaagttgagtcttcatagtacactaaaccgaatcgcataattacactaaacggtttattctgcctaaggaatagtcatgcatatgcaacaaaatgtaacaaaattaaatctcaactttcaaggatcatagttggaaataaacatttgcgcaaatccaagagagtaacctaatgtttcttttttcaaattttaattctctgcacttaatcggttgtcatcacaattttgtatgatagcactgttctattgctaatgtattttaatttatcagttgactttatttatgccagacatagcacatagacagatcccacatgttccctagtaaacaaaaattctcatatattagattattccattatcagaagatcttgattcctgatgttattaaaaaaaactgtggcacaagtcaataactataacatcaaataatactaatttcatgagtcattaaaaggggggagagagagagtcattatttgacaattaatatttaacaacaaatgacaattataatattcacttctcatagctgagggcttgttctatttataaaatttagtattcagacatggaactaaaaatatcattaaattacgatcaggattgcctagtaagtttttctaaaattccatttttgaggtaggcttgtcccaatgcctaagcagaacctccatgcttcacctagttgggtactgagcacctgaaataaaatatggtaagaactgcaagtactacatgcatgtccatctaccaaaaatacaacaataaccatgatttgacttgattacaccttaatatataaaaattgactccaaaagtttcatctcactaatttacattatcctaatctgttaagctggtggaacagaccgcgctaaggtgtcactgctttgcaaaccacttttcatccaggcaatgctgctaatttctgacaccaacgaagcaaaactactatctgaaattggtggatgatcttcaaactcattaaactcgggacccagcaatgagttcttacgaagttgcccatgagaactgcagcagccatgcccacatttatttggcacctcagcagcaaaacttgtaggatcaacaaacttgcagaccccattttcaggcttgaaaggatgaaggtttgagtcaaacttggtggcaaagctcagcatttccttttgtgatgattgagcaggtcctacattgtatggtttgaatgcaccaacctttgcaactggtcgggcaagataaggtggatcaacaacttcagttttgcaactctgatccccgatttgccatgccccaacataactttcagatactgtttgtgcgggagcttccattgcttccctaacatttaaggaactaagattgcccaatggccaaggttcttctgaaaccgacctaggcctctccggaatagctctcttcataacaccaccttgtgtgcatcggccaccagtgcagtgccgacgcctcagggtagagttccagtgattcttgattgcattatcggttctcccaaccaaaagctttgcaatagccgcccacttgtttccatggattgcatgagcagccattataatgcggtcttcctcctctgcagaaacagcaataataatttaacaagcaagttttacagagatgcaacgaaactacacaacagactgaacgcgcaatgttcatgcccataatgctacaaccaaactagcattgcctcatagacaagacaaatactctttggattaaggttaacatcacgtatcctataggatacagatactactggatgaaaggcagattgtaccagtgaagggcttgcgcttgacttgggggtcgagttggttacaccagcggaggcggcaggacttgccggagcgcccgggtatcccgcgcgctatcagcgtccagttcctcggcccgagtttctccaccagattgctcagcagcgtgtcctcatccgaggaccagggccccttcacccgctcctccatcgccgcccccgcggcgtcacccactgcgatttggccggtgatgacgacgtcatcctcgtcctcccccgaaggaggcggcgatgggtggctaggttggggcagggaccggactgggagtgggacgcgcgtctcgccgtcgacggccacgggaggggaggaggacgacgatgaggagcgatgcggttgggactcgtcgggatgggctcctgcgccgtgcgtctcgtcggtcatggaggcggggctggaatgggtggagtcggcggccggtggattcggcggcggcggcggcggcgaaacggcggtttcggacgacatggtggtggctggtgctgtggggttggtgctagttcgttcgttgtggcgagtgttccggagacgtgccctttcattttctatcctccgttgactgacttccgggtcccatattgtcagtcatcttcgcgtgggcctctcggcccttcgattattaaatgggctttttggagcccatcgaggtccctttagatggaccaggatttcagcccatccaaacgaggtctcaggcaatccattgcagatttgcagcgttgtggaaaacggcgtaccacggtaccagccatttaatttgatgaatatgaaaaattaagtacaattattttaaatttgaaatagatttatatgatattttaaagcagcttatatatagaaaatttttgcatgaaatgtaccatttagcggtttgaaaagcatactactccctctgtttcgggttgtaagacgttttgactttggtcaaagataaattattttaagtttgactaaatttataaacaaatataataatatttagaatactgaattagtggcatcaaatcaataattgaatatattttcataataaatttgtcttggattaaaaatgttattacttttttctacaaacctggtcaaacttaaagcagtttgactttgaccaaagttaaaacgtcttataacctgaaatgaagggagtgacaaaaaccaaggtaaaatttgcatcttaattagaaaaaaatgaggaatatttttgtttctttaacaattaatcatatgcttttttaatcatcggaataatcttttgtatattgcattttttttttaagataatgggagaaccggcctctacatcctgagacggatgcacacagccaattcgtatattgcacttgatgatcatttaaagtattgcatcttccatgatcttgtttagtgttgtttatatttatttatatattttttatgttttatctatccgatataaaccaaacctcatgactatttggtgtactacagcgtgtgaagctatattttgggttaatgttaaactatggctgttcagttaaaaaatagtatgaacatatttgattctagtgttgactacttctcccattcatgtagcgtgggcgtttttcatttttcaactctcagaaaaataagaaaccgtttcctccctcaaaattaaaagaaatcgttttcaagccgttgttggatcaacttgtcccccaaaaaagaaaaaattggcatatggcctatacatatggctgggttgataaagatgttcgtagcaaatagtagtgttgttctttgccacacactgacacaccggccgggacagcaaataggtgaatctactcggtatgtaaagacttgggcaggtatacgtgcgtgaggtgatggctgcatggcgccgttgctttcctgtaccaaatcttgacaatagtaacctgactaaactagctaggcgaataaaactgcatgtttcaccgtcactctgcccatcccacgctcttgtttgttccccagatcaatttgtccatgtacaaccagacattcacaatcaaaactattgttttcactgtcaagtggagtaaaattagacgcagtagacaacatgcaagtggtgtattttctttgtgtgccttgttggtctcatctgtgactaatacaaaaacaataacgaaggagtgagcaacgatttggttcctacaatcttttgcgctatatgtatattcctgtctggacaaaaaatgatactacagagttatgcaaatatgcattcatgctggaaatggatttcctgatcacaagtacttgatgaaatggatttcctgataacaacttgttggcttcgaatttttttgaggattaatattatttttatggaaaatcgcaaaagtagtggccaaccggggaaaatcgcgaaagtaggtccctgtcgaacgggtgcaattcgatagggcacctatcgaacgacggacagtcgacagagccctgtcgaacggctggcgttcgacacgctcgcctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtctccccagcccgcgatgcttgttcgatttatttgaggaccacatcgccagccgccgtcgagagtcgccacatcgtcgccgtgagcgccggagggagcgaggggaggggatagcaggccggagaggaggcgccggccgggaggaaagggttggcgacgccctccagcagt

SEQ ID NO: 58483 - DNA, 40223 bp, Oryza sativa
taaatttgtcataaatgccgtgtggccagtgaggggtcaacatggtggcagtggagagtagtggaggttgcgtcaactgggagttggaggaagtttgttagtaaagtaagggagaaaggctatagcctggcaatagtggtgcagaagacaaaatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgtttgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaacttacatacccgataattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccatctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagacaaaatgtgtgtgttctgcatgaccgacacgccggtttgctatcagcgatacagaagcttcaagaagatgtcacacagtccgtgccatggccagatttacatagcagatggtgcatgcgacattttggggctaatttttatagacaattcaggagtaagagattgatggacctgttcaagaagttatgcaagcaaaatcaacaaagaaagtttgatgccatatgggagcaactggatcgtttgaccactatacacatggaagaggttaggaaaaaacccatagttgccagacaggaggagccggatggacttgaacccattcctaatgaagcaccaagtattactcggcgcaggaaacgtggacgggccacgaagtgcttcacggagtgggtagaatttgagccaagggagaaatggtcgttgttgtacgatacagatggatcgaggtatggtgtgatgacaacaaatcttgctgaagtgtataattgggttatgaagaatacacgacctctaccacttgttgctatcctggagggcatcacgaggggtacacagaagtatctctgtaaaaggtattccatggctagtctgaacctcagcaaacccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcacctagttccttttcttacataaatgtggaactagttcagtatttataaatgatgtgcaactagttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggtctgacgacgtggcgagtgtccttcgcaacttccgtgcacgtgctgccgcactactacgtcgtgtctcctgtcggagcgcggcagatgtggtgcaaacgtcgggccgacggccatcaccaccactaccccgacgttccagcgtggatcggagtggtccatcctcttcacgtcgcgggtacgaagcagcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtatggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtaggaagaagggaggacctagcaagcgtgcgaagggcacttatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcacatacatataacattacaaaaatattttcctttcttacacactaaaataaattacatattattaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgttgaacggcagccttccgatctcgtcgccagtcgcgctctggccgttcgataggcgccctatcgaactgcacccgttcgacagggacctattttcgcgattttccccggttgaccactacttttgcgattttccataaaaataatattaattctcaaaaaaattcgttggcttcgatattgagttatgctaaaaaggtgtgacaatgacaagaagtttatgcaacaagcatgtcaaagcttagagaaacgatcatagagatatttgccaaccatatatagagatttagcctagtggttacagtgacctgagtagtaccccaaggtcctgagttcaaatctcttatggagcgaatttcagattgggttgtttggttcaaatctcttatggagcgaatttcagattgggttgtttgcggggctaagttccctacttcaatggccgtatatatccgattggatgtagaggccgggtaaaaaataccattctctaaaaaaaatatatatggagattgtaatatctctgtttatatggtggtgtgtccttttgctatcctgtcggttgtctgctatatataacttggagttgtctagactaaaacattgtaataggtgactaaagcttctctaaagtaaagaccgaattgttatcttaaaagaataaaaataagattacgataaagaataaatcatgtgaagtactctctccatttcaagttataaaacattttgactttggtcaaaattaaattgtttcaagtttgactaagtttatagacaaatatagtaatatttataatattaaattagttttatcaaatcaataattgaatatattttcataataaatttgtcttgggttgaaaatgttactacttttttctacaaacttgatcaaacttaaagcagtttgactttgactaaagtcaaaacgtcttataacctgaacggagggagtagtaatcaacaatacatacagagttaaaagaaaaaaaataaaaacaatacattgtttgtaaatgtctcatgcaaaaattgcttatataaattcctgaagaaacttctgaagagaattcaagtcgagactctagtctagctcaaactagctctgcaacttgcaagtgacagcgaacacaaatgagctcctggtgcttgtttaaactgaacgcgtgcaaatattatttgataaatatttacagcatataggaaaaatccactaggtggctgaatggttgcttcacctagtcttgaccagtcggcaaggggttagaaatcagactctgtagttggtattctgtagaaatgtcttgtattctctcaacatcacgtactagctgtaaagtttcaagggtagtagcaatcactgcataaatatataaattttcaataaactttgtcttgttttgttttgtctatttcgcatgtcaattagtagtcctcttttgaacttcgaagtgggttcctccttgaaagcaaaactgtaacttccactgtaaggttagtaaatactgttcaattaaaataaaatataagtcgtgatgagtacagaagaaatgtagtatggataaaaattaaaaagtcgctctaaaaagaagttcttctagatagaacttgaatcagatgcccaagcatacaagctattcctagtttctagtaaaggtacgctggagaccttgatatatggccagccatcaatcattgaaaattccttttgttttgagttattctactctcagcaaacaaggtatcagtcgttacaataagcccaggtccatgtctaggaagttgttagcagagtagttgatagaaattgtaaaaatataatgctatggtcatcatttggatatgtatgatcctagttagttgttaaagccataactaaaacacataagttatacttttaaaccttttctttttaaattttgatcagtgaaaagtaaacaatatgagtcagtctatatctgagccttgacttgggaaaccgttctaactgataataaataggaagtactctgcaataagcatccataaacttcatgttccatgagaaggattcaacaagttgcagttgaactaacaaaatgacacgcaagtcagcattattcaccccaatacttgattgatcaagtcaaccaggggcatcgggcagctatatatatagcggcattccggctgcattttgtcatccccttaacttcgacaatcactgctggtaagtgttatttctggtccccccccccccaaaaaaaaaaaaaagtccttttttcagattttgagtaaggtccagatcaatttttctgttcaccatatcattgagagttgctagctagctttggccttggaatcaaacatacggcatgtcgtgttcttggatgatcccagtgttcgctattctggcttttgttgcatccgcggcccaagctgacgtcgtggagcataccttcaatgtaatcattctctctctctctctacaaacaaaatccgcattgaattgttcatttgtcctttgcacaacaaaaaaatagtgccatgaaaactattacacacacgagtatatttttaataggaatttaatacgtataagggtttgtagttggcatccatccctcagagcttgtgttagcaggtgcactcacaagtgtgtgcatgtcatgtactcatgtacatacttagtgtagtgacgtgtgtatcttctatgtagtcgggaaaaaaaggagaaagtttgcacaaccaaggaacgtcacgaacgtgtaattgttttatagtcggtttaataacaaatatatggaaaaaatatttaatcaagtaatgtatcaaggagaagcaacaaagacaagtgataagtttaagtgatcatattttccttttttatatattttggaattatttttctagcatcttttttaatattaagatacatttttcaataacatctgatattttgtactccctcagtcccagaatgtaagaagaagttttagggttggaaacagttattaagaaagtaagtagaagtgagtggtggagggttgtgattgaatgagtagtgaaggtaggtggggaaaatgaatgatggagggttgtgattagttaggaaaagaatgttagtggagaagttgttatattttgggacaaatcctgagagctaaaagttattatattttgagacggagggagtaacagctagtagatgacatcacaccacaagttgccaaaacaaaatttctacaactaatatttattactaccagggtttttaaaaccgtgcggttaccatgcacggtaaccttttcagtttttgaaaccacggtatgtctcgcgattatcacgcggttttcacgcggtaaccgccttaccgcgggagtgcagtaactgcgccaaaaacggtaaggggaaccatgattactacctctgatcaataatattttatgtttaaaattagatttaattaaactttcaaaacttttacaatcaatatcttctaaaatgcttagttgtaaaaaatgtggagtttaccttgaaaagtactacaaagatagcacaaacttactataattccgtcccaaaatataacgactttacgtggtttaaactttctaattcaaagttgatgatcacaatttcaaaagtttgctcgaatatgtcctaaatgagagagaagatttaaactttctcgacaagcgggtagcgcggttgtatgcgagcgtccaagaaaattgtcagcttggcagcttgccacctcatatctaatattctcgtaccacacactagaaacccattatttctctgtcaattctcaagtcttgcctatggtactaaaccccagtcttaacagtcatgctcatgatattgtttctatatgatttttgtcaggtcgctacactatctcttccccgtatatgtcagccagggaatacgagcgtcaccgccgtaaacggacgagtgcccggtccccaagtcgaagcccgcgaaggcgacaccgtggtgattcacgtcatcaacgactcgccatacaacgtgacagtccactggtacatgtatctcacctactcctcgccgcccgatgtgtgacaaactaacaaacggcgcggcgaacggtgcgtacgtgcaggcatggcgtgttccagcgcggcacgccgtgggcggacgggccggcgatggtgacgcagtgccccatccggccgggccaccggtacacgtacaggttcgccgtggccgggcaggagggcaccctgtggtggcacgcgcacagctcgtacatgcgagccacggtgtacggcgccctcgtcatccggccgaggcgcgccggtggctacccgttcccgacgccatacgaggagaagaccgtcttgctgggggagtggtggaacggcgaccccgtcgccctggagagccagtccttctcgaccggcataccggcgccgaacgccgacgcgtacaccatcaacggaatgccgggagattcgtacctctgtccagagacgactaaccgtacgttcgagttagtatcacgcgcgcatatgtgtgacgattatgttctgcaacaatcaagtacgttcttgtgcaggaattgccaagttcgaggtgcgccgcgacaagacctacttgctccggatcatcaacgctgcgctcaacacggcgttcttcttcaaggtggcggggcacacgttcaccgtcgtcgcggcggacgcgagctacacggagccgtacgcgaccgacgtgatcgtgatcgcgccggggcagaccgtcgacgcgctcatggcggccgacgcctcccccggctgctaccacatggcgatctcctcctaccagagcgcgatccccttcccgccgcgtcccgcggggttcaatggcaacaccagcacagccatcgtggagtacgtcgacgcgacggcaacgaccgatgctggctcccctgtgctacccgtcatgccaaaaccgaacgacacgtacacggctaaccagttctacaccagcttgacggcgctcatccgccccggcaggcggaccgtgccgctcaccgtggacacccgcatgctcgtcaccgtcgggctcggcttctcctcctgccagcccgaacagacgcagtgcaacaggagcgccccggtggtcttggcgaacatgaacaacgtgtcattcgctctcccgaacaccgtctccatgcttgaggcgctgtaccggaacacggcggacggcgtgtacaccagggacttccccgaccagccgcccgtcgcgttcgactacactagccgcgggttgctcggtaactcgcctctggcatccacggggagcccgtcgacgaaggtgaagacgctcaggtacaacgcgacggtggagatggtgctccagaacaccgcgctggtgggactcgagagccacccgatgcacctgcacgggttcaacttcttcgtggtggcgcaggggttcggcaacaacgacggcgaagcggctggagcaggtgagttcaacctcgtcaacccgcaggagcggaacaccgtcgccgtgccgaccggtgggtgggcagtcatccgcttcgtcgccgataacccaggtacagtagtcatctgtaatcaacttcgtatatgaacgtttacggctgcagtaaacaggtaaagtttaattgggatttgggcccctccaaattgggcctaaaagagaccaacaccggtttgagttcgcacaaagttgaagctttgggctgttttgcatccgtgcatattatgttgggcctatatgggccgttttcagcccagtcttgtcaggccgaaatatagataatgtcaagtaatctggcccgttcagaacttcggggcttttttttttgcggggaacttcggggcgtgcttaacgatttgccactagatctacatgtcatagatagtgagtgacaaattgttaattgctatatcccaaaagtggcaaatagttaaatttccccagaagttccgatgctgaagcgctcggcgctgacgtactgatggtgtgtaggatacgcaatcacggactcacggtttatcttctccttttataagaagccaactaagtcactaaccattatgcttctgtcatctcaagaatcttatcagcttgatatagtttgcactgtcaagaagcttatcttgttgcggtttgcaaggggataaacagagtaaagaacgcatgttctgattagttggaaactttttctgcttgcaggaatgtgggccatgcactgccatatcgattctcacttcgccattggcttggcaatggtgttcgaggtggagagcgggccgacgccggggacgacgctgccgccgccgccccccgacttgccgcaatgctagctggcagctactagctgctaaggttgctctctgaaagttcagttctggccttcttcgatccggtgaaagatgggctgccatcatgatgtaaaatgcttcggacgacagggagatgacaattaagttccatacacatcttggtaatctttgaagagatacattgtttcgacaattcgattccgattgattgcaagtgtattttatccgtagagttttaccttcttttctgtgttgatatttgatcgttcctggattctgcagttctgcacgttaacatgtaaataagaggggtcagaatcaaagagtaaataacaacaaatcacaagaaaagcagaaattcatgtacgtgatttttcctaggaacacaatcagtgaagaaatttttttagataatgaatcactgaagagcttgtgccttgtgatcttgtatctatgtaaagctttttgcagatcatttcccacttccatggaattcggaagtgctcctgatttctttcacaaaagcaaaattcactgaattacccatgcataccccttgctaaaacaatcgctccctgcatatctgatgaactgcgtgcatgtttcagacgagcaaattcaatttgctttccgcatggttctgggcttctggcaaccatgctgaccctgcgcacatcctgcagttaggtgagaggtctccatcgtgtccatgccttcagaacttaatcgtttattcggagatggtacttctggatgttccctggcattcatgcaaagggaaaacaaggtctccacaagatagactccgagtgttgttttgttttttttttcctgagctctacaccgtatagccgtatgtataaacatcataacgttatctcgtcaagatagacctccatgatcaactaccacatgatcccaggtcattttccgttttcgtgtcatctttatcaacatatgcacgctgtattggttatctagagaatgctgtttgtccggttatgcatccatcctgtgcattacttcactatatcagaagaattcgttgcttaattcattgggcagaatttgtatagaatattattgcttgggcccaaatccgtgacatgatagactaatgagtagattgttgtcctaattagcttctcctgatccgatattcaaaccactgacaaggaatgcttggttcagggtacttttggtacacctcagctattatgagagctgcttttattgatccagatgggggagtaatataaggacactttgagacatgggattagttctaatgttttctcagccagttttttcctgttacacgtttagcttatacgttggcctcataattcgtcagaaaactatatacctagtgtgtccaatagtaaaactcctgattgattatgatgaaaacggcattttttgtggacgtggcggtaatgctagccaagaaagaggaattgacaatgttcaggttgatagaccgtgaatttgatactgcaatcaaagatagcagtgaacaagctagcaattgacgagtggcattgctttctctatcattttatcaggccacataaataattaggggtcagcaacacctagattatgagcgtgtgatatcgctagaagctttatgtcgcaatcggagaaaaaaatagacaaatgtgccattgccctacgcaagtgattctcggggaagtgccaaaagcattccatagtatatatacttatcgtgtttctctgaagactttgctatatacaagttggccaagatcaccaataaggatttgcctatccttctctggcgctcctgaatcctcttagatggttataccttggtgttcgtccatgatgcggcttttgtggttcttgttcgcgcttcttcttgccagatcggtggcagatgctgcaactgcgaactacactttcactgtaccctctctctctctctctctctctctcatcatcatcatcatcatcatcatcatcatcatcatcatctcatctctctgcatacatgtagttgtattcgttcatgtcattgatttcaagaagctttgtacagcaacaagaacttagatacttgctatacctgcaagctagagttattgatcaacttgtgtgtggaaagcatgagaattcataaacctgaaactgtatacaatttgttggtttttccttaatttcttcagtagtagtatgagaagagttcggttgtctgtatataagactgatgccacatttgtttgcaatcacataggtggaaagcatgcgagtcagtcggctatgcaacagcactgacattattgcggtgaacggcctactgccaggcccaatgatagaagtgaatgaaggtgacgcagttgctgtcgaggtcatcaacggatcaccatataacttaaccatacactggtacgtcactaatccttgtgcctcagaaacttccggtaatcaagttgctgtaaccttttcttcattttaagcagtaacgtcaagtcgtctttgtagtagcatgtgggatggcgtgagagtcctgcaatcgggctagttatttagattcgggggctagctggtcctttgataagtacgagtgattagtagttcctacccgaactcttgagcatatctatatatgaatatatgattagagccgaaagtgaaagtcctgaaaaggacaccctacctgacgatgccaattaagccgttaaatgtacgaaagctcatcttactatttgccaagtgttgtacagctgataactgttacaagtttaaaataaagcataggaaaaaaagtcatgtttcaattatactggagatacaagtgttcatacaccacacatataagaaaacgttcactttacatattagagacaaagtattatcctcaaaaatttcttacttaaagatgctaggatatatttcctgctctatcaatagaacttcgcaccgttttgtgcgagtcgttaaaaaaaatgctagaatttaaaccatcgtaagtagagatacggagcaatataccctcaactgcaccaatgcaaactacaaatgttttctgaaaagaaaggtgattttttttataatggattatattaaccaggcctctacaccttagaaagttatacacagcctaaaccgcaattaaaagtacataagactccacccactacatggggataccaaataatagtttaacaaaatagttaaaagaataacatcagtctaagcctcaattcttctactaaaattccaaccaaaggtagaaaagaactctattactctcttatccagaaaacttcatttgacttgaacttccattttatcgtcttctttaagaaacaaaaaccaaaaccttgtccaatgagttgccttgaaaatcacttgcaagaaagatatgtgaatatgtgactgtgactgttaaagaccataagggtatgtttcttcctagatatcaatcttatagcaacaaaaaattctaaaaatattttacaacattgtcatgatactaatctattgtctcataaaatcccccttttgcgctgaatggttgaattactgaatagctgattgtttcttttaataattatcagaggatacaaatgaacaaattaaatatcataaagttggtaagtggatttaaaataatatcttaataaattaatatatttgaagttcttttgcagacacataacatttaggagtttaggaagcgtgcgtattatttatagaatggggaaggagaaaaataataaatttggctgacaacatgacctttgatgttaaatcttttttataaattttcccgaattggatgtcatgaaagatacttcctacgtacttgtaaagaaagtcgtttaggataatgtttaagtcaaaccttagaaaaaaaatcatgaataactctcaagttgttgaatttgaaaatgtaaaaatcatatgaatagatttgtcttgaaaaatactttcataaaagtatacatatatcacttttaaataaatatttttatagaaacaagaagtcaaagttatatattggagaccgtgtcgctgtccaaatcgacttcgtttacgagtacggagggagtatgccgctgataaagtaataagtgcaaagactttctgcatttcgcatgctactaggagttgattgtcaggctgcttgtgttgctcttgaaaataaaagtagtattccctccatcccaaaatataaatatttttggacttcaacacagtcttcgagatgctattttgaccaacaatatatagtatgttttaaataaaaaaagttgcatattgtgatagtttgtttaataataaatctaataacatcaattttaatcttttttatattttttctattaatagttaagattgcaaatatttgatttggcactatgctaaaaatgcttatattttgagatagagggagtagtgcagcaattcagtgcacttttttttttagctcaatttagttcggtacacttaacctaaccatttggcataagcagagttgggtctaacccctgcacgtgtgactgctgctggtggaaaattttacaggcatggcatactccagctactgacgccatgggcggacggcccgagcatggtcacgcagtgccctatccagccgaacagctcgtacacgtacaggttcaacgtcaccggacaagaaggcacgctgtggtggcacgcccactcctccttcctgcgcgccaccgtgtacggcgctctcatcatccggccaagaaacggctccgcctatcccttccccgcgccggaccaagaggtccccatcgtgcttggtagccgccgaatctcctagctgtcgtactatgcattgatacggaaattgggcatatcttgattctggatgaggccttggtggacacaggggaatggtggagccggaatgtcgtcgacatcgagagcgacgccgtctcatctggccagcttcccagagaatccgacgcgttcaccgttaatggtgttaccggcgagctctaccaatgcgcaagtacgtacgtcatttggtaaatcctgatggaatgacacagtttaatttactgcaggcgaaaaatgtaaatcctctgctcaaatcgaagaaataactctgtaaaaaattggttcgtagatgacacgttcacggtggacgtgcagcccaacacgacggtgctactccgggtcatcaacgctggactcaacacgcacctctcttcaaggtggccggccacgcgttcaccgtcgtggccgtcgacgcgtgctacaccgccaactacaccacggacacctcgtgctcgcgccggggcacaccgtggacgcgctcatggtcaccaacgcgtcggccggcagctactacatggcggtgcaggcgtacgacagcctgtctccgaccaccatggccgtaaccgacgacaccaccgccacggccatcgtgcactacaacaccacgtcgaccaagaaaaacgcgacgcccgtcatgcccaccatgccccagagctccgactccgcgacggccaacgccttctacttcgggctgaggggcccgccgtctcccagcgcgccggccgtgccgaccaaggtggacgtgaacatgaccatcgagctgggcctcggccagctgccgtgcgactccacacagagcagctgctcggggaaatccgtcgcggcggcgatgaacggcgtgtcgttccgcctcccgtcgcagatgtccctcctggaggcgcagttcaaccgcacgccgggggtgtacaccgccgacttcccggacgccccgcagccgagcggcacgccgatggtcgaggggaccaaggtgcggaggctcaagtacaactcgacggtggagatcgtgctgcagaacccgaccgccttcccgtcggagaaccacccgatccacctccacggcttcaacttcttcgtgctggcccagggcctcggcaacttcacgccgggcaacgtgagcggctacaacctcgtcgacccggtttcgcgcaacaccctcgccgtgccgaccggcggctgggccgtcatccgtttcgttgccaacaatccaggtaggaatcctactgtcgctaaatctgtcgtatttctccggcccaaactagagatgggctgtttgggcctaacgtatgggctgaaaatgacgggtgctggttttggactttggacgcaggcatgtggttcttccattgccaccttgacgcgcacgttccgatggggctcggcatggtgttcgcggtggataacgggacgacgcctgactccttcctccctccgccgcctgccgatctgccgaagtgctagaacctgcaagattctggcgttggtgtcaaattgtaatgcactttcgtagccaaattttacttcatatttgttcttgtgtttgtgtaaatggagtacaggaggcacgaaacgaggtagtgccgttcgtttatttgttctgtgtatgtgtatcatgtgtaaactgtaaagaggtctgttttttttttcctctccgggggaacgtgtaaactgtaaagcaacaaatgtcaaacttcagattcctttgactgtgttaaacatgaatttattccaggataccaattaagcaacgatttgggagaatgacgttggtttgcttgcaattcttagttttcagctaaagattcctgtgtttagataagctgccaggggtgcatttggccatttagcctagcaggagccaggagggcaagctctgattggttttcaccaaaggacgacgtcgtcttacgagtcacaagctcacgacaccctcggcccatttgcaattatatttttgttcaagtgccaatcttatcgccaattgtcaatgggacattaccttacaaaacgaaatgtcaatgcgtcacttatatatatgtgctatttcatcgccgcggtttttccctgacttgatcaaagtatgcgtgtgacgttggcagaattcaggtccattcatggatgactattatttgagcctttcatgttcctctgtatgtagaacactaatatagaacacagatggttgtgaaactgtgaaacaaaaatgcaatcagaacagtagaacccttgtcacgccccgaactagccctgaacggaactagcccgtgactctccaaattaacctgttaatcgataccagtcccaggaaacagtgccggtatcacaggaagacagattatcacagcaacagaggtctccttattacagagtaggggtacaatcatgttgggctacggacagatcccgaactcacaactgcattacaaaaggaaaagcggaagccaagacttggaccattcatcacaggcgcgacttgagaactaggcagaaaccctaaaactcatcgtagccgacttgctcctggaagaactcctcatcagcgagacctacttcatcttcttcagcaactgggggggattatttatgtagagcaagggtgagtacaggagtactcagcaagacatgggaattaagtatttaatgcaggcttcaaaggaaaggctgttgtttgtgcaattgattttatttaaacccccttttgaaacaactaagtgagtgcttctcaaacgacacggatgagacagtgcgtcttgtccggtcggagtatgtgcaatgtatcagtctttgattggatcgaggttggcacccggccaacagctttcaaacggccacccaggcctggctgatcccatcagccgcagatttttccaaacatcgaaccctttccacatcagcaatttcacaagcagtagtcaaacaaaactacgctaggaatcacctcacatccgcccatgaccgtgggcacggctgttcgaacagtttaataacctctacagagggggtacactttacccacacgacattactaacccggatcacccagcccgtgcagaacggccacgtctggagaccttgaggctttcatgacaaggcatttcgaaagccgacacaggttcaccatatgccaacaagaggggtccagaccaacaccaggttaggtcccagaccatactgtgtcaggaaacctaggggttctccccggcaccaccccattgaatccacatgtctcttggcatcatggctcccccgattagctaattactcagccaggggcgtcccattacacccatgtggtcgcacttgtcttatgttcggatgaaattccaaggaaacggtccttagtgcaagagtgggaaaccgtactctcggtacgtcccccggtctgcgattttggaaattcatttagttcgcaagcaccgacccaggtatcagggtttttttccaagtcttttgtaaaccccaagttttacccatcgttggatgttttaaatttgaggggaggtgttccgatgcccatgcccgaaggcccgtgcatcgaagcacaacagtcgacaaaggagttttaggtattcaataattcacggagggtaattgcagcaatttaggatttggggcaggcaggctatctcgcaagccgcggccgaattacgtgtgttaaacctattcatgcaatatttgcggaaaagaaatacttatatttaaattataggtgcaaaatgttcaaaggtgacttgccttgctcgagatcttgagcttgatcctcgaaatcctcgcgctgtgggtcttcgggctccgaaactacacgcgaaacgggacaactcaacaaacggtgaaaataaagccgtattattgacctctaagcgtgccattagatagatctcgagacttgaggatttttggaagttgaacagagtcaaacggatgtacagttgagaagttattgaatttctaagattattggatttttggtctaaaggaaaaaggatttaattaaacccttttgaaaaagaaaagaaggaggaagggagtttagacttccctcgggatagccgcggcccgagaggagagagcggctcagctgagctaaatgggccggccggcccgagaaggcggcccaagggcacgcgcagggagagagggagggggaaccggtgggccgggtccacctcgcgtggtcccgagtgggacccgcttgtcggcggctcggctcaccaagagtgaggagcacgcgacgcggcgctagggtttggagggggcgcggtgcacgcgcgcggctcgcggtgggatgcggatgcggcgggcccacacgcagcctcacggctcgcagtggaccgcgcgcacgagcggggcggaggggagcggcggaccggggtcatcttgacccggtcgcggccgaggtggcgccgaggtggcgcctacgtggccgccacgcggaccggcgagaggaagacgacgacgcgcccgcgaacggacgggggacggcggcggcgagcggcggggcgatatacggcgatgcgggcgagggcgaacacaccgggaggtagcgcgagactagaggagacgagctaactgctcggattcgccggagggagtgcgacggcggcggattgcggcggtggcaaccggcggcaagagaagggggaaatggcgacggcgcgacgggagttcgattccttcgcactagagcatctacgcgactccgggaatccattccttgtgccggattaggaggaaacgcaccgagggaggccggcgacgagaggcgctaccgagctcgggcggcgacggcggtgagcacacagcgggcggtggcaaggcttggggcggcgccagctgactacgggggtctactcgtgctactaccgaaagctaggggcaggaggaggaacgaggagggagaacggggagtgcactaccgcgacgaggtgaagggcgcagtgacgatggctgacggcgcggggcgtgatcgctccggcctcgggccggggaagaggaggaagacgtgcgcccggagtccccttccgttcctagcgcgcactggctcctccggcacacgcgacggcggaaggcgacagcaagcagggcacgggcgaggcggcaatggctcggcggcttggagcgaaacaggggaatcgagcgagagggggaggggcggcttttatggggtggttatgtcggtttgggaggagaggaaaccgacctcgagcggtactggggcgagggagcttcgaggggaaggaacgggctcacgggcgcggggtcaaacggcatgggcgatggctcggcgtcaggcgctcctccctgcccatggcgctggaaccaagcgggagaaacagaggccgggccgagtgaggaaaggggaaaacagagggggagaaagggagctcgagccatgccgatttgggaagggagagagatgggagcgggaggcgctgtctccggtttttggacggatgcaggtggagcggctcgggcacgcgcgctggctcgcggggcaaggcgcgacgcaagcggcgcagcgcggtagggcgcggggccggacggcgtaggcatgggtagcaggtggctgacgacggcggcgaccgcgcgggcgcacgcgtgaagcaacggcacgcggattcgaaattgcgggtggggagctcgctggggatggagcggggagagagagcgagagaggggagagcgctcggctcggcgcacgcgcacacgcgcgtgcggcacacgggcagagcgagggagagagagacggagctgagggggggagagagagcgggctgagagagagagaatcggcccaccaaacgacggggaggcattttagacttttgcggaggaatttgatttgggaaagatttggattcgggatttgaatttgacgatagatcggggattttgagatccggaatggcacggatgcttgacaacactcaaagaacaaattttgcaattagggtttttaagaatttaattttcccgctaggcgccacgacggaacgggcgctataggatgtttaactttttttccttatcaaatttccaaatttatacaaaaatatagtaatattttcaacacaaaacaaacatattatcaaaatatattcaatgctagatttaatgaaactaatttgacaaaaattaaatattgaaattttttctataaatttggtcaaacgtaacaaagtttgactagaaaaaaagtcaaacgacttataatataaaacaaatggagtattatatagatatagtatagtattcatgccatgtaggcatgcatggtgagtattctagtccaaacatttaaatatagagtttgttctttttctaatgctacaaaaatgtttttgttaagaattaagacccacaaaaaccagatgatatttttatgagtaaacacacactaggctttccctgacaaaaagaacagcatgttgtacattgcaatgggattttgtgcaagcacgggccgacgaatctacttagggagcggttcattttatttatatctatttttttattggttgatggtgggggtttagtttttggtttttgctatccaattttgtatccattttttttatcgatcacccattaagttgtctatcattttttatcggtcacatgagtttttatctgatcattttctttatttggccatgggaagaggaacggtaactcccgaaatcacgtggaatcgcgttcaaggggtagcggataaatgaaattaccatttccattttacagtagtagtgatagtagtatgttcgtgcattgcaatagctagactaacattttaagggcccctttattttaagggcccctttgatttagagaaaaaacaaagaaaagaaattttagagtgtttcaatcctatatgaaatttttttatgaagtctttaaaagaaaggattgaatcatactccatcttttataattcctatggattgaacaatcctatagagattttgtacgaaatttaccgagaacttcaacctcttaaaaatttccctttgagtatatctctcttatctgattcatacgtttttcttgtgatctaatcaaacggtcattcatgtgtttttctatgttttgcaatcctcttctttatacttgtattcttgtcaaaattctgtgtttttctaattctgcgatttaaagggccctaagtgtatagagaagttgagcaactttggtagcttgcatgaacgtcccatattcaccgttgtgtctatgttctctatgatacgcattagctttcttattgttttgatacttaacttagtaacgagaacttgatggaagtttttgaagaaaggcaaaagctttgccttgtgtatattaatagagcaggagaaaaataaacaagggtatatatagggttagccgaggaaaaagactaccccgcaaaaaaggaaaagagctaagtgatatctcccaggattccaaactcctgtagggttgttgcctctgctttgacccatgctcttccttcctccttgatctttgctaggattgaggacggtgatgacgcagagtttcggaaaattcttgcattgtgttcgcaccagatttcccacgagactaggataatcatagtctttagaggcttgcgggggtgtttggggactccgctacgagagtccaccactgcccaacagagtgacaacgttcccaactacccatctgaaggtcggtgcatgtccatctctggatttctgtccatattctctttgttagcctacatttggccaggaggtgtagggtcgtggagtccaccatttagtcagaacttgatggaagttttgtacgcgtgtgcgagagtgtgtgttgttttttaaaacacatggtacatgcgcagacactacgagtttttcttgttgaatgtgtcatccacgttgttattaaactcaattatttgaattttttaactgaagagacggtacgtactatacgtgctagatggagctttagtaaaacaatatgtataagtgtagaaattttctactggatgctcttgacctcagatacacacttagaataattgatagatgctacatctagccaaacttcttcctttaccaacttcatgacgtgccatatactgtaatggtgatttaatccaactgcgttttcgaggaaaacagcatccctccatggctcatgccgtcgcaatctgatttcgttgttactaaagctctcacgccatgacggccaagtggaatcggttcattagacttacgtacgcattcacgaatacgctgtttcatacgtcgttctgcaagaagaagtaataagatagactagttccaatgtcagttcaataggatgtactattgtgctaatacttaaggacgcgcgcgccatggcggtgtgtctcctcaactttgctactccagttgctactgaagactccggccatggcatcggcagccatgctcgtgccgctcgtgctggttctctgcacggcagcagcaagcgcggccgtcgtggagcacaccttcaaggtaaaaattcctgcccagaaacttgtttgtgtgcatgtttgctctcttcgtatatatccagcgttatgtactgtactctggctttcgcgcgcgtcgctccacctgtggctgtggtgcttgttcgttttggagtggagtgttgcaagggtccacggctatgtctttctaagttctgcgtatacctgaattcaggtgggcggtacgaagatcacccagctatgcatgaacagtgtgatctacacggccaaccagcagctgccgggaccgaccatagaggttaccgaaggcgatacactggtcgtccacgccgtgaacgactcaccgtaccctctgtcactccattggtaagcgctttgacattctctgaactttcctttgccaaacagggggcgtgatctgaatacaacagactgccaatgtttgtgggcctcacatatccagcccacacagcccatagtccctcaatcattctgggcttccggcctaccacacctggacaaaccggcccaaaactcatgtgtttcctctccggtggtgattgatgcaggcacggtgtataccagctccggagtggttggaatgacggggccaacaagatcacgcaatgccccatccagccttctggcaatttcacgtaccggttcaacatcaccggccaggaggggacgctgtggtggcacgcgcactcctcgctcctccgagcaaccatctacggcgcgctcatcataaaacccaggaatgggccgagtgggtacccgttcctgaaccatatgaagagatcccgatcctactaggtacgcaagaactagtaccgtatacacgatggagagatggtggcaatgtggcatggttcatttttgctgtgtggctcgtcacgatattacgtaattgttgttttctctggcaggtgagtggtggaacagaaatgtggacgatgtggagaatgatgggtacctgaccggcttagggcctcagatttcagatgcgctcaccatcaacggcatgccaggtgaccagaatcgctgcaaaggtacagctccaccagcacgtattagatagtttacctgtgaccaacattttcccgacctgcattttttttgtgtgtgtgcaacacattaggttccgccatgtatgaagtggaggtggagtacggcaagacttgcctcctgcgcatcatcaacgctgcagtcaatgtggagctcttcttcaaggtggccggccacaccttcaccgtggtcgccgccgacgccagctacaccaaaccatacgccacggacgtcatcgtcatcgcgccgggccagacggtggacgccctcatgaacaccacagcatcgcccggtcggtactacatggcggcacacgtcttcgacagcaagaccgtcgccgtgccgttcgaccagtccaccgccacgggcatcgtgaagtacaagggcgtgccgaattacgccccggcggccatgccgtccctgccgccccacgacgacgtcgtcaccgccggcagattctactggtcactcaccggcctcgcgcgcccgagcgacccgggcgtgccaacaaccgtcgaccacaacatggtggtgacgttcgggctggaccaggcgccgtgcgcgcccaaccagacgaagtgcagcgggttcgcgctcgtggcggccatgaacaggaactcgttccagttcccggatcagaaggtgtcgctactcgaggcgctctacaagggcgtaccgggcgtgtactccgaggacttcccggacttcccgccgccgatgcaggggttcaggaaggcgacggcggtgaagaaagtgaagtacaacgacgtggtggaggtggtgctgcagagcgagcagtacagtagcacgctcggcaccgagaaccacccgatccacctgcacgggttcgacttctacctgctggcgcaggggctcggccggttcaacccgtcgatgaagagcaagtacaacctcgtggacccgcaggtgcgcaacaccgtcgccgtgccggccggcggctgggcggtgatccggttcatggcgaacaacccaggtgagcccgcggcgcttatttatttttaccttacatgatttggtgcaaccgtgcaagtgactgtcgagttgttgagttgcaactgatttctgattggttccatgcatcggggatgaaactgtaggtatgtggttcatgcactgtcacttggacgcgcacctgccgttggggctggccatggttttcgaggtgctgaacggaccagccccgaatctgctccctccacctcctgttgaccatccaaaatgccatggatgaacgccttacagattatgtgcgtatatacagagtatactcgacaagttcatgataccaggaatgagattgggtataggagttttcacctgaaaaagaaagatttgagtgtgcgaggcgtgcccgtattcaaattccatgtacttactgctcgtgtggtcattcttttctcatcctgcttgtgtttaggacaatcatgttcgaagttcgccactttttaagatttcagtactgaataaaggatgggcttctggagccttccaattcgtcactgtcttgttactacttcctccttttagcctctcattgtaagctggattactacaatagctcctcatgaaatttttcattgctgcaagaattggaatatttgcacataggctcacggaacgaactacttcaccaaaagaatgaataagctatgtttacttgttggcatatcaattgcaaccacaaattgaattttactatttagagttgattttgagggattctacatgtaaattatttttcttgcttcattctttttggaatcaaacaatcagaaccgaacttttctttttgtttttttttaaattagctgggtggcccgcgcaattgagcggctagcatccaaacaaaatcatatagtttttaagtatgattttatttaaaatttattaaatagctatctagctatttcattgtcttaagactttgaaagaccaaaccttatcatcctcgtgtttctaattatatagtttttaaaagtcacaccagttgctatcccttatgtcatctccttctttatttgcttgctcgatctaccactattttcattcattcttcttggaacctttaaaaattagattttatagtttttagagtttattgtcatgttgggtttcatttttataatttctagatgtcccatcaaacgttgccattatactactctacggcccgtccacggtctcttctcattgttgtcattgagattttaaaaatcgaacataatttttgtttgggttcattttttactttctagaagttccgccaaaccgtcagcggctttgctattgtactcctctacggctcacccgctgcctcccttcttattggcattgagattttagaatcgaacatgattatcgttgggtttttttactttttagaagttcaaaacctttaaaaattggacttgtagttttattttttataatttttagaagtcccatcaaacgatgctacaatgcccctctacagcctgtccgccgccaactctttattgacattgtgattctaaaaatcgaacataactgtcgttggaattcattttttattttctagaagtcctgtcaaccgtcggcggctctacaactatgctcttatacaccccgcccgctgcttctcctttttattatcattgagattttaaaaattgaatatgattatcaatgggtttttttttactttctagaagtcccggcaatcgccttactcgtttgcttcatggcctgcctgacgtctctccttttaatcgtcattaggattctatttggtgttttattaacaatttttatatctcatatcaaccgccaccactctacttctttataggcatgttacttaatttatctcgtcatgtgttttagatggtcttttctttcaatgatctttatttttatcacaaattttagttatttataaattgtattcctaattgatatcttatttttatttttctaatttcagaattttttaaaaaattttagttaatatcgtattgtgttattttaatgtttttattttttattttcaatttcagttgtttcaaaattgtattcctatttgaactctcttttaatttttctagttttagatattattttattttttattctaatttttaattaatctcgtattggattcttctttcaatatttcttatttttaattttgaatttcagttatttttaaattatacttctacttggactctcctttttcttttttttctttttctccaattaatgtgggaattatttttattctgaattttaattaatcttgtattgggttattatatagactcttattttaatattccttatttttaattccgaattcagatatttttatattgtattcctacttggactcttattttcttttctaattttagattttattttattattattttgatttttgattaatctcgtattgggttcttatatggaaacttattttaatattccttatttttaatttcgaatttcagctatttttaaattgtatttctacttggactctcctttccttttttgattttggatttttttatttttatttcgaattttgattaatctcatattgggttcttatatagaaacttctttcaatattgcttatttttaatttcgaatttcagctatttttaaattgtacttctacttggactctcctttttctttttttttatttttctccgattaatgtgaaaatttctagcccccacagtgaacatggtgtctcctttcaaagctgttttaataatataatagatatatgatcagagccgaactttgtcacatgctcatataacttggtcgaaagcgtcgagcccattatttactggccgtctggccctcatttggtcctgttattttggtaaagcccaaagtccagcccatgaactccagaaagcagcaaaataccgtgcgccagcggctctagacctctagtcaaagcgaaagccaacggaggacgtatcgaggttgttgcagagtgctggacttgcccgccaagccgaagacaaaacgcaccgcggacgtggagcaacacgcgccgcgattcaggctccccacttcgtccacacatcccgcctcctcgccgcttctttaaactccaagcggccaagcccaccgccaatcactcatccaagtatccaacaaagaacaaacccacccccgccgctgagatcgaatccgaccttaattttcacctgctcgctgatctcgccggccgtcgaccgccatggggatggtgctgggcaagatcacggtggagacgcccaagcacgaggtgctccacaccggcgccggctacgaggtccgcaagtacccgccgtgcgtcgtcgccgaggtcacctacgaccccgcggagatgaaaggcgaccgcgacggcgggttcaccgtcctcggcaactacatcggcgccctcggcaacccgcagaacaccaagccagagaagatcgacatgaccgcgccggtcatcacctccggcgagcccgagagtatcgccatgacggccccggtcatcacctccggtgagcctgagccggtggcgatgaccgcgccggtgatcacggccgaagagcgcagccaggggaagggtcagatgacaatgcagtttctgctgccgtccaagtacagcaaggtggaggaggcgccgcggccgacggacgagcgggtggtgctgcggcaggtgggggagaggaagtacggggtggtgaggttcagcggcctgaccggagacaaggtggtgaaggagaaggcggagtggctcaaggccgcgctggagaaggacgggttcaccgtcaagggccccttcgtgctggcgcggtacaacccgccgtttactctgcctccgctgcgcaccaacgaggtcatggtccccgtcgagtgatacggcgagactccattgttggtgtctagtgatgtactgatgcgcatgtacttttatcagggtgtccttgttactcctaggccctagctatttctctatttctttatccttttgactttgttctgtactgatgtatgtttggatcaacgaataatggacatatcttgggaaaaatttcagtagtccggaaaaatgaatcaagcatgcacacaagaatactctgcagttcagtcacgggcagagtacacagcttatgcagttatgctccttgacggtaaatttgttccggcctgaacttattggagacgctcactgcaacctcatacttgagccaacgcaactgtcaaatctaaacttcaggctggccgtcgagatcgaatttggcccatattagttagcggtgcagcaccgttccgtttcaatgttgggcctacaaagcgctcagatccatacccgcaaggctgcaacccagtttatggattcgggcgcaacccgacatccttaacggtcgctaaacccttcaacgcgaactggatagagtcgaacaccttcgtcttctaccaggcttcccaccgaaggagagagccggctatggccatggcggcctccccattcctcatcttgccatccttattccccaagcccaccatcctcgccgcgcgcatccaccccagcatcttccgaggccgccatattcgctgctccccgaacggcgccgccgtaccggaatcccctgaacccgccccacgccgcgggcgcaggaagtccccatccccgtcgccgccgaaggcgaagaccacgaggcgcaggaccaagaagaatacgcaggagtctgattcagagggcgaggaggagccgccgaagcggcggggccgtcggacaaggaaatccaagcaagaggccgaacaggaggcggcggagaaggaggatgaggtccgggcggcgagccccggaacggaggattcgaagagagcggtccaagatgaggatggggaggcggaggcgacggggagcgactccgaagacggggaggattcgccgtacgactggccgccgctggtgtgctgcttcggggcgccgcggtgggagttcgtcccgacggtgcgggtgtcggaccggcagatgcacccggacatatactccacgtggctgcatctgcagtgggagcctccggagttcgcgcgcgcgccggggagcgcggcgagcaacgtggccatcgcgctcaccaggctcggcggccgcgccgcggtgctcggcaaggtcggtgacgacgacttcggccgcgagcttgtgtaccgcatgaactgcgagcgagtgcagacgcgcgccatcaggttcgacgacggcgcggccacggccactgcgcgcatgaaggtcgggttccgggaccgtgaggacggcagcggcggaacgaggcttgtggctgagacggtgaagagcgctgccgaggactccctcagcaaggctgagatcaatgtggatgttttgaaagaggtgagtcggtgattttgtggtaaatgattgaaattggtgacttctgcatactccattgctgcatttttatttctcggcaaggatatccaccgctcagctgcggtacattgttgcattgaaaaacaccgactctatgtgagtagtgtactacagagcacaattgcttatgtctattcattagttcagttgaacatacaatggtgccaagccaaccagttttgcagattaaaaagacaaacaaattttaccctgttatatgatgtttatccttagaagatgaattttttatgtgcccgtgaaagtagattgtagaccgtcttttctttatttatgatttgatggaaagcaaaaaaaaatgaattttagacctaacgtgctgtaattgcaggctagagtgttccatttcaattcagaggtcctattgactccctcaatggaaagcacactcttcagagcaattgaactgtccaagaaatttggaagtaaaatattctttgatcttaacttgccattgcctttgtggaggtcaagggatgaaacaaaggagttgataaacaaggcatggaatgaggctgatattatagaggtgtcaagggatgagttggaattcctccttgatcacgagtactatcaatataagcgtgccaatccacctcagtattatctggatggttttcatctaacaaggaactggccacagtactaccattacacccccgaagaaattgctcccatttggcatgatgggataaaactcttgcttgtgacatacggaacacttaggatccactactacacacccaagtttcatggctgcgtgattgggacggaggatgcactcataactccatacacaactgaccggacaggttctggagatgctgttgttgctgctgctattagaaaattgacgtcttgtcctgagatgtatgaggaccaggatacattggagaggaatctgagattcgctgttgctgccggaatcatttcgcaatggactattggtgctgtgcgaggattccctactgagagtgctgcccagaacttgaaggagcaagtatatgtgccttctatgtggtgactggcggactggtaatcatttgtgattaaaagaacaatgctcatgatatacaagtgtatttcatgagtgctgcaacagaggtggtcaagggaaaagttttaccaaaacagcttacaggcttttcaggtatcatcctatcgtccgttccatattgtttcagtgttcagttttagttggaaaaatgtgtctgccacttggaggcttccattgctttacagttttgaagagctatgtttacctattgacttccatggtagggatgcaagtgtctaacccactgacccatgtcactaaattggtgcttctttttctgcacacatttatgttagtgataaagctaaataatcagaatgaagtcacaatttctgaaattgacttagtttcacacattcaaggaaacttaacagggaatgtgtttaagaattaagaacaacagtactctgtttgagaggaactggcaacatggatgatatttagttatgatatcgaggatgattgatatgaaatggagcaaagcatagaaatccaaaacaatcaactgaacttagtgataaaatgtttgttggcatcatggcagcacaaattcctaaagcaaacttgaaatgcaaagactcaatggaatgaaataaactaaaaaagaatttaccattcatcacttgtttcttcttgggtacatcctgctctctctatatacatcatacatgcctatctgaataaagctgcaattttgggatgaatacaaaatataaaaagaggacagactgtacatatggagtgtgtgaagtgtgaactacatacatgcactaaaaaaggtattctttcaagctatcccatcacttctggcacatctatgctttgctggtatttaaaatcttttttactcttccgtttcctgtatacttgaataaataatcaactggagatgcagatctcagacgataataaatggacctgcccctcctgcttccttttctatgaatgatggctgcatacactgttaatctaggaaaattatctgtgggctgtccctgtccattaccagtgtaattctttgttagaagattttgtgtttgtatatccatgctacatcagggaagtggttggaacttttgaagacaataatatcacatcctcttcataacaaatcagcgtcatttaatcctttgcattcttttgcacaagcagcctggaaggggatttgcgtagaagtactcctcttgcctaggacttcgaccagataacctctgatatggacccccaagtctgttttcatgatgtatcttcacttcactttggaactcattccatgttagtgtaccttcatcaagcttgtcaatgagtcccacaagcttctgcctacaatcagttaaaaaattcagctcttacaattgaggtataataattacaacattcctagaactgtacctgtctgggttgatggttttttggaatccttcaaatcttctgtgaccctgtactgctttagccatatttccatcatacgtatacacaaaaacatcactttggacggctacattatagtccaaggcagctaatctgttttggtatagcttgaaaggctctaactcatctaccgttgccagactataatgtgtatatatgtttggatattcagcctttaatgaatccatgctatgtccaccatatatttcacctgctacaatatagatctttgtgctggaaggatagcccatagctttgaggaaaagagctacttcacgagagtcatagggcagcgtccttggagtctcctctccctactgttgatttccttctctttccagtgccgcacgttgagtctcatttctctcagctcatctgcctctttatgtgttaggttgtggctgcaaccagtaaatgagagcatgtccttctcatacctgttaattgataagaaaaggaagtacattactgatctgcaagattatttgcagcaaaattatgtcagcttcacttaacatttccagtttcaatcaccttaagtgaagtgcgatataatgattggatccattcctcagtctatctactagagcagtactcagctcttcaatttctttgtggaatcttagtgcctcataatttgcccgacaacggagtcgttggatggatgggggaagaccattgttaacaattcgtgaatctgtatgtgtgaatttcacaactttggccttcttcagtgtccttgagaaagctctgtagtaagaagcctgcagaaaagtaactagcagttcataactcttcgactgcagtatattatgtctttttctaaataactttgatgcccacttgagtgattggtccataccttggcccaagaagtgggtgctctcatataaagtttcaatcctttataagctagtggcaaggaatccacaatcgaaatgtcaccctctaaagttttcttgaagtgttccacatcaaatatatctttgaaatcactgcatgttaggaccaaaacatcagttatatatcccagtagtttctctaggaccctcattatagtatatttatactggtcataaagagattaaccttggatcagtccaaaatgatttgtgatccagagtagggattactagtgttgcattcatgagcttagcaactgcaaccatgtcgcttatctgcatgaaagattttgaagcaatgtaagtgagctggaagtcgtaatcatcttgatatgtttaaaggttttttttccctaacatagatgtgtacatactcccagtctcatctggttcaatccaccattggcattaacaattatataaccagctgttgcactgttcattcctggcaagaagcatatgatatgtggttaagcgtaggcactcagtttaaactagcatgaacttgaaagatggagagtaatagcttactgtcatgtttcttcgggcgttcaatgcatttgccataaccttcactatctggcgtcatccatatcttcatctgttcattttgtaggtgaacttcagtatagagctcgttgatcatagaatattattactagcatagtagcatttcaaccatattttgctttcatgaatgggaaaaaacagctgattgaattaaaaaaaaatctctcttgtaattaggaacatcgtatatgacaatgatcatcctgctactttacttgcaggtctacagaagacgcttttaattagagggaaacaggtgataatcatgtttcatcaaataaatctttttcctagtgttctagtcatagaagcactattctagcacttagtgaggatataattgattgatgtatatttcccacttcattttctcatctttccttgtcgagggcatgggactagaattgcgacagtcagattttcattcctataacctaatgcagaggatttagatagccaggaaacactaggaacccactttttcttttcatttgcaagatttagtgcatctgttggttatttgtgtcttgaacctctgtttcaactgggcgatagtttcagtgctgaaacttgaaaaatgttttttctcctatgctgcttgattgttttggcactagcaatgaaatgaatgtttgtgtaacgctgtgagtttcttcaatgtgagtttcttgaaatgttgtagcaaatcccagctttgagtgcctggacatcaacatcaagcaatttggaagggcctcgcgctgcaggcgccaagggcctacataagtggcgttaaccttagggaatcactctcccgattgaattctgcaacggatgaccaccagcgataataactacgcgaaaaagaagaaacagcgatgtgctaaagaaaataccattatgctacaccacgggcgacaagaacaggcacttatccatcgacaaagacacggatggaagggcttcccctgtaacttctgaagaagaaatgtctctaccgtgttcagcgtgtttctaagcaagaatacaaaagacagctgagacctgaaggccatggacgctcgccatgaatttttctctaagttctatacttctcttgcgtacacacatggtgacatccagtccacgaagagagtaggttccaacacgtctgtgccaattcaatgtctatacccaggaacaaaagctggaacgagttctacacttctactcaaatatatatcattcatggcgcgtcataatttcctcttttcttaaataatcttgactctatctaccgtctagtatgtgcaccaaccgctaagcaccggtttgtgtgggattgattaaccgaaccgttaacggcgatacgtacttaccggcgtgtcaggtgactggcgagcaacagccgtcaagttctcctccgtccagcccatcacttcgccgtcaccgaggtccatcctctgcacgagcctcccgccgccggcgccgctcactcggtgcgagctcagcacgagcccggcgacgacggtgaggccgagcaggcacgcgaccacgttccgcagccatgcctgatcgataatcacggacgccctcttgctcctcctggccgacgagaacagcgccctgacacccgccacgccggcgccgtgcccgcggcgcactccgccgccgccgtcgtcgtcatcatgatcgacgtcgacgtcgcacgggccgccgtagtcgaacgcgtctcgctcgacgtcgttgagccggcggcggtgcgcggccgacaggacggggctggacgacgacgacgacgacgccacggacggcggcgccgcagccatggccaaaccgcgcgcggcccggctgacttttgccagacctaagtatagcacccgaatacctgatcacggggagcaaaaagaggccccggatcaaacagccgccgcgatgccttgccttcaccgcttcgtcacccgccacgagctcgcacctgcgtgcgcgccctcgcgaggacgcctgcgtacgtacgacgtgcaaccacgcccgcggcacgtagggggacgaggcgtgcgcgctggggattttgcacggaggagaggtggaacgaagtggaaagattgaggcgttcgcgtttgcgccttgggccgccgttgcacacgcacgcgcgcacgttcgctgtcgtgtgggtcgtggccgagcacgtcgcatatataggtcgtttttctcgcctttcttttgcgcgcgggcgcgacgcgtgtagattacattggatcggcggcttccgtaggcccgtgtggttggttgatcgatttagcctgacatgaattgcaatgcaccatgccaccaccggagggcacatgcgtccgaaggggtagagcgacgcagacgatgcggacgttgaagtagccctcctatccggggtcgagcgggcttgcatggttggttggtgaggacgtgaggatgagcctatccggcaccagtcagcgaaatcctttcattaatcctcgtctttcaatttagtggagatggtcctgcccatttagtgccatactgctgattttaactggtcttttagcaagtggtctgctgacaaatcacaaagtttttttttcttccattcgtttccgtggatatggcagtgcctgactgcagaaacgtttttataacaacggcactgccaacatgttgaaaagtggttcggtgctagccttctcccggatctgtgtgttggtgttgtcggtgtacgggtgacggtatattttttcattttttactggttatgaccctccagaattataatattataattttttcctactttattaatagaatttcgtatcgtttcgtgcgagtcattcaaagaaacatgttgagaagttattatcagcctgatgcagtggctcgcaagcaggacaggcttacggctacacgcgtgcgctatgaatgctacgtcttcgtagcctctgccctcttagtcgtgaggaatttctctaatttgcccattgattctcagtctcacccgtcgaaatggacaaaagaaatgccgtagtgaccggggaacttcagaaaagtgactagctaataggcatgtcttgtaggcttgttacaacgtgtgtatctactccctctatattaaaatataaccacttttagtactcaatatttgtcttaaaatataacaacttcttcatcaacattcccttcccaaccaattacagccctccaaccctcacttttctcatctacctccgcttctcaaccaatcacaaactcttcatatataattttacctactttcttaataaccgtgtctacctctaaaacttcttatattctagaacagatggagtatattttatcaacattaacacgagctcacacgggagattgacttataaaacggtgtgctggattaattgtcactttgtcagtatgaagagatgtaggatattctcttgtgtttgattggcctggggatttggatcaggtgcagtcaagtgcaaaataagcagtagcagtacacatcattggatacaccctggacggctcagatcacacaatgcactgttcacagcactgtagcagtaatattgtagcacgggtcactgttcacatgggtactatagctttagacctgagggtgtgtttagtttatgctaaaattagaagtttggttgaaattgaaacgatgtgatggaaaagttgaaagcttatgtgggtagaaaaattttgatgtgatggaaaagttaaaagtttgaagaaaaaacttaaaactaaacaaagcctgaataaaatggacggtcgaagttacgtgcaattgttaagcggatcccaattcttggcctgggcatgcaggtcgcccaatggaatgatggacgccaatatgtatctgaagtgggaatccaccagacggacacgattgttggccgccgcgttgggtctagtcgggtaggcgtcgctctcgatccgtccttgttgcattaggcgcctagaccgctagagacgttaggggcccatacagcatcatctcctgtcaccgagtaaccaaattaattaagccgcagaaagcaagcttgcttggtattccgtctgacttgggtcctccggaactaacttgtggtttgtcatttggcaccgaaggatgaaaacgcgatcatttttcaagagaagatcggtcggtattcatgacttagtccaagaaaggaggacacgcacatcgttacaatttgatagacgctcatttttttgtccaggaagcggagatgccggtcgcacctgcaccacacaaaccaatccgccgtggatgaaaatttgcgctgttgcgaccaccgatccaacgggagaagagaggctcgttccccgcgtcaaaccttgttattgtcggtttgagtctaactcgtacgtgcgacacgcgtcaagtttccgctcgtgtccccatcaggcgagtaaacaccaaattccacccggttgaacatattgttggcagcgccgagcagcatccatcccgtgaccgaacgaacgaaaagtacgatgacctgcattgacctgcacccgcgccgcgtgcgtgggggtctggctctctgctctcgtccgccaccggatcggacgtgagatccaaaagctatgtaatgtctcggccgcgggaaagccactcgtgaccgggcggcctggcaggagatgacgcggactgacggttggttggcagagccacatcacgctactgcgccgcgccacgggtgcgcgggcaccgcgtgcagccggcaagccccgcgtgcgccgatcgatccggtggcgtgtttcgcgccgaggctaagtgacggactgggggtttggcccgtcggtcacgctcacggtcacgcgacgagaggggcaatcggtaggccgccggcggctggtaggtaggcaggtcacagggccaggagcccagggctcttcactgcgttgccctgcgctttaactttcacaatatgccatctaattcacactactttcaagatatgccacctaattcgtgctattttcaaaatacaccatcaaagcgcgaatttccttcgttccgtgccactccgtttcttccgtccgtagcgccgtcgtcttctccgtccggtgccgccgccgtcagtccgccaccgcccgcgccggcgtccgtccgtcgccggcatcgtccatccttgtcggcgtccatcgtcatcgtctacggcgtggcgtggccgcggagagagggagtccgccaccgccggcgccgacgccggtgttagccgcgccagtgtccgtcctccgtcaccaatatcatcgtcgtccatcgcccgcgcttgcgcccatgtcaccggcggcgccgtccgttcg

SEQ ID NO: 58484 - DNA, 5901 bp, Oryza sativa
tactccgatggcgtattctgaaagtagcacgaattgggtggcatatcctgaaagtagtgcgaattcgatcgcatattctgaaaattctcccgagcaggaggcccaaacacatacatccagcagataaaagacgaatggatgtttggcaaatttacttcccgaagttcgaattgctcgcgataacaagcaaagtcgtatatgagacaacccggtttccctcgcgtccttctcccgtcttggggtcttggcgttcgtgcgacagtgagtgaatgagtgtctgtatgcgcacgctgcgcctgcgcgcttggtcatcgagatttaaggcaatctatcgaacacctgacgtgccgtgatcgcgcaatcccagtatcccactacggcatcatcatagatactacaggtcgttcatgctcaaggtccccgccttctcccagcgctaggcttctgcgtcaccgtgctcgagaatcatggcgattcctcctcctccggcgaaacgaataacgagtgaccggtgacgctgatctgtagttgcgctctgcttcctactttcctagtcaggattgaatccagtcaaggaatgatcttcggcttaaggaaaatacggtcaagctctttcgttttcagtaaccaacctctttgtctagttactttgtacccggctatggtcaatgagaattcagtgccaaactgccaatcagaaaccaagctgttgggctgaaggattatgtttctcttttaaacatagcacaagaacgtatagataactgaaaacacaaccgaagcgcagaacattgcagtgctaagactgaagtatatagacagtcagacagagcagtaagacggatgtcaacatgtttaactctaggaagacaagtatacaaggcaaaattttgttgacaactgtacaatgagatcaaaacagtttattgttttccaagatcagttcttaatcttagatttatatgctttccatgcttgtccacatgcctgaatatttgctgacgcttgatttaagaacttggcaatgttttcttcatatttatccaccaatgcagggatggtgagagcaagaacaaggcctgggagatagaaagttcagcaaagtcagcattgatcagtaagatgatactaaagatcaatacatcacatttgttattgtgcctcctttaaaaatatatgatattctatactgattggaatggctccaccacaaatttcagaagagttccttgacttctcccaaatttttgtactaaattggctgcacataatgctactgttaactaggcagataacagagatcccctttgccaagtcaatgtccctatctttgagaccaacttttggaaatgaataattttcacctattaagtaatagctcacaaataatttcggactgttattaaatgtaattactcagggtggttttaactagacatgaatatgacacagaccaataaatttcaacataacatttatttctatatgttctgcatgatatttctacaggagtctttttgctgtaagtttcaagttttgacacaattctcagaaaactaatgaaagtgcatatcatcactgcattgcacattacatcctactataaagttcttaacaacaataggtgagtagtgataattagttagaattgagaaacagtaaaagaacttacatgcatataccaaagtaatgagatcagtcacacggccaactatggagatcagcagtaatactgaaaccatcttgtaaaagagactggagtcctttccgtgtgcaatgttttcaaaaccctgtagtgccttatgtaggatgttacccactgctgctgctgctttgctcattgagtcttcagatattttgatcagtggaacaggtggaggtggcctgcatcgaatttttgtatgcctttagagtcagcattcagcaactagaagtcatggattagatcctcctgcacttaaacgtggaattttcatatcgcttgtttccattgttcagttttgagcatcaatcaaagcatcagtcggagcagctgtagtttataattggatgggccgctttcgttctgatgcaatggcattagctatgatgaacatatcagggcattgatcgagcaagataatttgctgcattgctgctcactctcttccaatttatatcatccacattagtttttacaccatgatcatttatccaccgactaccagtacattcacactcacaagtattaaatgtcaaagcttaatcaatccaagggccaaggccaaacaaatgatatccactccttgtatcaatagcaagtgtaacaactaacaacaaaagcaagtcatctaagggctaagtcgaattcagcaatttgtacaataataatctgaactaaatcacactagtgcatcaacaatttggaggcaaataaatcacattactgcaaataaactgcaaacaaaaaaaatccacctgttgagcagccgcgcggccttggcccagacgaagaggacgacgagcacgatcatgagcacgctggacacgaaggagagcagcgtgtagccaggcaagcaatagaagaggacccaggacgccgccaccgccgccagcgaccagccggccacctccttcctcctccacagcaccacatccgccactgcggcgcccacaaaacccaccacatcacaaaacgcaaaatgcaaacgaagccgcgcaaccacagcccgcaggggaggcgatctacggcgggcgaactgaagaagataactgagcttagctcactggcgccgccgccgaggaggccgtgcagcgatctctgggcgccgagcagccggcaaccttggtcagaggcatccattgccttgctgggtggatgaatggatctctctgatcgggggagaccgatcgggagttcagctggtggaaaggggagaaaagcgcacggcaagaacagcggcgtgatgcagaagtggtatctgctgaatcccccgcatactccaactcctcgagctttagtttggaaattgctgggtgacgaagaaaaagaaaaagaaaagtatgaaaaaggccaaggagaaaaaggcgcaagcgtggggcaccgccacgccacgtcatcagcaccgtgtcctattgaactttggggggtctttccgttccctacttcccttggctgtggcgctacagcagcctagactgttggtgtagctgcagcaacaacacaccatcttataccataatctctgcgtttcaaaataaaccagttttaagatttaaaatttatctcaaaataaatcaacttctacctaactaccattggtccgcaaattaaaaatttttatctcttcaaaaccccttacttaactattcagtaatataactttcctatttattaggggcattttgatcctttatctctttccttgtatctaccttgtgaagctagagttggacattttgtgggacagagggagtagttgctataagtacgattgttcacatacaatactatgactaacgttttccagcgaaagcccatagcctttttcaactgatttgtagcgatacaatatatgacgttcaccatcagtgatcagttaagaattgtactagtatttacatagaagtagcatgcatagtattttcgtatatcaatctcaagttctcaccgaacaccgctaggatgacggaaattcctgcacagcagtattgttccttaaaagaaatgctgtttttatcgttatataattttttatcagcgtcagactgaagtaaccattagatagttaaattgataaatttagaaaagatcctaatcgtattacctagaaataacaattgctaaccttcatgaaactgaaatttggagcggatttctgttaaaagtgggaccttgaatttgtgcgaagatttatgtcggcctccttgtcttctatcttcagcgagccgcaactcagacgggacacagcggccttgatcagttagggtatagggtgtgaggtcgataggagagggggaaaagagggtttctcttccccgaggtatagagggatgaccatggatgatttaggactgacgatatatggtggacacgggtggaggggcgacgctaccggcaaagtcatggggatggaaaagggtggtgggcggctaaaaccgttcatgcctttaggtgcccacaggcgaggggggcccgctagcgagctcacccctttgctatgccggagagaagaggaacaggagagaggataaggtcactgtttatgcacgaatcttgatgcaatccttggctgaaatctattcggtcacatatcaaatagactattcctagaaattatgtggtatccgaccgtttgatgagacttcgattagaagaggcacaatcgaagtgtgctaaatacagtgaaaacttcctagtagatgaaaacattggaaagcaatctataaaatgtgcataggttttcaagaaattttctaagaaaaaatacacgtttgaaaattgaaataatgccacatcatttcccaagcggaacaccaacaccaggttaaacaaaacaaacctgattttgcttgtgaaggatgacattggccgataatgtctgtcttctccgttgatccttgtcatatctcacaaacgaggccatgttttgatccacaactacatatttctcaaacaaaaatgcattcatacttgcatgaaacatactaaacatgcctgagttttgagctgctactataccatactgcagacgataacagaaaagatacaacagattcaagatcatagttgctgcagctgtaaaaggaaaaggtgtatatgcgaaagttgagatggaaaagaacgagacaaagcctccattctagtctctatgcagtttaaacataatgctacaaaagtcaagtttttaagcagggcagttcagacgatttgtatacggcattcacagatcagaaagaagttcacaatagcatcactcccccagtcaaatggagagcagttgaaatgcatcccctctttttcttttttctttttgttgtctgtatattctaatacagttccatcccgaatcatgccgtcctaatcttcttttatagattcttttccctctaaagaggtagtgttctgcttcgggttactgcctgaagcagactcaatattatcgctgttaggctcgcttgtttcagacttgttagccccttgctcctccagattgccgtctttgctcatttcacctgatgttgattcaattgcaaaagcatcctgagacctgctttcttcgtgagctgcataattagcaaatggacccccagtgtccatcaggctagcagctatagcagcatttaagtcagcttcttcctgctgtgcagcaatcatatccatttcactcatttcctctgattgatcagcaactagagagacgcctgcctgctgagtaggtgtttggacctggttacaagaggaggttatcctccgggcatcatcaggagtcagccactgcccgaaaccattagagccttccgttgccatgggacactccttaggaaaattgcccctcactgcaaagatactccagcctgaccccttcagggtgtcgatgaaagctgataggtaaaactttgatagatgctcaggagcagggtacagactattgaagttgtaccactctccatttaccttcctaatgcagaaccagtggtcctgcagatggcaaatgaaagcagtttccagctcagggtcaaataggcatgaccccacatctggggagtcaagggggataacttgcagatcccaaacttcaagtgccttctgcagaacctatagagtaagatgaaaagcatagttgagtgtatgaacttgcagcgtagtcactggaaatgagttgtaacaatatattagcttgagtaactatgcgtaaaaga

SEQ ID NO: 58485 - DNA, 3822 bp, Oryza sativa
tcgcagaagaattaataattatatatgcatgcatgcatgcacgcacttacttgtatctttgcatggcaagtagtgaagtacgtaacatgaaaaactgcaacctgccaagagaactcttgtcgacgtttacaaaaagccctctcacccaactatttcccacatgttgttaatttaaatgaacgtgcaactatggagtaaacagatgtagtcacatagtatttctgtaacttctcaagaagaaactatacatcaatatgcaatctccttcatcatcaccacatagtacttacattgttgcaacaaaaacctatgaacatattcctaactagcaaagttgtgactacaaaaaggaatcatgcaaatgctgatgtctaggataaatataaacccttcatattacctaaccatatagaaaggtttcaattaaaattatatgattttatctgcatttgagaacaatagtgtgggcaagttcctgtctcagacaaataaacattccttaccatcctcaacatgataacatattgaccactatgctataaatcatttattatttggaattccggaagccatctgagaatcttaaactagaatgtaccatcaacaacatgatacgtcaagcaaaccccccaaaattcgaacctacaagcctacagacaaccaaactcatttcgacaacaatctcactaacttcgaggttataggcctacaggcaaccaagttcatttcgacaacaatcttgctaaattcgaagcttacaggcctacaggcaacctaagttcatctcggcaacaatctcactaaccaggacgacagaagacaagcgaaaagaaataaataaaccccccacgagcgtggatggcggagggccatagacggggcaagccaacctggatgctgaagtctcctccaagggagacgttgtgggagccctcaccctcggcgaggaagtcccccgcggcggtggtggcggcgccggccgcgccctcggacatgacctggcgctcccgctggtcgaggtcgacggcgagcgcggagaggtcgaactcggagaagaagggcccctgcagggtggtgttcacgcagtgcacggcgcagagcttcccctcctgcacctcgtggtacagcagccccccgttgctcgccgccgccgcctcctccatccctctagaatcttctcgaaccctccggcgattcccccctcttctcttctaccctccctctacccctaccactgtgtagcgaggtagattcgaccaaccaaccgatccgatgggggaaaggttagagagagagttgagtgctgtacgggtcagtgcgcgacgcagattctcctgcggggaaaaaaaaaaccatcaaaaaggcgtcgccacgtcgaccgcgatcctctcaaccgtctaccacgtggaatttgcccccaaaaatgaaattgatatctcgatgcaccaaggctggtttagataaaataatttgaacaaaaacatcaaatcaaatgtttgacacatacattaaacattaaacgtgggaaaaaacaattacacagtttacagtttgcatgtaaattgcgagacaaatttttttagcctaattacgccataatttaataatatgatgctataataaatatttactaatgatggattaattagactcaataaattcgtttcgcagtttacaggcaaaatctataatttattttattattagtctacgtttaatacttcaaatctgtatctgtatactttaaaaactttacctctagacaaaaacacaccccaaacaaacaaagcctctatagtctatgctccatatgtatttgattcatgagtgaaatatgccaaggttagtatttcgatctatttagagtgcgacgtcaccgtgaaagaaaaggaaaaggcatcgggtgcgtggctccaccagatgtttacagctctctccacattggtagtccgtatactgtatgtaggacagtaggagtgtagtctatttcttcgctttcttttctttttctccctgagaagttgaaaaataatgtcgtgggcctagcccatagatgtccttcctctcaatataagtcgtgggccgtttcagtttggtgcgtgttgattgagctgtcattttgtttgtattaggcacatttccttgcaacagtagattgctatactataaatagatttaatttaagaaacagtagctatatgttttcgtgtacgaaattgctatttttctttcgacggattttttggggaaaatatttaagttttagactgttagatttactctgaaagatggaaaaaaaatcactaccactggtgaagaaaacgagcacaagctcatccctctaattgaggtacagtaacacaagcggatccaaggaccaccggaaaaaaaatcctaacctaatacatatatacacatatatttaaaaaattagaaaaagtaaaaaaaatactaactcccttattaatatattgttatgcatatttgatcaatttatacttatagctttgttatatttagggtatttctaaaaaagtataggttcgatcacccatataaaaatcccagatatgccactgtgcactaacacctatttctaatctcgagtccaagttgcacaatattgacataggagttacgatgcaagtaactccaatataattacactataattatatatttatatttgaaagtttttctcttaattttatgtggaaaattatatagctacaccaatgatgtgtttggataatgggaaatgagaggtaggattgagattgggaaatgaataaagggttaggattaaatggatgagggagaatgaatggttaagatttaaagaggggtggaaaatcatttccattagacatttgccaaacactgccttgtggtttattggttccagaagtctagcctggcaagcgtggcccatcgtactatatgggccagtttggcccaaacattagagagaacaaataaagatccaacaaatttctctgtgtctttgtcctggatgcctggtgcaacactctttctccaattggtggattgattcctctaatgaaaaataaactgaagtgggttgatgaatgatgataacctaaactatggacttgtgatgcagtgtgcgactgcgcactatccgtgtggtccgcggccgtcgccatcgagcatcggagcatggcgcattggcgcatctcatgcccccgcaccgaactcgaaagctcgaaaagtaggctacgctacataagatataaaatataagaatattttatcttttttacgactaaaatataataaatttgaagataaaatttcgcatgtagctacaatactattggaatatatgggtctaatttttttataattttatgacatttgctagcttgcgtgcacggattgtgtacgggaagcttatgtatataaaatatgttccttgtacacatataaatatataatataaataatagtgttataaaacttatatatactccctctattgttaaatatatgatgatgttgttgttttctgggtatgatgtttggctattcattctattcaataaattaatgtaagcatacaaaatatgattaaagtacttattaaataataagataaatcacaatggaataaaacatacataactataactgtttaaaaaagatgaataggtaaacgtcgtattcaaaagacaattgtggtttatatataaaattgaaggtacgtagctactgttgtttatttttcataaattcgatatgcttatatccccggccttcgtacgaccaataaacaataaaaagactaccacacatacattt

SEQ ID NO: 58486 - DNA, 3749 bp, Oryza sativa
gtggaaattatctcttttttttttacttttgttgtaaattgcaaaaagaaatttctaatttcctccatttaaattttagcatcagttatatcattgaactattttagtgtgtttgctggattgttctgatagttaagtataatttcatcacttaattccgcacccttaatagcaaaatcctgaatcggcgactgatgtgacagatgagcatggatgcatatatcaatgataaaatttatttcgaggcgtctacaaatcaggcgttcgatttttttttcaaaaatcggacgatgtttcaccaagtagatcgaacatgtttcactaaatagataaaaattttggaaagctgaaacacaaccaaatcacctcatgaaacattttgctacaacgtatgaaacaacggttttcaaaaaaaaaatcgagtgatgtttcaccctatataaaaataatgtttcagcaaatagcgaaaaaatgtttatattcactgcaacatttgatctatacatagtgaaacattatgagtatactgggtgaaatatttttggtggaaaaaaaaaggaacggattcccttaatagaggttttccataatatgtgggtgatttgttgcaaaaaaatatttcaattcactgcaacattttatacatacatagtgaaatatcatgagtacactagttaaaacattgttggcggaaaaaaataaaacggattttcttaatagagcatttccgtaatatgtgaaggatttgttgtaacaggaagagagtggggggacacgtggggggcgcccgatttttcttacgcgtgtcgggctcccgatcccggcgttttccaacttatttagttgtgatgttactagaaaagatgttcgtgcgttgcaatgggtgaatactattttaatcttattattgttatacggtttggctagggtgaaattcactgtgggaatttgcttggatatttttttctagaaaatattgagctgcaattaggagtccaaaattcataaattagcatgcaagtgtttttaaagagattttttatatgacaaaaagaaagcgtgggtgaatcgcacacgagattgtttgcgcgggcttgctctctgtttcgctgttaaaaaaaaaacaaatccgatcattgcggcatggatcaacgatctgatgtgttagggggtaaattgatacggactcacgatgcaaaccaaaaggatgacgtactaaatttattggcaaaaatattttcaatttttataatagtaaagaaaagaaaaagagagaagtcgtgttagtacacttctccttgcatgctggaccaaatctttccgagattatccttccccaaacgattaaaaatcctgaccaactttatctccacgttgctgagcagtgagcagagctagtatatctcggatgagcattgttgtttcttctttgcgagttgtgaacgaagttttggagccatcgactcggacaacgaatcggacaagtgcgtatggtgctatggtcatatgaacttgagaacagtcaagtggatagtgtgatcaaagtgatcatgagctcacgctaacagaggtggtctcacatggctacacggcctgcaccgctgaggagtcggggcacattaataacgattaaaccagatcatgcaacgcgatgccatcagttgcctttttctttctgtgctcctttatcactttatcagtgatgtatcgtaaactaatccttttctttttttccctgtcacgacacatctcttgttcgtcgtgtagaaaagaaaacgttatttacagaagtataacaaaaaaaaaatatagatggattgtggatttgttatgctgaggcgtgatgatcagagttttagacatcaaagtatcaaaacaaatatccagtgataaggaaagatataattttatcatatcgtattaaatctttagtttagttttagtaatccactgttaacaactacgatcgatgtcatgtgccgcatcttcaccgtccatcttctttcgagaaaggaatgaaaacggccacggaaggtcctaactaagcaagtgtcattttcatataagtgtaccatttctaaccatttttttattatagtactatataaattttgattttcctaatttgtttagcgttgttttggtattgacactgaatagttaaattgatgaatatgctctattcccaaccggctgagaatcattttgaatatatgttgcaccgtttcattcctatttctatatgcatttgcctatgcctctttatcctcgctgccccatgaaagtccctacctctttcctaatccatactcgtcgttgcccatttctctacaccttcttgatttgcatgttctcctttgttccctcttcgtttgcaatgtctatagattgcagttgatttgtggacagtcgttgatgccattttgtttgcaccaagctgttgtcctccccacccagttctttcccaccatttctgcaccggtaaccacgacggggctcctatttgccgctgattatgacaccggattgagaaggggcacatggcattgtgttcgtcaatggtcatatggactacatgttacgttaacgagtccaacaacggccgggaataatgttgtatgtccagattcataatattataaaatatcttatttggttttagatttttatattttaggactaaggggagtagtatttgattgaatgtagagattcttgtaataggattctttgtttggtttgcttgtattcttaattcgccgagctagatttgtccgcttcacctggtgcttgctgcagagtgcagaccacctctgaatcaggttggttatctgtttctgcagatgctttgaccaaaggattgtgcacagtaattgacaagacatttaatcagttattagtcaatattggttatgaatggttcaacttcaatttttagtaatatgttgtagtagtcagatactcccttccctccgtccttaaaaaaacaaacttagaattgaatatatcatactccagtttatactagaacgtatctgaaaagatctatctaaatttagtaggatatgttacatcgagtcttaagttttttttttaaagaacggaggaaatagttctcatcgtgttgttttatttattatcctgcgggttaatgacttcagatagttctcctggtgctgtttttatcgtccaggtcttggtacaggtttagtcagcaactatgatgatataattacgccctttgttctcctttcatgtagaagatgtagatgcacataataagaagggttaattggatcattgtaaatttgcttattaagaaaaatgacaatacaattcgtctattcatagtcatgccactagtattttataaaattaaaaccgtgccattaccgtcacgttttctatcaactccttccatacaacaccgatgagaagccacctgcggatctgccccaatgccacagcatcatcaccgtctctagccagagccgcgaaggccgcggcgtagctgctcctgcaccagggacgctcccatccacgaatcgtgggtaacgcaccgagagcggcggcgcacggaagccacggccatgggcggcggcggcggcgacgacgcgctgtacgcgcgatgcctggtgatcctgtacctgatcagcccgatcaccgtgttcctgctccggttcgtgtcggcgccgtacgggaagctctcccgccccgggtggggtcccgccgtgccggcggcgctcgcg

SEQ ID NO: 58487 - DNA, 3989 bp, Oryza sativa
  unsure (1)..(3989): unsure at all n locations
tcaacgcctacgtccaggcgcgctcctgggcgctagacgccgccgctccccacagcaccgccaccgccaccgccacgcccgcggccgtcgcccgctgcctcgtcgggctagccctcttcgcgtgggggatgcggaccaacatcgcggcggacaaggcgctcctgaggctgaaggaggccgggaaagggtaccagattccccgcggcgggctgttcgacgtggtcacctgccccaactacttcggcgaggccgtggagtggctcggctacgcgctggtggcgtggacgccggcggcctgggccttcttcctctacacctgctccaacctcgggccgagggccagggatcaccgccggtggtacgtcggcaagttcggcgacaagtacccggcgtcgcgcaaggcgttcgtcccgtacatctactgattcctctgttattgctgatggatacgtatcggccagggagtgatgcgcattgtgcttcacctcgaaacagcttttgattcatactgttggcatgcgcatgtggttctgttggattggaataaaaatgagccgtatcgtggctgtttgtcccgcatctatgtctggttctaccaattattttgtatgagcaaagctgcaacggtatattatgctattttaacgacgactcaaacatttcgtgattagtttgctttgtatattactcgctccgttctaaaatataaaaatttttaaacctcggcacaatcttcgagatgctgcttggatcaataatatttatataagtaagatgttttaaagaaaaagagttacatattattatgatagtttgtttaataataaatctagtaacatcaattttatatgattgattttttttattttttattaatagttaaagtttaaaatgtttaacttgatactacgttaaaaatatttatattttaggatggatggagtatgctatactgatatttaaatagtctccggggccagcgaaaaattgtcaaaacgactacgtgaagcatgaatagatcgttgcttcagaccttcagtgctgtcgacctgtcgtaatctaacacagctttggtctaccgcaggccgcagctttcgtctttcactagcgagtagtgatagtgatattgccgaggggtcgacgagagatcagaggagtttcctcactcccacgggcggtggacttatcaacataaacagtaaagaccaactgttagcagcataaacagttgccaaatggcaaagtgcatttaggctatatttggataacttctataagatacagcttctttcagattctccgactcctcaaaacagtacgtacctgttcagattaatgttaaaatcaaccttaccaaaatttagcgatactaaatttttgataagttgatataattactaaattttggtaggatggaataaaatttaaaattttctacgcgcgttaccaatattttataacaaactaaatgcagctatatatttatcaattttattaaacaatggtatgatttaaaatgacaccaatctaaataggccctacatattctaagtcagaggctaggtttctcagatcttacctagattcttatattttgtagttataaaatctaaaaaataaacaagaagtagaagctagatactaagtagaagctagatactaactagttgtttctcaaaattttaagccccgttgaaagggtatgtaacctggtggttaaagtgacctgagtaacacgccaaggtcctgagtttaaatcgcgaattttaaattgggttatttaagggctaagtttcctatttgataggctaagttcctaatttaaaaaaggaatttcagattgggttatttgagggctaagtttcctatttgataggctaacttcctaatttaaaaatggctgcatagaatttcagattgggttatttgagggctaagatttctatttgataggctaagttcctattaaaaaaggttgcatctatttgataggctaaattcctaatttaaaaagggttaattagatacatccattaaaaattcaccggttttgaaatatactattactatttgcgtatttggaacgatgccattgatatttgtttataatttcagtggtgccactaagacacgtattttgcatgtattggacgaaaatgccatcatcttctacctctctcccttctctcatcttcaagctctctctccccgctgcttcaactccggcgccgtcaccgccgctgctgctgccgctgcggcgccgttgctgctcgacgccgctgctgctcgccgccgctccgcaatgctgccgccgccgcaccgccgttgccgctcaccgctgccgtcgctccgccgccgctgccgctcgccgctgctgccgttgttactcgccgccgctccgcacgctgccgccaccgctccgccgccgccgctcgccgcccgccgctgccgctcgccgctcgctccgacgctgccgctgctgccgctcgctccgccgccgcctgttctctgagctgtggaagaaaggagaggggagaaaaagaagcaaagaagggtaatttggtctaaatttttttcgtaaatggtagatagtggcatatcttgaatatgtgtaaaattgtaatggcatggttccaaatacacgaatactgatggtatatttcaaaactgataaatttttaatggtatgtatctaattaacccatttaaaaaaggctgcatatatccaacaaaaatacccttctttaaaaaaaattaagctccatctaaatgaagcttaagctattttgcaacaagcatgttttggtaacaaagaaagataaccaaaaatttgaatcgttttattttgtgacggaagattccatccagtacatctcacaagtaccttgttccagaccaaatacatatatattagcataaagcaaaagagggttgcgttttccagcgcacttcaaagtgccagcttcactcgttgctgggttctccgcgctccagcttacaacggaagcaagtgttattcaccgtggatcgttatctaatccttattattgcataatatagcgtccatcttgatgagcttcgtcttggtgcatctcgtatttaggagacagggctagcagtaatgccccatatttcctttgcatactgagcgatagtacggtcgctgctgaatttgccacttccagctgtgttcagtatagacatcttgatccattttttcttatccctgtcagagaaacaggatttaatcaaagcattcagtgcaagaacagatagcaataagagcgcaatgttcttgtgtttggttgtctcacataggttgtgcagaattacatactggttgagttgtcatattaattgattgctatttgctaaccatattacgggtcgtggataaggctgagccagagcagtaggccctcaacagaagaatgcaaactgatcacattttgattactatagcaaattcagagcactaagagtacattaaaatttcccatagcattaagacctgttggagcatggttatgtttgttcaagaatttgcaatgtatggagtaagtaaatgcaaatagcatgtttgttatccttacttgtaggcttcatcaacctgggcctgtgcatcaatatagcttgggaaatcatagccaacgaggaaataatcaccacgaccaaatccagaatttccttcaagagaatccaagaggggagcatagtcataggtgccaaaagcaccactccttataagctgcttggcttcttcaaaacgtgggtctggtttgaactgttggtaacgtaagcaaggttaatgataattcatccacttgtgagaaatatataccagatcaataagctaacaataccaacaaattcaatttagctatttgcaagtcaagctcatctaataatggttgtatatcacttatctactagaaaatatcttacnnnnnnnnnnnnnnnnnnnnnnnnnnnnnnnnnnnnnnnnnnga

SEQ ID NO: 58488 - DNA, 992 bp, Oryza sativa
ttccttgttgaatctctgcatcatacccccattccggtatgacttgctgagtacagtgggtagtactcagtcttgctctatttctccccaatcccagagtttgagtttgtgtcagatggcgggttctccgaggagtaggcttcgtccgtgccgtcgaggatgcctgtggaatggtgttcccgctgcagtcaagtctaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctggacgtgacagaccctaaggacttcaggatggtggtccaacggtgctgaatctcagctccgtggaggcatccctcatcccccaaggggtcctcctcctctgctgcgatccagagcgcgccaatatcctggccatcatgcaggtggtcggggcgtcgggggagcgggccccccgaggccacgatggcgtgggcgggagcagcaggggggaacaatctacctcgggagggggtcgtgcttctgggccccgcgacgggggcccggggggcatccgtcctgccgacactcggggaaagaggaagcaggagggtacccctcccccatctcctccccgagggggcggggcggtgcgtgccagcagcaggcgtccggagggtgccgtgccgactccgcagcccgagggggagcgaaaaaagaaacggctccgcaagatgggggggatcgtgccatgccgggggaacctcatctcgcccccgaggtggtcgtttagccaacctccccgcaggttcgtccccgcgcccaccgcggccgtattcattctcccatctcccaaggcgagttttcactcacccatttctttttgtcttctggtttttcttctgcctcagcgagatcccgtcgcgccccccccc

SEQ ID NO: 58489 - DNA, 4012 bp, Oryza sativa
cctcccatagaaaaattcagtatatatgtgaaaaattcagtaaatactggtgcgtatcaaagttcagactacgaatcactatggaaagatttagtatacgtgtggaaaatgcagtatatgctatcgtctagaaaaattcagtacgtaacccatagaaaaattcagtacatactatcattcaacataaatcagaaagaacccctccattttaaaaaatgagtatatacaatcatctaacaaagttcagaacaaagctccccatatttttttgttagtagtacaacatatattttttttaaatttgcagtaagtactgattataaattaggttgttttttgtaaactacattttcagttagtagtagtatatgctatttttaaatatagtgtctccaatacagaaatttggtcccttcactggattggacagaaggaaacccatatgaaaaagaaggagctaggataccgatggaaaggtttgtatcagcatgttacggatttttacgattttttttgagccaggatattggtggtattttctgaaaactgattgtacattttcttttcagaatggtggtagataatgttgatagcagtgctgtcatacctcctgctgatcctcaaattcttactccgatgctgggacaaagatttaagactgagagggatgcctataatttttataatgtttatgctgttagtaaaggatttgggatacgactggacaaagatcacatgaatactaaaaagcagagaacaatgcggcaaatatgttgttctcaccaggtacatacattatgtaacaatatcttagtagcagaaatttacctaaataaagacttgacgtactatgtgttaatttcgaaatcttttatgcaggggaggaacccaaaaaccaagaagccttccgttcgaattgggtgcccagcaatgatgaagataaatatgtctggagctggtagtggctggtcagtaacaaaggttgtttctgcgcacaaccatcctatgaaaaaaagtgtaggagttactaagaattatcagtcgcacaatcaaatagatgaggggactcgtggtattattgaagagatggtagacagtagtatgagtcttacaaatatgtatggtatgttgtctgggatgcatggcggaccttccatggttccattcacgagaaaagctatggatagggttgcttatgcaattaggcgggatgagagcagcgatgacatgcaaaaaacacttgatgtcttgaaggatttgcaaaaaaggagcaagaatttcttttatagtatacaagttgacgaggcttgccgtgtgaagaacatattttggtctcatctgtttcagattgaactttgagcattttggtgatgtcatcacatttgatactacctacaaaacaacgaagtataatatgccctttgcaccatttgttggtgtaaacaatcactttcagagcacctctttggttgtgccttgcttagagaagagactgaagaatcatttacatggttattcaatacattcatagagtgcatgaatgggtaggttcctattggaatattaacaggtatgtgagtatttggccgaatttataatttggaatgaattcgttatactttacttattttaagtatatgatgggttattcattggatgcttattattgtccttaattttgcagacaattgtccttccatggcagctgccattagaacagtatttcccaatacaatccatcgtgtgtgcaagtcgcatgtactgaagaaagcaaaggaatttatggggaacatatactccaagtgtcatacattcaagaaagcatttcataaggttcttacgcagacactaacagaggaggagtttgttgcggcttggcacaaactgattagagattataatctggaaaaaagtgtttacttgcgtcacatatgggacataaggcgtaaatgggcatttgtatatttttcccataggttctttgctgggatgactactacacagagaagtgagtctgcaaaccatgtgtttaagatgtttgtgtcaccctctagctctatgaatggctttgttaagaggtacgaccggtttttcaatgagaagctgcaaaaagaggactcggaggaattccaaaccagtaatgtaagtatccactgtgataggtttgttgacctctttttatggatatgtgtaatcaacatttggtgtcgcttggtgcaggacaaggttgaaattaaaacaaggtcaccgatagagattcacgcatcccaagtatatactagggctgttttccaattgttctctgaggagttaaccgatagtatatcttacatggtgaaacctggggaggacgaaagcaccgtgcaagttgtacggatgaactcgcaagaatcattccttaggaaggaatatcaggtgtcttgtgatttggaaagagaggaattttcatgcgtttgcaagatgtttgagcataaggggattctgtgcagccacatcttaagggtatttgtttcttctactgtctaaacatttattttcattgggtcgtactatatgttcggtagtgtttggctttttgaagtaatgcattggtttgtccctttaggtacttgttcagtatggtttgtcaagaattccagagaggtatatactgaaaagatggacgaaggatgctcgggatactataccacctcatctacatgggtacaaagatgatgtcgatgcttcacaatcgaggagttacatacatgtaatgctgaaaaggaagactgtggaggtggctaagattgctaataaagatgtgcagacatttaagatggcaatgacagtcatgaataagcttttggaggacatgaaaaatcagttatctttggatgatggtgacaatagtagagaagctccgaagcgagcagctaggcataaatcaaggtctactgtattgactaaagatggaaacgaagatgttggtggaggtgatgaggacagtgagtatgacgtgccaagtgaggacgagggtggaaatttgactgctgatatacttccaccgttgaaaaagagaagcagaggaagacctaaggtgaataggtataaatcgggtggtgaggttgccagcctgaaaagaagaaaagaagtagggattgagaagaagaacacaaccaatgagtgtgagtccgttgagaagaaaaccaagtcattgatcatgatgatgaagtgccctttcctcgtaggttttgccacacatgccacgaagctggtcataattcgcgaacttgcggccggacatctacgtacaagagaaaactttagaatatggttccctgtagtttagttgggactcctctgattgttagaagttgttttgttttaagtacgtgaacaaatttttgagaggcgtgtgttttttcatcctatgagcaatttattaagattatgtaacctgtggattggtcagtatatacgaccttaagtaaagtatgcttctagtagtaaattgtgtcttttttgggtagtgtatttgcaccggttaaaaatggatgtctgctgtaattagtttcatttggatgatggtgctttctctataaagagagaaagagatatagtatactggtatttatgacgatcattgtttgcaaaaggagtgtgatttggtgtggatatgagttgttttttttaggtatggagatagaaattagctgtgcaatgtattgaatcctcccgttcactgaaatggacataattatcgatagcaattgactcgttatcacgcagagtcaatgacataatttacgcagagtcaccgcatatattgaatcctcccgttgaaaatgataaatggaagtaaatgacatactgttattgtttggcatagtgaataatttccatagcacagttcgtgcaactgtcattgcaacccagacgatactttgtccatgcatagcaatgttttcatgattctgtcaagataggacagaagtgtatttcgaagattacatgaaaatgttctggtaaagct

SEQ ID NO: 58490 - DNA, 6042 bp, Oryza sativa
aaatggtgtatgtactcaacgttacctgttggttgatccaattgactagcatcttttgtagcatgtgtggagtagtttgtgggtgtgtggtatcccatggcagttgtgtctccccatggatggagaggaccttgtatatcctcaatggtatcaataactttcgttactgctgcccttatcgctatcttaactgccgttgtaatattagtcttgaaagctctcttgaataggttagatgcgtgaatagcagtttgcatggtgcttatgtcgacgaaatctgatatggtaggcaaaatctcatcgatgcggtcgaatccatcctgaacgtaagatttcaactcctcgtatgcctgttttatgttatcatatataccacatgttagtttaaaatcccttgatcatgtgaaaattacaacttaatgaagaaacaatcaagtaacatagcatacggatggttgacatacctgtgacccgacagttccacgtacgtctaacgaagagaagtgtgattccaagaattttattaaatttttaccgccatcaatggctctagatgggatcttcgaaccggagcataagtttaggggagatagctctggcacatgggggttgttttctcttggttccttcatcaactgaacagcatgtatatcggaaattagctaaattttgcagccagaaataggcatattacagccagggtatcgtacatacctggagtttcccataacgagggaaggggaatcctgggttatgtttactaactacatcttgttgaatcatcctagcaatttgatcatcctcaaactgagaaatgtgacatgttttaacacatgtgatcccaaccttccggaactggagatttctcaaatattttacctgcaaaaatgattcacaatgacaatatgtgtgttgattgtatgctgcattaacaagtcagttttaaatgctaaccattagaaagatgatacacccgttaatggatagttgagccttattcggaaagcaggtgggcattgattctgctgctttcttcacctcatctacaacgaattgggaccagttgtactgttttatattgtcaacatcagaaacagccataatatacctaggagatatgaagtttgcgcaagattgccgtgccaaaagcttcgttgtgacataaagcacaaaagccgccatgaaaaccctcttttcatctattgtcatgggatacccatactgcttctttaggattctctctaagagtgatattttcaggtgtgaaaagtttggtatctcaaatatttcgcacaatatttgtttcttcccatccaattcatcttgagagcaagggataataggttgacctgagcatggcaagccaaaaactgcattcacatcattaggaccgaatggcaactcctggttgacatctttaacaatagcgcatgatttcggatcaactttgctcagtagccatgcaccaaactgcctgtttaccttagtaagcttgatatccaaaagtccatcaaacccaacttcaccaatcaactccttcttcctatcatcgaattctttaatgatattcactacgcatttgggctgacacctgcagttgataccaaaggtagtgttgtctttcttctgtctatttaaaactctgctttgccgatacctggataccacccgtgcagcagtcttatttaggctgccccttgtgccagaaaccttcaaagcctgcagataattagtttttcatttcataaatagacaatactacatggaccagtgtatttaaaatttcaacatatacttctattttttaaaaaaaacagcatacactcatatatgtatggaaagatgaagtacaaaatactgcgtagcaaattctacctatgtgtaccctcttaattaaaaaaaaatcatgtgcactgaaagaaaagtcagtatatgcaaagtttagagaatattactgtatgtaaaaaatcagcatatacctctctatgtaaaagtgcagtatatacttcttcgtaacaaggtccagtatgtaaaccactatggaaaagcctctgtatatatgtggaaaaatgcagtatatgctatcttctagaaaagttcagtatgtaccacatacaaaattcagtacatactatatgctgtcgtataacaaagctcagtacaaagcctcccatagaaaaattcagtatatctatgaaaaattcagtaaatactggtgcgtatcaaagttcagtctatgaatcactgtggaaagattcagtatagatgtggaaaatgcagtatatgctatcgtccaataaagtagagaataaagctccccacataaaaattcagtatatactattgcctaacagagagttcagtaagaaccctgccacaccaaaaatcaatacttaataccgtctagcagattccaaaaagttcccctccaaagaaaaaatgagtatataccgttgaaaattcagtacgtactaccatctacatttttctttatgggggtgggggctaaaacagcattaacttcatccacccaaaaaaccatcatatgcactaaaaggggaaaaattagcatctgaaactgagagagtacatgaaccgaactacacctaatccctctctacaggcatacatgtattcaatttcaggtggcataccttggactgtggtgacaaactaattttcctgtgaccctgcggcaaagaagaaaattttaggcaacgtgtcttgatcttgccgtacaaaaataaacgaatactaacctgctgctttggatgaaatccactgctatggcccatcgattttgccattgttgccccgctcctgcattcagccgactctagatcgattacttctgcttcaggaacacatgttgttgagagaggatccatcgctggaggaaggggaggagtcatcactggaggaaggaacaaactgctatctctgtaccgccgccagccacacagtcgccgctgaatcgctggtccgtcgccgcgctgacccccaaaaccccgaaagctgaatcgctggtccgtcgtcgcgcagttccgtcgccgcgccgccccccaaaaccccaattttcgggataatctgtttggcctgttgggagcaaaccccaaattacggaataagcagtccggtcttttaattagaaaaactaatcggatccaccgagccaaacccgttatgatgagggagggagtacatatctgatcgatcaaatgaacggtggatgggagagggagtacgtactccctaggagtatagaactattttcccatatatatatatatatacatatatacatatatatatatatacatatatacatatatatatatatacatatatacatatatatatatatatatatatatatatatacatatatatatatatatatataagtgaggagtataaactagtaagatggatgaattgtggcaacggaaccaaccgaaatatcctgcatgactattttataatttagttgttttaaaattttattttgaaaatgcgtatataaaaaaataaaaatagatcatctctcgatgctgatacatggtggtaagttgctaacacaaaagggatcggcgtcaaaaatatgtacgtcgagggtctttttataatgttaaaatgcaattattctttcttacaaataggcctttggtgagatcgaatttgacaaaaacgacctatttataagaacaaggaaaaagccctaataccctctcctggtgaggctgcaacattgttgatgtgtcctcctccctactggtatgttcctggtagccgtacttctttccaccctcccccaagggcataatcaataaatatttatcaagtgggtagtaagatgggactcacaaaactaggttataggcccggtttagatcctccaaaattttaccattttagagcactttttgccattttggatctaacactactagtaaaagttgacaatttatcatttgccatttgctagtccatagtagcaaattgtgccaaaacgtgctttgggaccactatttatctctctctctctccaccgaaaagtgctagaatagcaaaagtttagtatgcatctaaacaccaactagtatttttgcaacgtcaaaacttttgccaccaacactttttccatttgtcattccaaataaatctaaacatactcatagttgtttctacctcacacaatatacaatatgtgggtagtaagatatgacctacatgtaaagcaatgatgggatagaaaagagagagagtgagtgagagaagagagtttaatatttttttatgcttgttaccaggtagtagtgctattgcctggtatagttattatctgctctactatccatattcacaatggtaaagtaggtagtaaggggtcttactacccacttttcatccacattgtgggtgccctaagtcatcacctgcgagggatggatgggctatgcgtgaggaacgaaacgactcggcggagagagataaagggtgtgtttagttccacgctaaatttagaagtttaaagaaaaaagttggaaatttatgtgtgtatgaaagttttgatgtgatgaaaaagttgaaaatttgaagaaaaagttgggaactaaacccggccatacactcgtgtatgggaggagggaacacgtcacatggcttgaggggcggttggggaagtcgtatttagagcaggtacaatagcaggttataacctagctgcaaacatattttaataagataaatgaggagagagagaagcagcgggctatagatttgtagccagctgtagcacgaactccaaaacgaagtgtgtgtatgacatgtgagaccagttattaatagtgtagtatgtaagccttaggccgtgtttagtttctgaaattggggagaagtttggggaaagttgagagtttatgtgagtaggaaagttttagatgtgatgtaatgtgatgaaaagttgagagtttgtggaaagtttggtgcgaactaaatatggcctaaacttgctcttatgcggtagtgcgaggggcttcctaggggcacacgaggtgcagatgtggagagaaatcttatagccaacaggttgggattgaatgccatttgaagtgttcgagagaagccggaggggaagaaacgcacacgcttcatgaacggaaaaaatctattaaaatttactttaaaaattatatgaatttattttaaaatttaaaatgattaatattatgtaatggcttatctcgtttgatgtccggtactctcatttcaattttttctcatatctcaaacaagtgcattgtgaacgggctaatcatttttttttctctggtacgatgggacagtagtaatgcttctgccacattttgtcagttgcatgcagggtaaagacagtgctttcttcatgtgtgcgcgctaacttttctgcacaaaccggctggcagagcaaagcccggggaagggaaggggcttgcttgccgagtgccttgcctgccgctgcctgcttgccttgccccgcgcagtgggagcctgcgggcttgcttggagacaaatgccatcacccaccacaatccccttcgctttcatttctttcctcagcgttacgcactcagctgcgcgattcaaagctagcgctgcgttgcaaactgctggcgcaaggctgcccattcctggagcagtggcgcggggacggcacgagctgccaaacaacgtgggccaacgtgcggcactgcacttgcgccggtaccggtaacaacggcaatggctgtcaaaaaggcgcgccttcctcgcatagctaaaaacgaatccaatgcgcacggacatttcaaaatatactacaccagaccgtatcgacagtataagctggccggctggcaagcaccgttctcctccattttgtgccttttagtacatatgaaatgtatttttcctaccgacagaaaacaaatctttttagtcagacgctcctttttttcggaatgacataaatttcagattctttgtccgctgacgtggtttaggggggggtgtttgggactttag

SEQ ID NO: 58491 - DNA, 24061 bp, Oryza sativa
ggtgaacggaacgtggtggtttagggccgaggcgtccgcgaggtgggcgcgaggtggcttggctggtgcgcggtgcgcctcgccggttgcaaaaaccgcgggagttgctgccctgggagcggggcccaccgggcagcgagctcggtgtggaattcccctcgaccggcctgatgcccaggaaagccagggcacgtatgtttcgaaccacgtattccagctgtcggtactcgtacgacaatcaatgtcattgtaaagtagagatacgtactccctccctcgtaaaaaaagtcaaacttgtccaactttaactgtctgttttatatgaaatttttttataatttgtatttttattgttgttagatgataaaacatgattaatattttatacgtgacttgtctttttaatttttttcataattttttttaaataagatagacggttaaatgttggacacggaaaccaatgtttgtctttttctgggacggagggagtatataggagtatgtgtacgtggggtacggagtacattgtataacatgtgcatcatagatggcacgcattttggctgctgcattgggccccccaccccagcagtgcgtagttcgtttccacgctcaatcttagcggtgaccatcaactgctcggctgggccacaccacacacacctacggagtggccccctgaaaccgcaaatccacccgcgaatgttcggctgcgtttcactttcatagtttcatgtcatccaggttagtacctcttgtacagttgtaacgcgtcgctagccgggtatacggctgggcttcgggtctttgggttgcgcagtattttcatacgtgacgtgtttggctgctgtagcgtacataccaggacagacggtacaaggcgcgaaactcgcgcattaatgtgcagaaccaggtcacgaattgaatgcggttgcaaacacgaacatgaagccctacaagaactgcggcccggtgaaagtctcgtgacgatcgtgctttacgccacatcgaccaatttaattcgtaccacgcctatctcgccagtactctcccggattatcgagtaggttggcacccccctcgcaaaaatggaaaacaagaaaccgatcgtaccacaaggagtaggactggtgtagtacattaccatcagatgttgatgtgaacttcaaaccttttttgttgttatcatgtggtttttttgtcaacatttgttgaactactactaccattttggtggggggagtgtgttgtcttaataccaaaggaaaatagccacaataagttagatgcatttttcagaaaaaaaaaggaccaattctcaggaggaaaacacattactattatctttggtggtttcaaacgctagtcctaatcacatacactgactaccttattccagacactcggttactcatttggccctgtttagttcgcgaaaagaaaatttctagatgtcatatggaatgtttgatcagatattggaaggagttttcggatacgaatgaaaaaaaactaattttataactcgactgaaaatcgcgagacgaatttattaagcctaattaatcttttattaccacatgtgggttactgtagcacttatggctaatcatggattaagtatgcttaaaagattcgtctcgcgatttccattcaaactgtgcaattagtttttcttttttatttatatttaatattctatacatgtgtctaaagattcgatgtgatgttttgaaaaaagaaaatttaggaactaaacaaggccaaaatttgcttcccaaatagtcctaactccaagtctttttttttaaccgtaaacaattcatttggcatttaaagtttacggcagatgtaggccctcttggatatagctctggatccaattttttttgttacagttgaatatttttagctttacaaatttaaatctatgattacgtagataacatttggataatcattttgtttccatgtcatgtgaaatttataatttaaaatattatagttttacatacagactttaagtttatcatggaactgagataagctatgcctatgcctgagccgtacttgtgccgttgtgcggttaatccgtaaaaataaaaatcagacccactaattacactccttccggctcactttataaagccacccaacacaagcagagatgaggaccgctttgacctccgtaaccacagccgctcgataaaatccccagccgtccttggacattctcccctccatcccacccccacgccgcttcccctcctccgtccatccgctttccgggggataatatatctcatctcatcatctgatacttcgcgttttgccttcctgggtcccccccatcgctcacacagacgaggaggacaggaggttggagcgtactagtgctggaggagggaggcggggaggggagccatcagccatcacctctcctggccctgtacgtgccgctgcctattattgtttcttccccgcgcggcaattcctggccaacaccaccgccgtcctatattacccctcctcctcgtgtggggagtgggtgttccgtccacgcttgcagcagccgcgcggacggaaggggttgtgttttcgtgggccaaatggcggaggtgtgcacccctggcgccgccgaggcggagttgtggctccccgacgagttcttgaacgatgatttcttcaccgtggagaagaagctggcggttgcggccaagagcgagagcgacgaggaggacgggttggatggcctcgcgcgacgcatggccgacctcctcgccggcgagggtgaaaagggaacgggttccaaggttggttggtgtctcgtttggccttgttcgacatgctttgtgtttgcgccttcgttgtagcgaaatctgatcgtgttcttttgtttgtgacaggtggaggtgatggcggggtcgccgcagtcgacgctgtgcgggttggcggcttccggggaggatagccccaacggcggtgcgtcgcagttcagctcgccgccgtcgtcgccgctggagcagccgccgacggacccttgggacgttctctccgaggctgccgggcaggttgctcgcctgcgcatgaacagcatcccggtgccccagaagccccatgcgcatgccggccatggccgcttcgtcccacctgcgagaaacccgtctccgccggtgcaagcccagaagaccgccggtgccttccagttcgcgcccaacaacaacatgctcacccaacgccaggttcaagtcgctcatgtaagttctttcgccataaatcaactgttccatgcctttctgtttgattttgtgactgttctgatgttctgttcgtctccgcctgtttccagttccacctcctgaagcagaggcagctgttgaagcagcaacgggagcagcagctcgccgcggcagcagcggcggcgtggggaacgcaccgcgccggcgtcggcgtcggcgcgccgcttggtctgaactcctccggctggccaccgctgcagaaggcccaccagcaggcgtcgtccgcggccggcatgcgcgccgtgttcctcagcccttccggcggcaaaacggaacgcacgggcaccggcgtgttcatcccccgccaggccggcgcccccgccgagcccaagaaaaagccaagtgcgcacctcctccgaacctcttcctttacctgcccttttttgcgtgagtcgcgccgtattttgggctaaaattctgcggctctgcttgccttcaggctgctccaccgtgcttctgcccgcgcgcgtcgtgcaggccctcaacctcaacgtcgacgatcttggtgcccgtccttgctttcccggcggtttcgttctcgaccacggtaagttcactccacgcctacaatttttatgttacggttcaccaatgagtagtactcctgacagtttcctgattcatttctcacagacgctctggtcagtcggagcaatgcaatgctcaccacccagaagcgggtgcagcaccacctccacgcggccaccgcggcgccgcctacgcttgccgctgcgcgcgaggtgaatcttccccaggaatggacatactgaggcgcagatttgcttcgttcgtctgttctaatcccagtttaatggatcatatttaagaattattactgctactattattagtgctaggtaggtgttaggctagaattaggaatggcattggcagtagcatcagtgttaggtgttcttttgtatggtgatatattggttattttggaaggtgggtgatggatgcagatcaacagatgagaaatacatggcttccgtaggttgttcagggtattgacggtgatatatccaataataagtgttcttttggagaattgaatggaactccatccgtcccataatataagagattttaagttttcatttgcaaatatttgatcactcgttttattaaaaaaattttgaaattattatttattttattatctatagtactttaagcataactttttgttttttatatttgcgaaaaaaaattaaataagacgagtggtcaaacgttgtaagcaaaaactctcaaaatctcttatattgtgggacggagggagtactatgctagttagctctatgccagttagctctagtcgtatgatgattggaagaaatcatcagatgtttgaaaagttgtaagaaagaaataataagagcttcagatttcctttaacactgcgtttgctgtgttgcctttgtctcatcagtctctcttgcatctttttgaaatatgttgcttcaagagtcaggaactcacatgagtatacagtttattcgtgtaattgtgcatcagtgcttccccttccacttttttttttttttggtgcatagcatattgctctggctatgtatatgggattctgatttgggttgggcgacagtttctgtagttggatggatgtggagtagtaggaagtacagaggtaaaacgggtggttgtggtactcaacctgttcgatgtatcttgacaagtctaacatatgacgtcctagttgcttaacatggtggtgtcttatttctttggtctatttttagttccaatcataatcaactggtcatctgccaccgaagaatctgccctggttggggcccgggatcttgcatcttcagcttcctgtcattacctaccgacggcgacgcttgtgctgcaacttgcgaactcgcaactccgataattcttgccaaattggttgcgagattaataacacagcatcacgagatcacggcttgtgttgtgaatttccccttgggtcccccgtcacagcaccaagccacaaagttaaggtagatctgtcacattttaaacgtaacaatgggtttctatgtacttatgtactttcgttttatttaaaatttatattatcatattattgattgttcatcttatttaaaatttatattattatattactgtaggatcagagtaatatgtcatgaattagagcatatctaaagtagtgaaaaaagtaaagtgtttcgtcacctcattgcgccacgttatcaatttaataatgaccgttggatgcacaatgaattcaacaccagccatcagatgtgaagtagtaaagttgagtgaaaaaaaaaatctggaccatggtagaatgctccagtggccaacggtccatggtccagccgaggcgtcgcgaataggagaagccgtcgtgccgtataaaaaagaaaaatcaccgagcaggtgaaaaggtccgaaaaagaaaaagaaaaaaaattatccaccgctgcctccgccgcctgcccatctcctcgcttccatcgccgcctccccattgccgtcgcctcctccacctccacttccaccctcctcctccaccgcgcccactcgccccctccatatccacgtcgttggcgcaagttcctcatccgcctctgcctgccaccacttcctcctcctcttcccctctaccaatgccgcctctgtctccactacctcgtccccgtcctccacccacagatcggtctagccaccgaatcccgctgcggcaggaggccgcccggcccgctcgccgccatgaaatggggcgccggcttctaccacatctccgaggagacgcaccgcctcgccggtgagctctagggcatatagcaaactagagatgttcctgttgattgccaaaaagttgagtgaattccacgatcttgattccttgatataactggacccaagaagctagaagctgaggtacgctggttcgttgattctttgtctccatcaatgacgagagctgtcaaagatcctcttccgaaataaccagatatgtgattttatttgcaattgattcagtagcttttcaatccatacatatattctgaaatcaggcaaacattagctacggtaccaaatcattgtctctgcattttcttttacatttcctcacagctagcttgctcaaattgttcatatgtttaaccacacctattggatgtctcatgatactcataatataaccaaggaaagctcagataaaatatcatgtaattttgtcattgcagttgcaacaaattttgaagttgttcagattaaaacagttaatttttagctaggttcatttggtttcatatcagcagtaatctcaaacatcagtcaaaatactctgatggtaccatggctgcaatatgctgattaaaaatggttgtttcccctgtcactgaattctatctgatgactacatgacctgcatgccaaccttcagaatttctaagcataaatactccgcctttctaaatagttggaatgtgtatagttaaatgcttcattcacaatatgggtttttaatcattatataaaaaatgtttttttccttgatgggtgtcttaaggacagtcctaatagaagtcaagtataatccaattcatctcagattatatgtgacatattaatgttctaaatcttaactactttcggctttatctccttcaaaagggaagatgatgagctctgtgctatgcatatactctctccgtcccaaaataagtgctgttttgcactattcacgtttaacgtttgaccattcgtcttatttgaaaattttttatgattagtatttttattgctattagatgataaaacatgaatagtactttatgtgtgactaaatattttcaaattttttaaataagacggacggtcaaacgttgggcacggatatccacgactgcacttattttgggacagaggtagtataatataatatgaacttgatataacactggtacaggatggaggcggtttgaagaacttcctagctaaaggaataagtgttaaagtaatattttcctattattattttcctgaattagtaaaagatgatttatagtcattgttatatttacttaaacagtactccccccgtctcatactacaagactttctagcattgcccacattcatatatatgtcaatgaatctagacatatataggtatttagattcattgacatctatatgaatgtgagcaatgctagaaagttttataatatgaaacggaggaaggagcatattggctacaagcagcacaaatatgttttcgcatgtgaatagatagatgggatataggattgttttgagtttatattgaacatggaattgtacattacaacatcaattgtgtaataaaattttgaacatatagttgaggccatatgcttatcaacttaggtaatccatcaatgacgcttaatgatcaaaattcaaaacaaaccaacctattataacatttccagtataagagttttcttgtatagggggtttaaaatgggtatctaaagtcgcgcaacgtccgactaggtggctagtaatattgattttaatatatttaattgttttttatgtaaacttagtatatttattcccattattttcaatttattttattttaaataatatttgatagtttcatagcgatcgcagtatctggatatactctctaaaatttgataggatcatgtgaaaaatatcgtttaggctcgggcactcggtatataatcgtgtggattaggatacagataaccttgccaagccgggcgtttggccagagttttgggtggattccgtttcggcagctggctgtttcctgtcgtcttttgttgcggcgtgtcgtgtggccgtggccgggcaggcctctgaccggtcaatttgtaaagctattatctcgtgtggcgtgccaagtccttttgttttcggtttgtaccaccttgccgtcgaacgaaacatcgggttctgttcaaatttaaaagagaaccttgcccggcgccttgttgggaaatccggattttcttaacgatgcctttacagcaaagctgatactactactaatactaatccccctcctaatcccctgttcgaaggcgcctttgtacccttgctttgctgcaccgtacggtaggcagtatagtactagtaggatggatcttggtgtcatgactgatgaatgtgcacgaggaggctagctaggcgagcacatattgttaggctgtcgtgatcggtggaaaggttgggttttgcgttgcgtctgagctggtgcaaccggcgcccatgtggccgtcaggttgccgagagccagcagttgggcggtgccacggccactttctctctatcgattggtctcggctcgttgtcgcgctggttgcgtcatttgcatcctctgattgctctctccgttctccagatcaaatccagcagcggagcgtcgtaatgcaggtgtacgactcaagtagtagaaaaacatatttttgaatcaacaggctacgaggctagtatttgatggagttgtactggagatcctaggggcactctgtgtactggagaattcaaaatgttttggcggtactatccgtagcctgggagacaagacccggacctggaatatttgtgattgtgaagaaagttgaaatggcagaggcgggaatagaagaattctctccaatgtgtttagtcaactgtaatcggttatatttaaacttgattatgttctgcgcttatgtcacgctctcatggctgattgctggaggcctggcagactgactaccatggcaattaacaaaagccgaattacgtctgcggaacacaaatggagcctttgtgcttacctaccaagtctttttcatttttcattgctcacaaagtcaaatactagcttggagcgttattttgttaaccacgtgaaaaaactttggagcgtttgaggctgcccgccaagagagccgagacgagcgcctgaacgtagacaaagcggaaaaggtggctcctaggtaggagtatgtgcatgtgtacgagtacgagagtacagttgcaccagctgttttctgtcggacttgcatttaaatttgtccatcaccttgggccatcggctctttccccaggaggccaggatgcacggagcgatggattattggtgttggtagtttctcactgcgaggggaccggtattgacaacaggtcagcaatgcacacaaccagaatctagtgagacaatccggtttttaattcgtgagcctttctgtttctttcgtttgggagttgggaccatggtccagccctgcgataggagcttacaggcctgatagatttggtgctggaattaacctgtgtccaattatcttatcttctctagccttggcggccctcctctaattgtaagcgaatgctttagaaggttgagtttttttttatggaggaagtattttcataggtaattatatactccatccgagctgataatattagtcgttttagacaagggtaaagtcaaactttaaaatctttgattacaaataatttctaaaataattatcttaaaaatatgaaaaccatatttgtagattaatctttaaaagtacttcaataaaatcatatgtttgttgatatttttatatatattataatagaaaatagttgtcaaagttactttttgaagactgtgcccctgtccaaaacgacaagtattatcaacccggagggagtatcttgatttcccacctgtcaccagtttagagaagtcctggtggcggatgccaaagctttatttgactctcttgtgtctccttggctgctgtgttgcatacataatttagacgtcgttgactttttaccaatcatttgttttatttaaaaaaatatacattattatcatttattttatcgtgacttgatttatcattaaatattttttaagcatgacataaatgtttttatatttatacaaaagttttgaataagatgaatggtcgaaggtggataaaaaaaatcaatggtgtcatccgttgaaatgcgtagggagtactacacaaagtcagccacttgtcgtcgtgttggcgtagaacacgccatgcttcccagaatatacagcaacgtgccaacgtgtggaccgcatcagctgatcagcatagtgcagcagaatcagatacggtgttccatcgatcacccgatgctatagtcaacagaggagtagtactacactactacatgctcgcgtcagcaatcctctttgatctgatttggtccggggctaatcacttcatcggatgatcctggtttgcgagcaatcttctcctcatcctattgcatgtgccgccgggtcgtgctgccggtaggccacgcgatcgatggagtgacggcccactgcgcgcgcggctgcggctcggttcagtggatacgtgcatgcacgcatccgcaccgcaccctatgtgcccgaagctgattattccttccgtcgcccgccgccggcggccggcagcccggcaggctggtccggggcccaagtcacacgataaaaacttggagtgcaatctagccttacgttattcgagtggatgcacgcatgctttccgatatggataggtccgcctccgggaaggtcgggcgttgtgctcgagtctctgattttctggcccagtggtgaggaggctatgtcaggactattcgcttctaaagcccgtttgtgctgcatgaatccatatttgggccatgaccactgatggctttaggcccatcattaagcagtcatagtatttgttttgctttgggccctcgcagcctactaaaatctaagttcttttttttttgacacaactaaaaatctgagttagttcaactgatcacacctgaatattctttgacagagttgggcgacacaacaggatatgacagtgaacatttggaatcatctgttcgtcacggtgtcaaatctctcgtcatctcgctatccacgagcgtctattttggggactatttatcaacaagttgatttactgatcctgatcctcgaagtaataatgacgactgggtgattgtcgcctgttgatagttgctattgtctgttgatatgtgtacagagcactacaaggttctcttcgatatacagcgtctgataaggactaacgatgtaggcgaaacaactgcggtggatagttccactttcatatgttcttgtacctttatcttttcagtttgttctcttgaactgttggttcaaaactccccattttcaaggagatccaaccgaatttgctccatattcaaaattcgccagcatttcctgacaaccttacatttaaggaacacaaatgccctccatcctcatcaaacctgatgcaaactggatatcttgtgtcagtttcaatccctctcatgttgatgttcgttcggagaggaaggcttattatgtgcaaaactctccctctccttggggaaaagaaggatttttgccccaaaaccgttccattttattccttgtacacgacagtactagttttggatgtaaaactagctagctgagatcgtgatcgtgctcgcaaaaaaagaaaaaaaaaacgccagaaacgaaccgctgtgaaagtgcgaatcatgatcgagaccgcagcgtgcgtgtgttgatggctctaccgatcgctacgcgtcttcgacgcggatgatgatgcctcgcctttccggctgaaagcacctgtcgggttcgaacaaaacaggcgcccatctgggcaaataccgcggcttctcgccgtgcccctgtggcgtctgcttgtccatcttgcttcgccgcgactgcaacctttctcctctaattttcatcacctcctcgctctggacgcgtacaactttagccgtccaagccagcttatccgccacgtgtgtgcatgatacgccatgatactgctacgcagatgattcggtacagatgtgtatgatacggagtattaaatttggcttggccaacggcacatgtcaaagttgctgggcgcagacgtgcacttgtcatcggcttgtcccgtagcagcgtgtgatcaccaccacgttcgcgtcacttggggttgtttggttctccatgtttccatctccagctgtgtcggtttttttatgaaccccgatccggatcgctgggatctgcatgagaaagcagttaacaggtagtagtatcaaagtttcgagtcatgttgagaacattcgaatttcacatggggaaaataggtatcggaatgacaaaataagacttggcttggttccctttcgtattctccgagctttgacttggaatggtattacaaggaaggtggaatttgcatgaccggatggttattccgcggatagacagcgtacgctagcttggtgccaacctagcacagaagatggaacgatggattagcaaagtttgatccttcgagagaaggatggcaccggccggcctctatataatgttctatgcttcgttttcaataaagaatttgtggtgtgctacataggagagtacacattaattgttttgtatagtatcggggtacgtacatttgttgatatcacagcggacaacggtcaatacatggaataaacaagtacacgtgctatcttcaatcacaaatactgaagatttatatgaaaaaaaagaattccccagcaccaccagaatgtagacgtatatatcagttaaatacttaaatgtccctataatgttaattgatactaacagtaaaatatgccaaactaaataatttgtgcaggccaagtttgagtaaaccgggttaggctctggttggctgccgtagccaagtctaattgaacattgataaatacgtcattaggacattgcaaacttcttccaaaagctctttgcggctccattgttgccgagtggcagatacaatcatacaactgtatggcgcacatgggacgacggagatcattggcaaagacatcttgtagggtatattatttttgctgtaaaatatattatatttatattataatcgcataaaaacagattataatcaatacatttaaacaccaaagaacttctacaatgatattggcaaaccgcagaaagcaaatgcgtagctgtgctcgtgcacggcatgtagcacatgaatcgtaatcaccccacttgatgatgcattaaaaaagattgagcgagttagaaatgaagacaagcaatcatatacacaaagatcatatgatgatcgatacctcgtgtatgaaatattactccgtcccaaaatgtaagcatttttaagattggcacgggtattaagaaagtaggtgagaatgattgaaaaatgtgggtgattggttgaaaagagaaattaggtgaaaaagaatggttgtgattggttgagaggagaagataggtagaaaaatagctttattttaagacaaagtattgtgctagaaataactatattttaggacggaaggtagtacctaattgatctaatgggctgatgtcgggtcggtggctatacgctatactagggcatgtttctggaggtgttggtgtcacaggtcgtggttggtctagtcatctcaccctacgtaatggatgtgtctgttcctacctatcagaaataataatgttttggtatttctatggtaattggttgtaaaaactaatgcactgttttgtttcaaattaccttttcaaactatgactattaataatttctcgatttattttggagggtattatcgtaatgttataaacctattagattttacaaagttattttaacacgaatttgatgaacaaattcatcaaaaactatactccctctattccaaaatataaggcacaaccactcttaacataaagaccaaaaaataattattatcatcttgtagtttgaatcatcctaataaatataatgcatacatccaatatgatcagataatatgagagtggaagatttaaaaaagtaataatttaatggagaagatgccatagttaattgcatgcttgcatgcatgccttatattatataacatctactaaaagtggttgtgccttattatggaacgtagggagtatcaaatattgcgaaaaacatcaaagatttgtaaacagaggaagtacaaaaattaagacgaatgttcctcacattttcttgaatttcccgttcactagtatttcgtgagacatatatcgatctagtatcaattttctataatatgatactactacatttaattccatgaatggaaccctagatgagctggaacttggattcttggaacattggaagcactggtaaccaaaaaaaatagcgcaatcctctaaaaacaggggaaaaagaaaggaaagagaagcgcaactactccgcttaatgcggtcagttacttaaacccaccgcattttaccaaaacgcccactccgctgacccttttgttcctcgaacccaccctccccctcccggattcaaaccgtcgacgccgtcgccgcgtgactctcctccgcggcggcctgagcctgaccacccccaccctcactcgcctcgtcgccggaaaattgcattcgcgccgctcgcgctccccccccctcttggaggccccggagctagctgcttggggggatcctcctccgctcggcgggcggcgatctcgcggcggtcccgaggaggtggcgaggtcctggctgcgacgagatgccgtgatcccagcagtgatgcgcggatcggagcatgggtgtgagccctccagggtgtacctgtaggcggcgggcgaggagcgggagttgcggccatggcggtttacatcgctcgggaggctaccaaggtgtggattcgttggcacatggggttgggatgttctagctatggtttgtgatttttttttacccgcctttgtgcagctatggaggaaggtgtgtgcggagatagcggtggagctgcagcttcttttcgagaagtggcgcttgctccttgccggattggtgtttcaggtaaacttcagtttatttcctttgattttttttatcctccgtggctccgtgtgcataattgccatatttgtggcgtgctttgtaattcttgactgctattttctgtgtgtttcaaaaattttgatatagcacgtggtcgaccccttttgaacggcaattttagctagctctgcatcgtacaatctatgctaattttagagttggatttggggaccggtacgaattctgtgtcaacactgcccagagggtttagttgtatgaactaagtgtggtaaattatacctcacctcgagcaagggtgtggctgattgaacatttgcatgaaaactatatgtctgcacagtttaggtgaatttagtttgttgttaatcaagaggggagtattggggatggaagtatgattcaatctgtttatgtgatatgtcctcagagtagaaaaaaaaatccagagcttgttgagaaatgttggatacttggatgagcaactactgcaaattcacagaaagcagttcaagcactggcaatcttggttgagctggagccaaggtcaaaagcaatataccatgatagatgtcatatcatggggagaaattgttgccttgtgtcttcttcaaaagttccctgcttagagagtttgagacaattagcttgctattggtccctcttgtaaaatatgttagataaattgcctcttatgtttgtctagattttgcaagtatttatttatttctgaaattcttttcataaaatcagcgcgcttattatgcagttactgtgatgtttcttgtcctgcatgtagtctcctcgaaactgtaatcatgctcatgcaaacaacttgtaggttggtttattgaactaaagatgattattaatgccattctggaaatgaattggatattcatgggcctgtcatcagatatattcgcttgtactgtaacaggatatgctctattatgagaagataataattaaatatcataagttgacctcagaaataatactgcaattaacattttgggataataggacttgcattattttctattttgagttgagatataggagatgaattcatttgaacttaggtgcaacctatcctcttgatatttaataaaatcgcgcacccaatcctttgacatagttggttccatttgtgatactgctccctgtcagacatgctccattccctagaaatctgactcaactgtggtgatttcatataactttttttctccatgtttgtgttattataattgatttacttccttagatgagtaaacattttagagcgcagtaagatctacagtccttttctgtacacgatggagaaagaatgaaactaactgttgggaaagcgtgagatttgatttcccatatggcttgataggttgcaatgcgaaatgccggttggcgcctaaataaaatctttcttctccttgtattttctacaggttctctttttgagagcgtggaaaaataaaataaaatgtccaacttttattgttcttcatcatcttctcaagatttacttcttacataatattatctgttcattaatggatgatattggaaattcatgcaatccttttacctataattagtacattcatggactggctgctcgaggagtacattacttgcatcgacctgggccactgctccaggacttgggattcatggctcttccggtatgtgacctggtaaaaattaatctcatatctgtcaaagaacaatggtactgatttgttcctgccactggtggcacttctctttgtttttaggaacttggacaggacaaaggatatgttagtgagagcgtgttcacattcatcttcatttccttcctgttggtaggtggctattttgcttcactgcatatgatcatctattgcatagttcatacatatttgataattaatgatgtatgttttgtaatgaccctttcttcttatatcttgaataagttagccagaaatcttgtagtgtaaatggcaatgacagccctgctgatattgacaagtaaacaacacaatttgaaagagctgcagtgagaaataaatttgaaaatagtggctatccagattgatttatgaaagtgaaaaagtaatttgataatttagcttagtgtgattttgtaccttatgaccatgggttaatcaattgctctccgataaattattgccacctccaatatgtactacagtatggtagtttggtccttttagtaaggtcttgtctgcatgatctgtaagaacaaaaaatgtttttcgaagctatttgttgcaccaattttctgtacaattaagatgttaaaatggtgagaatgtgagatgcacttctttgtgttgtagtatagcagaggcgtttatgtattttgctcctctccgcatcaacagaatttggtttgtttaagctacttgcatgtaatgcttgatcataaagtagtgtaattgactgacaatctttatggttttgcagtggagttttcacccttttatttatcatagcaaacgtttctacactgttctactctggcgcagggtgctggcctttttagttgtaagtggctgtcccatgtcttttaacttatctctgcaaccattataatcatgatgtaacaatgatgtttttcttttctttcctctaggcttcacaatttttgcggattattactttctattccactcagctcccaggtccaaattatcactgtcgggaggtaaccttaatttctcatcatagctaaagcatactcgtgaactacatactgtcatactttgttaaaggcttactgaagtcatttatctttgcattttgcagggctcaaaaatggccactcttccaccgccccataatgtacttgaagtgctcctgatcaactgtaagcctttcatcatttgttgggttgaatcttttgtccagatgggtggaaaatcatctgaatttcctttttttttcctttgcagttcctcgtggagtgctttttggttgtggcgatctgattttttcatctcacatgatctttacacttgttttcgtgcgtacatatcataaatatggatccaaaaggtattaaaatatagaatgcatatgcgcacacacgcttatttgtctctttccctggtcattttttgcctgtaatatgtcataaatttggttcaagttgcatgctaactcagtactctgacatctgatcttctaatctcattggttgttcctgttttgttaggttgattaagattcttgcttggctgatggctataattcagagtcttcttataattgcttctcgaaaacactacagcgtggatgttgttgttgcttggtaggataaagtttcatttctgtaatatgattgccttgtagtggcatctgactttggtgcattctttttcgtcaggtatactgtcaatttggttgtattctttattgacaataagctaccaggtaccctcttttagcttcctttaattatgcagtattatccatgtggttcattctgtaacaatcgttagtggcaattctacagaaatgccagatcgcacaaatggatcatctttgctcccagttacagcgaaagataaagatggcagaacaaaggaagagctccataaactagagaaggattgcaagatgaaggaagagttccataaattgttaaatggaaacactgtcgattctactgatcgggtatcatagagcattaatcagctactctatgttctattttaatctccaaatgaacttcccaaacttagaagttattttgtcataaatttttcatccaacaatgaaacatatctacatttcattgtagttcaattgcaacataaccacaagccttttatcttctacatagtacctagcaacttatatgcagcaaccattttgatatttcccctaacgtacctatttccgattatccagcggcaacgtgtgcagatgaacggaaaacatggcgaggacatcaaccacacactctcagatgccactcccaatggcacatgatcagctgcttttcatcaggcggcttgtctagttgtctttcacattgacaggggaatctgctaggagacaaagaatgcttggtttcctctgtatgatgactggcttctcaggtgcctctgcccctgcattttgtctgtccgccatggcaatatgttcacggatgaatgagacagagccaggtgccatagcaccagcattgctatggactgcaaaggaatcagagtctcaactctcaagtctcccagcgacttttctcaggctgccattacagttttgcacccttgtatcgaatctctagttctcttccctcaatttcttaggttatggaatgaacactttcaggttgatttgagaagcatagcttctcccgctgtatatatattgtcacattgatgaacttagcttaatcttggcatggatatactcatatatctatcgccgattggtcattttcatgtgggatttgagcttgtgatgcggggtgccacttggcaccgttgttgcgaaagtccaccgggggctcactgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaagaaagataaacggcgcaaacgactccattccacaggcagcttgaccggggctacacctaatcctccacaccatcggcatcactgtaaaactcttcctctgatgaatgattgcaaggtgagtatatgacatactcagcaagtcacgcagcaaatatgcaagtgcacaggataacaaaggatggcataatagggttccatttgcataaacagcctttaataaacatttcagaatttaataaaacagttaagtaataattaaacaatattaatccaacgctatacaacataccctgttatataggcccaaccattctgaacaaccatcccggctgcacagtcctatctccaaaccaggaatataccattccaaaccaggagctaatcaaattattaccaattatagcatcttttattatgatgagatgtgtgagactaatcacgaaagacattgttagacccgcccataaccgcgggcacggctattcgaatagttttactctgaacagaggtgtaccactgtacccacaagacacaaccccacatcatgtcaccatgtgcctcaataccaccacggtacctcggaaaggagttgtgacaataccccttgcacaacacaatccattacagcgcacctttcctggatcataatcacccccttataaacaagacatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaaccaatcacgattgaccatcgtgacctatcattaagccatcattaaataatagtaaatcttaagttatcccaatagtgtgctaatgtttctaagcagggctaagcaattatatctaatatctagctgaaccaatatataaagctcaactagtcaagttataataacccaagatatcaaggaataaagtaatcaagaacaaaagggctttagcaaacaataggttaattccacccaatgacattcgaaaataaatgcaatagttgaatagaaatgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcagctagggtttcgcggtggaccgggcgcacggcgacggttcacgcgaacggacggccgagatcgacttgatccaaaacggacggccgagatcgaacggtccacgaccggctcacgggagagggcgacgatgacgtcggcgatgacgtcaccaccggcggcggcggctcggcggctcgggcgtgcatgctcgccggcgaacagcggcgcttcggcacgaacggagggcaccaagacgtagagcgcgacgcggcgaactcaccggtgaccaaaggagcggcggaagaccaacggacggcgacggcgacggcgacgacgaagaaacggcggcggtcttcgggttgacggcggcgatggtgctccggcgatcttcggcgacggcgaaggggcggacgaggacagcggcgacttggcgaccacgacggcggtcttcccgagcgacggcgatgaccggaatggcggcggcgcacagctggagcgacggcggcgacggcggcgctaggtcacacggcgctagagctctaccggcgacgagaggcgaaggcgagggtggcgacgggtagcggcgactccgggggtccttttaaaggggctaggaggcggcggcgaaggcccacggcgaccggcgacgagatggaaaggtcgggctcggagagagaaaagccgatccgattcgacttcgaatcaaacactttccaagccgatttagccgatatttccaaaggggaaaaggtagaggagatcccgaggatcatttcccctctatcaattcggccggagaaggaaaggatcgaccggatttggaaggaaacggcggcggcgcggtgctagggtttcgggcggcggccgtcgcgaggaagacgacgacctgacaggcgggccccacctgtcagcgagcggacgcgcgcgcgcgggcggctgcggactgggccggcttgggccgaggagagagggaagggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaataaaattttatctggccccattttatattggaatttattaattaaaattagatcttctcttcaaagctttttaaaataaattctaataattccatttaaacaacaatttatatcttttgaatttttaggatgtgacaaacctaccccccttaaacagaatctcgtcctcgagattcggaagcactggcgatcagatgcggatgagctgacttcaattcatcttctcgttcccaagttgattcttcttccgagtgattactccattggactttgcaaaaacggataactcgatttctggttcttctctcatctatttccaagatatggattggtctctcaacataggtcagatcctcttggacttctatatgttcaagattagcttcttcggtaggtacccttaaacactttttcaactgcgacacatggaacacattatggactcctgccaaagattgaggtaactccaactgataagcaacctctcctcttctactgataatcttataaggtcccacaaaacgcggtgccaattttcctttggtatgaaaacgatgaacccctcgaagaggcgtgacacgaaggtacacataatctcctgcgtcaaaacttagatctctacgacgattgtcggcataactcttatggcgagactgggccacacgcaatctttcttgaatgattttcaccttttcttctgcttccctcaagatatccgtcccgaaaacctgacgttctcccgtttgatcccacaaaagcggagtgcggcacttccgaccatacagtgcttcgtaaggagccatctgaagactagcttgataactgttgttgtacgaaaattccgcataaggtagattcttatcccaacttccaccgaagtctaaagcacaagctctcaacatatcttccaaaatctgattcaccctttcggtttgtccgtctgtctgtggatgataagcagtactaaagttcagcttagaacccatctcttcctgaagcttcttccaaaattttgaagtaaactgactgcctcgatcagacactattttcttagggacgccatgcaaacacacaatccttgccatatacaattccgccaaccgacttccagaatatgttgtctttactgggatgaaatgagccactttggtaagtctgtcgactatcacccaaatagagtcatgacctgatgacgttctgggtaaaccagtgatgaaatccataccgatttcctcccatttccattcaggaatcttcaaaggctgcaacaaaccggcgggtttttgatgttctgccttgactcgctgacaaacatcacatactgctacgtattctgcaatttcacgcttcatacttgcccaccaaaatctttccttgagatcctggtacattttggtactaccagggtgaatggagtataa

SEQ ID NO: 58492 - DNA, 1262 bp, Oryza sativa
tatgtcatatactcaccttgcaatcattcatcagaggaagagttttacagtgatgccgatggtgtgcaggattaggtgtagccccggtcaagctgcctgtggaatggagtcgtatgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccagcaaaagttttacaatattgtttagtttaatcttgctgcaatgaaataaatttatcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttttatgcccaaattcctcatgatcgtcacgaagaaaagtgccgagtcaaagtcaccttgaacagtaatagtgaagatatcccctcagtgatgttcgaagccggaggaagaaactacatccatacatgtcaggaggtggcaaggatcgccataggagagctccgcgatcgctacagtgatcagttggccgacactgagtatcgctaccatcctcgccaaccccagggaagtgaccgtggcagctaccttgagactgagggaattgagaatgatgctaccacaaggcatttggttgagatgctgtgggctatgcatgaaacccgtgcggagactgtgttagcggctcaagatcg

SEQ ID NO: 58493 - DNA, 1363 bp, Oryza sativa
atgtaagtgcatgcgtttgtttgcttttgagtgttaggaagttggtgagtttagtggtgtgagagtcttcagttttgtaataatgaaactcagttaagatcaataaaagttaaagtaattctctgccctaagtagttttccccggtttctcttcttgtgccctgcccatgccagatggtgctcactcgcagcaacgggaatggccccaatagtaacaataacaataacaatgaagggaacccaactcttgcccaagttcttgctcaacagacacagcttatgaacatgatgatgcagcaactccagaaccagcagaaccagggaaataaccatgcacctccccagaacaagttagcagaatttcttcgtgtgaggccgcctattttctctagtaccgctaatcctgttgaagctggtgattggctgcatgccatagagaagaagttggatttgcttcagtgcaccgatcaggagaaggtctcatttgcatcacaccagctgcatggccctgcctctgaatggtgggatcacttccgccttaataggattactgctgaacctatcacttggcttgagttcaccgctgctttccggaagacgcatataccatcgggagtggtgtctctcaagaagaaggaattcaggtcgcttacccagggatctcgctctgttaccgagtatctgcacgagttcaatcgtctggctcgttatgctccggaagatgtacgcactgatgaagagcgccaggagaagttcttggaatgacttaatgatgagctttcttatccactcatgactggggattatcctgatttccagaagttagtggataaggctattcgtcaggaggacaaatacaatcgcatggagcagaagaaacgccggattgctcatttcatgacgcaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctttgacacagcaacaacctgccaagaaggagcaaggcagcaagcccgtggtgtgtttcaactgtggagaaccaggacattacgctgacaagtgtccgaagccccgacgcgcgaaggttgtccctgcccagagcaactctaccgcaccagcatcaaaggcccgtgtcaatcatgttgctgctgcagaaactcaaggtgctccagatgtgattttgggtacgttccttgttaacttagtccctgcaacagtgctttttgattctggtgctacacattcattcttatctatgagttttgcgggaaatcatg

SEQ ID NO: 58494 - DNA, 853 bp, Oryza sativa
gttcaccatatagttgaatacgtaaaagccacagtcatccctgtatgtttttgagaaagtagtgtcagtacaagctttgggttggttgtatttcgtttgttttaggagtcactcacccgttctgctgctctggtatattttcaactgtctcaaagtcccaattaagtatgtccatgttccaccctggagatgcaagacgcatgcattccattacacactgtgacaccatgatctttatcttgtcatgcctggtgaaacgtgattcccctagtggatcttctgtgtttagtgaatcaagcaccgataacttcttgctctccatgttaaatacgtacagcacgtaatgattgaataggtgaacaggaatcagtatctgcaaagtttaggtttttcagtgggactacttctgtactattgtttacaagagtttctacaatctacgaactgcaaatttgtactcaccaggtggctttctgaaacatcatatactacctctgggcccgagaagtgtgcaagttgatggctagcttcccaaaattcctcaccagctagcgcgtacatctgacaatacagaaagaatcattgaatttatatttttattgatgaaagaaatatattgtttattgcatgcaatgttaccccaaaatcttggttaatgaaatgcctccaaccaaggtagtttgtgttgtgaaatctctcaacttcttgttggaacattattcgaattgcaaggttgagagaatctgaatccatttggctcccaatctttatagtttcttggatgtttcgtagcgtcaatgatattatgaaaggatggcaactctgcagccatgtttttctgaaataaaccatg

SEQ ID NO: 58495 - DNA, 1733 bp, Oryza sativa
ggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggtgatgtggaaaaagaactctatattttgggagttaccatattgggaattcttggacgtacgccacgcaatcgacgtgatgcacctcactaagaaactttgcgtaaaccttcttggcttcctaggtgtatacagaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtagccttccagacaatgtccgggcaacaataacaaagatatgtgcattcatgaacgcaatttcgcagaaggtcatcgatccggatagattagaagcccttcagaatgaagtggtgcaatgtctcgtcagttttgagttaatatttctaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacaagagcccaagacatgaagagcacgaaccaaaacagcgctgttcgtgtcgatgccatggga

SEQ ID NO: 58496 - DNA, 5648 bp, Oryza sativa
tctctctcggcctctctccttcgccaccactgcctagggcaaatccccgcgccgacgccgccgtatctcgccgtcgtctcgagctcgtcgtcctcgccgccgcctccgcctcctccgctgccgccgcatctctggggtgagagccgccgccaccagatctcccttcatgcatctcgatctctccgatctcgatctctctctgtcgcgccgcccgccacgagacaccgcgccacgacgacgacgcgccacgccgccgccttcgacgccgcgccacgccgccgccgcatgccaacgccacgccgccgccgccgtcgccacgccgccgccgccttcgccgccgcgcgcgcaatgccgccgccgccacgccccgccgccgccgccacgccacgccatgccaccgccgccacgccacgccgccgccgccacggccccacaacgccacgccgccgccgccgtcgccacgccgccgcgccaaccgccgccctgatgccgccacaccgccgttaacgaacgagaacgagaacgatcgaacgaacgagagcgagaacgaacacgtcaacgtacgttgccgcgacaacatgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaaatgcaatatatatatatatatatatatatatatatatatatttgtatatatatatatgtatatatatatatatgtatatatatatatgtatatatatatatatatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtttgacattattgactacagaattggtgcgactcctagcaattgactattgtagtcttaattagatttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagactgagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgtggagggaagcagccagtactggaatgaagaagaggggaacgaggatccaaaccagtacttgaacgaaaaagggaacgtggagagggatgcggaggggaaccagcaggggcacgtggaaagggatgtggaggggaaccaggaggaggaggctagtggtagtcaaccctccgttgaacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctataccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagattgattgagaggggtatcgaaccggcaacagccaattggccggaacgatcgaagttctggtactatgctcacggtggaacgctcaacccagctgatggctcacaggtcttcggctatcagatacaagaggctgcgcgacgactaacagatgcagtggaagcctcctctcagggcacgttccgaccagacagagatagggacgagctgacactcgccctgcagactccagagcatccaggacgaactcaagggaaaggggtgattccttggaagattggttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatacaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctagattaccctggaggagacggtgagacgcatctacgagacacatgccatgccattattctatggcgcagggtgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggccaccccaactccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatatctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcagaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattataagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctagataccaaatttcattcccgtacgaacttgctaagtgtttcatatgtaatgcattccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctatgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaagaatttatcgcggcggttcaagaacaactcatgggattcatcaacgaagaaatccttgatcccaagggtgaattctactacgacggaaacacaattcaccggtccttagcttctgagctactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatatatatatatatatatacatatatatatgtatgcatatatatgtattgaaacatatatatatgcatggtttatatatatatatatatatatatatatatatatatatatatatatatatatatatatatatatatatct

SEQ ID NO: 58497 - DNA, 2496 bp, Oryza sativa
  unsure (1)..(2496): unsure at all n locations
cccccagttggcccggtagcccggcccggtgtacccaaccgggactaaagatcgatctttactcccggttatttcacccgggactaaagatagcgatctttagttccggattggtactcccggtttggaaaccgggactaaaggggggttacgaaccgggactacaaagggtttctccaccagtggtacaggcacaagcacaacttctgcctgctgcttgcgtgagcccgcatggtaagaagctaagctcaacgattggtggatgtgacatagtcggacacgtaggattaattcctacttatagcattttcaaactgccgcaccggcaaggcgacatgacggtcactaaaacccagtggcactggccgccgccgtcacttcgtccatccgccgctgcagcctcgccgtcttctcctcggagagcgtcctggccatcctgacgagcgcgtcggcgttgctcccctcgtcgggcaccttctcgtacctcccggtctccacgttgaccctcgtcacctgctgccccagcatgcgctcgccgacgccgacgagcttcctcatgttctccggcgtcgcctcgtccagcgccgccgcggtgctcctgagcgagtcatcctggtcctcctggatgcggaggtagttcccctcgctgtggaacagctggaaattgacgccgacgtggatgtcgaccatgtcggagctccccgccatgaagatgtcgatgatgggcgccatccccctgtgccgcagccacccgagcgccccccaccgggagcatttctccgccgtgtacagcccctcgtcggaggtcagtccggtgccgatggacaggacgaggaaccggccgcactccttctccggcggcttcgtcaggagcagcggcgccttctcctccgctatcatctcctccgtgatcatcgtcatggctaccatcgtctgcagcacaaacacgaagcaaacgttgcaaacaaatctctggtcgaatccgacgaatcgtctatggattattggaaaatctctgatggagtgtgactgatacaggattgttggcggcgacgccgccgtcgatgaggttgtactcgcgcgtttcgccgctggcgtcgtcgtgtgtctggaagtagtgcgcggggaggtacgtcggcgccgccgacgtgccgatgcagacgtcggagagccgcgcgttcttcagagtcgagttcttcgcctgcatagacgcaggcaccaagaatttaaccacatctctcttcatgagaatatcaatggcgctcgcgcgcgcggcgcgcacgtacgtacgtcgtatgtggagaagatgacgggctggagcagccggacgtcgaaggtggggatgaccacattggtgagcgtgccgtccaccgtcgtttcgccgagcacctcccggaccatgtcgcggaggtacctgccgtcgtacttgggcccccacaccgcggcgacggtggaggcgagcttgccccacctctgggggaagatgcgcgggccgtgctcctggtagaacgggcaaatctcaccggcggcgaacatcggccgccgcggcccgtctccgtcctctttgggggtggcgagcatcgcggtgatcagcccgccggtgctcgtgccggcgatgtagtcgaagtagtcggccagcctcgcatctggcccgtccagccgctggagctcggtctccaagaactcgagcaccttgcctgggatgatcccccggatgccgccgccatcgatggtcagcaccgtcaccctctcgccggcgacactgccggcggcggcgctgccgccatggaaaaactcactatgaaacggttgagacatggcgtagcatatcctctaaatcaaaaccaccatcgaaatcatcactatcggtggaaacatcgacaaccattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacgacacggacaaaagatctttgtcatattctccctcaaagcatgctccttagcctgatcaataaatttagatgcttccttaataaatatcggctgcgttctccgtatctcatacatccatgacgaccgatccatctaattatataaaggcaaaaaagttacagataaaaaaatagaccgcaggtatttcatacaaaagtttaaatgcatttgtctcccaaaaaaaatacaacaatacatgtaactagtatgtacgagggggtcggtaggttccaatacttatcacactgtttaaacaggtnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58498 - DNA, 981 bp, Oryza sativa
ttatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctatgctaagtacatatgatgattacaatttttattaattttaaatcatgcagtatgtacatacatatcttaattagagtttttaccaatataataatatcattcatatatatgctaagtatatatgattattggaatttttattaattatattttcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccggaaggaaatatcttttctttactcccggttga

SEQ ID NO: 58499 - DNA, 7742 bp, Oryza sativa
ctatttggactttcctaatatatgaaaccacatatatatagtatttgtgtgaaaatcgttagttttttgtgcttgcgtcctatgcattggtcattgaatgcaaaatattcagcaataataatgttctttcttgaccaactagaggttaactttctttgttcaaaaaattatgaacttataatataattgtatcgtattttatttttggtagaactgtatgcagcttgactgtaggcctgccaatgaggttaaaacccgccctgttcccaatccaaaccacaacagccagctaaagtagtccagaccaacccaacaatccagaagtcttcttttagaatctaaaccaaaccatttcccatctatgggttcaatccacccttccaatttccaaaccatttggggccattacaatcgaccacaaccacactaacccatacagtccattcaccatcaacaagtacttgcagcggccatggagagagtagatagcaggatgacattagctggctgcactagtacatcaacggcgacggcctgtgatcttaacctccccaaacagaaccagtctcatcttgtgatccatttcttagctgccagcagcccagccagtgattgaaattttgaaacaaaatttcggaccccccggtaagtcaatatctcggctgaaatttttgtgaatttgatcaaaatttagtcaagttcagttaaactgtgtcaaaaatttcggtccaaaaaatgctgaaatttccgaaatttcggtactaccgaaatgactgagcccagcagcaagaagcggtgtcgatttcctgtgcgcgtcactgcctgtccctgccaccgcctcgttccggtgcgtcgccggcggcgatggcctcaacgagataaccgatcgatcgcttgatcagtgctttttcgtaataaaacggaatagtgggaagttcagaaagttttgttgtcccgatattcgtgaaagtggagcgactcccgcgccgctctccatgggcgacgacactggaggcgaacagccccgagcgaatgctccccagccacgtccgctcgcgtcgctgccaccggcgacggcggtgcggcggtggtggcgcctcccaccccttttcccctttcctccttccctctccctttcctttcctcgttttcttctgttccaccttgactcgccaccgtcggcgtgaccgccagcgatggcacctccttccctgtccccatcctttctcccaccctcttccttccccctccatttccttccctttccctttctctttttctgcagatccaaattcaggcgatatgcatggtgggtctccgtgaggggactagctataggcagctggtacttgaccggtggtgccgcagcgcaggtttagaatcggaatacaactcgatgtagttttagggtgtgtttggtttctaagattggatgggatatggcggtccagttttttgtttggttatgtgaatatggcgatccagttttttatttggttgtagggacgaaggtggagttggtgatctaatttttttgtttggttggaggaagtatggtggatttgtaggtgtggtcacctctcacttgagatggtgaatatacccgttgacgaaaaaattgaacacaccggcctgagagatctgcttaaatcctgtgcaggtctaaagattgttgagatgcgggcgtgctagtcagtttgatcctgcaactgacaagatatgtaaacagtagatcaaatagccgatcggctgacaagccaatgtagtgattccagccgatgccgatactagccgatagcgatagggtttgagcaatcggctatgtgtccaatgtagataatgatgcaaagacaatcagctgatgatattaaaatataacaataatataatccagtagaaaccaatcggctaacaatgacatgatagaataagcactgatccgatggttaaagcatacatcgactggaggtccaatgtcataaaatccacaagattagattaaacagtgaaacctttgttgtcatcggctaaatccaacttatatgtatatgcaatccttatgagccgatgcaacgtctagataactcaccggctgaaaccccgatgaaacccttattggcaatcaagaagcaggatagagattatggttctaagcacgacttagtagatcaaacttaactgatacagcattaagtatgaaaagatacacaatctagacaatcaaaccgttgaatgagttttcagggtggtagatgtctaagctaatctaatctagcaacgcgatttagctgataccggcagaaaccctaaaacaagaagcagccgatagagctaaattgatatgctaagactagattaacagagacatatgataaataggtaggcaagtatatcatccaaaccagagcaatctaagaggtcgaatgtcctgatgcagccttgaacgacgccgacgtagacgatataattgcctgggccgacggaacattggacttaccccttagccggagatcgaacaccgatgcagccccgcgtcgggtgccaagttccgccagaacgtagaaacaaaagtaaaagtaaaaagggtggcgatgcgccgaattgtattgatcgtgaggatagattacaatgaccccgcgtgtacatatttatacccatgggtagatactaatccttgtaggacaagaaagaaactttcctaaagataaaaggaaaacataaagtccttataggacactaaacacactttcctaaagataaaaaggaaactaccaaactattcctaattaatagacaacttgccatgccgcattctctttgaactcggtctcttctggataagctttctttactagatcaatttccttagcaagaatccgacaactggcggcttgataattctcatcggccgattccaggactctgaagccgatactgactttaggccgatgataactttgggcttaccaaatttcgttgttaacaatacccccatcaaattaatacataatacaattttactccactacctctattataaatacacatagaaaaaagaaaaaaagaaaaagaaaaaagaaaaaaaaatagggccagatctgggctcgccgccgccacttcctcccgtcggccgcctactcccgccggcagccacctcccgccggccgccttcctcccgccggacgccttcctcccgctggccgcctcctcccgccgtcgccttcctctcttgtgacccgcgctggctaccgagctcgcctcctctctcgccagccgccgcgctcgtcacccacggctgccatgctcgtcgctcgcgccggccgccctatccgccgcctcgctcgtgtcgtcgtggtaaggggtgacgcgagtcacgcgactcactcgcccgactcgcccgagcctcgagtggttgcatccggccaaatcggccagatccctctatccagcatctgggggggtatattcccctctgggccgccctatcccactttcgtccagcaaacaaacaccctccaaagagcggcggccatgtcctatccaggtatatcccaccaaccaaacacacccttagataatatacttaattttcaggatgttacaaatgaagaggatacaactcgagcaagagaagggaaggggtgagcagtaatgtgcatatgtgaggggagatggaggttgggatattttgtttttcaaatctttgtataaacaatactctctccatctacttttgataggcatatttctaaatctgaaaaatttatttttgactagcaatagtgcccgtgcattgcaacggaaaaaacaccgtttgatagtgtgacaccttgagaatctcaaatcagtaaaaatcaagtctaatttgatatattaccaaatcggtagaatcgagtctaatttgatgaattagcatcggatttaggctttagtcttagatttatttttcgaggctacttaggagtttatctaactttaatttaaaaatctgagccacattgattgatcaaatttgctttcggcccaggtcatcccaagccggcccaaacttgggctggcccatcttcacgcgagctgagtccattcgatggcccacaagccgagcacatgagcgcggcccacatacgcggcgacgatgcacttccgtggcccattgcgcagcgtaatcagcggtggtagcggcccgatgttggacgaatctgagccgtccgatctattggatggctccgatcgtccccgcgtcggatgaagcaccgaccgggagagaggggcaaaaccctagctcccaaatccctctctcccgatcccctttctctctggcgacgagcgagcggtacaacggcgaaggcggcacgcgtgcggtgacgaccgccaagcggctcctgctttggcggatgggggacggacccgagggtggcggaaagccatgccacgacgtcagcggtccgaccaggcgggcgcgcaaacggcgacaagcgccgagtggcctggacctcgtcggtgggaggggcgatgccaagccgacgcttcccgtcttcggcaagggacggtggaggagtactccaggacagcgcgtgcacggggaacccgacgcgactgcgagaaggtgaaggagtggaggtgccgcttcccagaaagttccggtgagcttaggggcttcaagtccggtaagtaacccaaacccttagcttaattgatttggattttgattcttagggttcttacccgaaattagggttcttcgaatttggggaattttgttgggaaattgcaatctattttatttcttttttttctagttatgggagtttcaatatcgtttatccacttttaattttaggaactttaatctagtttatccctttgcttaattacttttttttgctttggccggcgtttcatcgcgcgggtggtgacggagggcgcggtcagtcccctcggaaagattgagattaagataagataagattttcacggacgacggaagtaaattgaatcggactttcttttttttgttttaatgttttttttcgccctttttcgttattacggacgatggaaacgttttcaattttttaagtagtggagataggcatatttcaatccaacaacctattatcttaataactttctcaaatttaatgcatgactcttcattcttccacataaaattggctacatggacatcgagaaatgcaaatattaatgaatcgcttgtttacgatgaatgtctagtagcatgtttaaatagatgataagtagaattacttatccttgatctgtgtgttaaaatgaaatatgactatcaaaagtagatggagggagtataagcgaaaacttaactaatcgtgcgagttcgcgcggtcttgtgctgcgcgagattgtgcagtgtcgcatgctcgccgcgcaagaccttggtctcgcacttccattctgcgataatgttatatttctgcattctaaacgtgtatatttcctacaaaatcattgaaaaaatgatgtatttcctttaatgatatctcgagttcagaaaacgttacttgcgaccatgactagcagcctagcatcgacgacacccaaatccgctctgctctcggtcctccggttggctgttcttcctctcattggttgagctctattgttgttgtttttaaggaaccggcactagaaagtgccaatttcactgaatagaacaggaggaaaaccgtacaagtataaatctataaagggaaagaaaagaaaagactaggctaatttcattgaattgagctctgttgttagcagggccagctttgaacttcaagctgactacataatagcgagctgatctcgattaggattggatttgaagtaaacgatgatattggaatatttatttatgctgagcgcgagattaggtattgacatgcagcaagtgatccatgtttttgctttcacatcatgtggagtacatatataatggcaagctgattgattgggattcgatctgagtaaacgatatactccctccgtttcgaaatatttgacaccgttgactttttagcatatgtttgaccgttcgtcttatttaaaaacttatgtgagatatgtaaaattatatgcctacataaaaatatatttaacaacgaatcaaatgataggaaaagaattaataattaattaatttttttaataagacgaatggtcaaacatgtgataaaaagtcaacggcgtcaaacatttcgaaacggagggagtatttgtttatgtggtcagaggagaaagtggtcgaggttttattttttttcgttaattactactactatttgtatctccattctccagccagctgctaacgtgttgagctcagcgacaagcaagatcaacaaggtgtttgctttcccatcatggagtgagctggcctagctagaccttggtttaattccttcccaatcatgcggtaagcaagcatatatacaatactcgtttcccactattttattcttcaaggtaaaccatctatcatttaatttctgcaggtcgtttatatataactggaaaaaaaacccatgcccatggtaggtagctaattaagtagcagcagcaggcagatccatgccttcatcgatcagcttaattttctagtagtgtatacacagtcacattggattgctgctgcatgcttcattcgatcgatcgaatctgcttctgctggtatgagagggaaagaaacaagaatgtccgagctaggtgatgaggagtcggagctgatcagttacagtcgatctgagcgaacaaatcgccacggccagcggcagcggcagcccatggacgagctgtggccggaagtagtcaacatcaacaagtatgcggtgctcatggggtacttgtcgatggcagtcaggggcctggccttcttgatgttcacctggaccaccgttgttctccttggtggcttcgtctctgcgttgaacaagaaggacttttggtgtctcacgatgattaccctcatccagactgccgggttagtcgtcttgcctccgacgatcctccccatagctattacatcgagttattttgtccattgtttcagttattttcagtttctcttgtcgatctggttgttagtttcctcttcctgatctttacttcccttctcccacactcatatgcatatgctctgggataggatgcatgcatacgcatgaattattcaaggctaattttactattcctgattagatactattcttgataaggtattgagatgtatcacacttgtagcgtaaatacctacaggtaccaagtatcttcttgaggtaccaaaatttttagcgtaaaatcttaatacctctagttactttcttatgtaccataaaatttctcattatttaaagtgggaaacaggaactcaatcaggaaaaaccataaagtgtatagtatggcagtaggatgcatgcatatatttaaattcttccaagtcgaaagtcgattgggaaacatagaactatatattcgttaatctataccaacctatgaatacgcataaccgtaccatttaattgtaagcaccatgaatgatttggacactggttaatactccctccattttttaatagatgacgccgttgactttttctcacatgtttgaccattcgtcttattcaaaaaatttatgtaattataatttattttattatgggtttttttatcactcatagtactttaagtgtgatttatatcttatatatttgcatgggctg

SEQ ID NO: 58500 - DNA, 43099 bp, Oryza sativa
aaaatttttgaataagacgaatggtcaacatgtgagaaaaagtcaacggcatcatctattaaaaaacggaggtagtacacaattattgttacccgcaaactcaagtaccacacactcgttcaaacataagaatatatagttgatgcaatttttttttaatttttaccatagtgctatgacctcgcagttgtaaaaatgtgcaattagttctaaactcttgcatcccaccccaatgccatcgtacaatggaacacactcctttcatcccataaaaaaatcaacctagtactgaatataatatatcctattacaacaaatctagactagtgggacgaaggaagtagataggaattactacatgagagcgcataaagtgtcccacagagccatgataccagtacagataatcctcagacacagtgccggtatctacggtaacagatatgcatgatcgccatccttattacataatagaacatatttaccttactttagttgcaacttcaagcccttccaagattaacatatctagtattcaattaaaccaataaatcaacaaactcatctgtgcacaataagtacatcatggcgtgcagacgttctgctactcccatttcctcgcgcacacatgccacattaagtagggggttgctagtgcgtgcgtgcgcgccaggaaaggagccggcgcgcgctagccgcgtccctacgcgtttctttttttctctagatctcctattttggcgtcaccttttcgtttcctttttaaaatttccagattttttggaatcgcttctttcttttccacttgcgcgcttgatttttatacgatattttataaattcaatctttcagcttcaacatcagttgagagttttgaatttgagttgaaaagtttctaaaatttaagttgaatgttttgaattttgagatgaaagttttcaaatttaagttgattattttgaattttgaagtgaaagcttttaaatttgagctaaaagttttcaaacctgagttaagttttcaaatcttgacttgaattttttaaatttgaattgaaagtttcaaatctttagttgaaagttttcaagtcagagttgaaagttttcaaatctgagttaaaagttttcaaatccgagttgaacgttttcaaatccgacttgaaagttttcaagtttgaattgaaagtttcaaatctttagttgaaagttttcaagtccgaggtgaaagttttcaaatccgagtttaacgtttttaaatccgagttgaaagttttcaagtttgaattgaaagttttcaaatccgagttgaaagtttttaaatcttgacttgaaagttttcaaatctgagttaaaagttttttaaatctttaacttgaaagttttcaaatattgactcctactcttagatgcgtgtggtagttaatggcaaaaagaaaaaaaagaaaaaaaaacacagcagttgcgcaaccgaaaaaaaaggaaaaaaagaaaaaagaagcgtgcacgatcgatcgtacgatgacccgccacgtggtacacgtgcgacttggataagtcacgcgcaaaaccgcattaagtgcataaaaagattgtaattacggttgtgagaataaatctcaggaagcaaactgttaactaactatttcaactacgtgtttattacgtaatgatttcaatatgagggagaacatcatttgaaaaaaaagacacttcataatttcacatgcaaaagtaatccaatctttattcaacataagcaaccgctatattttactccctccattcctaaatatttgacgccgttgactcttctaaaacatgtttgaccgtttgtcttattcaaaaacttttatgaaatatataaaactatatatatatatatatatatatatatatatatatatatatatatatatatatatatatataaaagtatatttaacagtgaatcaaatgataggaaaagaattaataattacttaaattttttgaataagacaacggtcaaacatgtttaaaaactcaacggcgtcaaatatttagggacggagggagtattttcttgttgactacaagaaaacgaagcaataatgccaagaacaaccattttatcattttcagggtgtttacaatcacatgcggtagcttcaaaactagctaggacggaacggtaatctttaactacccaaaaactggtcatttggatgagcagaccagaccatccagtttgcttgggatgtgccaattgtggctgtcaacactatgtttgtcggacaattcgactccatcaacacgtatccagtaacaggaggataagagggatgtagggatgtttccatacattattaattaggcaaaatttgctatagtacataaaaaaagtgcaattaggtaggggacattgtaagaacgtgtatttgctgtagaacatcgtaaaaaaatggtaattagctgctggacaccgacaaaattattttattatttttagaggaataggagagagaaacaatcattaaagaccattttgcccttggctcaaattaatccaaagtgagtgtaccgtagagattggcatggctgccgtggtggtggtggcggcttgcttgtcccccgtctgcgctgccgctgcctccgtcccacgcactcgggtttgcttcgtgagtcccccaggttcttcgagctgcctcgccgcgagcaatggctgcgggttgcttagcggagggaatgaatgcgattgcagtggagggcaccggtgtgtgccaaggtggacgaggtggacaaggaggtcggtttggggttccgcaagccggaacggaggaggatacgcctgtggctccagcggctcttgccgcgggacctccccggggatgctgcagccgcgctgcggtgagccgttcgacgcgtgccgcccgcggcggccgcgcccatcgtcctagcggtcctcctcctcgccgctcgcttcgcgctgcccaagaatgcagccaaggaggtggcctactcggacctcctggctggcctccgcgcgggcgccgtcaccgtcgtcgcattcgaggaggaatcccaccgcatctacttccatagggttgtggacgatgggggcggtggcaaggatgtcgacacaggcgcgagcgaggcctgcagaagcgccgcggaggcgaggtggccgtgctacgcgaggagcgtgccgcatgacgaggggttcttgctggggctgatgcgggacggcggcgcggactatcggtcggtgccgcggctggcggccgggaggctgctggtggatatgctgaacacactgctcacgctgtgggaggagtggcggcggcgagcgagcgccgtgatgataggcgaagcggcgggagaggttgaaggcggcggttgagagcagagacagaaatagagaaagaatgagagagggagaaaaggataaggaagaaaaatgaaaaagaaaagaaaaaaaatcaaagggttgaaccgtacttacacagctgtttctctctccaattcttctagatataataaaataatcccgcgggtgtccaacaactataattaccagttttttacagtgctctatagcagaaacacgttcttgcgttgtctcgtagctaattacactttttttggatatcctgtagcaagatttgcctattaattaagaagaattgttgtgccttcactattcctgtctactgagttcattaaaacttgatgatactccatatttttttttcttacagggtcttcgatgtcttcatgaaagaaaagctgagcagtatttgggatggctacagaggcttgttacagacaacagtaaggacatcagtttcactaatgaacgttttaagctacctggagtgcaacacagctaggggttcctgcatattcaacatcacatacatcctagctactgcactatctaaagctgggagttcaggtggtggtgatcgccgtcctaatgtgccctctgattgttctgtacatgttcgggatctatatatatctccacggcgctctcgctgtggcgcctcgcgaggcgtcgggactactactcggtaacaggagagggggacaccaacataacaccagccttggacgtcttctactcgttggctatcttccagggcgtcatcttcacctacagggtcagctattcatctgcagcagaagcaatagtgaatgatgtatgccgatattaccacatggacgcgcgggagtcggtgtgggactacctgcgggacaccatgatcggatgcgaggaggacccctcgttcgctcgagggagaaacatggtcacctacgccgttgagcaggtggagtcgtcgagctcacctgatggctacctctccgggctcaggatactgagcacgctcgtcggggagatagcgtccagctacgcttgtaccacgactcacgttgagcagcacaggatgatcaaacatatgctcatttctcgccaccatgtcgtgatgctgaaactgatacagacgctggagccacgaggcccgcacgacgcggaggcgagggagcgcgccacggtgatagtggcttacatcgccggtggcgttcacctagaacggctaccccgagcgctctgctgcgtaacctcactgctcgacgacgagtaccgcctcgccgagccatacgaccgtgatttggtgctcgagaagctgcaattgagaccaccaccatgccctgatgaggaggttgagttcgtggagatgtacaggctggtctacgagcgtgagcctccccatctgtcactcgagaagtacaagaatctggtggtgcagggccagcgcatcctcgggaagctcgccgccgacgaggacaactgcaggatcatgagcgacacccgaggccttgtctccacgatcatggcacctatcagctccggctccgaccatggaggacgaccacgacgacgaccatagatatgaactctcagtcatggcaaaggggtcgataacacttattggtcagcttgtctctgttcctttccaagactcccgcgtgaagctacgccgccaaatcacgagctgcaagcctgcaatcagcaccatggagagcatcctcaggtgcgacggttgtgatgcagagcttcggaggctagctgcacagctgctcacagttctctctctcgacaagtcttctggtggtatgagcagtgaaaacatacagggtctcatcaggatcctcacagacatctttgttcatgacagcaaacgcagctccgtcaggaaatgtgcaggcgaagagctggtgaagctgtctctcgagagcgaaagcaacgcctcgatcatcctgaagttgaagctaaatgatagtattgttgtcgatcgcctttctgagatggttgtagatgtcgaggacaacacattcaggacaagtgcggcagatatcttgaaacatctttgtatcaaccacactacggacgatgaacattgggacaaactgaagaactccatgaccattgcaataccaaaggtaatgatcgatacctgtcaaattaacacgtacaaaacgaaaaagttttatgctgaaataccttggggttaatgtttcaggtcctcagagaattacttggctgtgactggagacgaccagagagacaaacagtagctacacaggcgaacaattctgggaatttctcgccaccagatgcagacatagaagccctaccagacggtgatccttcacgagttagcaatggaggcaacaacgcctcatcttgttccaatcagcagaatggcaagcaatatactccagaggaaatagaagtgcaggaggcgttggcgtccctctgcgtgacggtatgcgacaagctgatctccacggatccagttctggctgatcggttcgacaagatcgcagccgacgtctgcttggattcaagtataactgccaacacgactgccaacacggccttcgctgccctcgtgaaagaagcaggagaagtcgtggagaagaggaaggcacaatcgatcgttggcattgcgcctgcgcagctggttaggtagagctcactttctactattagtccatcttaaagctaacacatatactccctccgtattttaatatatgacgccgttgacttttcgaccaacgtttgaccattcgttttattcaaaatttttgtgcaaatatgaaaatatttatgtcatgcttaaaaaacatttgatgacgaatcaagttataataaaataaatgataattacataaattttttgaataagacgaatggtcaaacgttggacaaaaagtcaacggtgtcatacattaaaatatggaggctataaggctgacttcaatttttcttctcccctctctttctctcacttaaacatttgatttatttgtcttggagcacgcgttaagctaactcttgcattaagctaacaccctcaaatgtcccctgcctttttggtgaacttgagaaccaaaaagcatatagcatgcaatcttagggcgataatataattatcggccattttacctcatagcgtgtgtttggtttggggacaaaatgggataggttagacctatcctatttttgggatgggatgggatggtttcagttatttatttggtttatggtataggatagttatagtttttatttggtagaagggattgaggtgggatgggatggacggatttgcactgaccgttagtgctgtttggctcctagcggtgggggcacaacaagcggtgagtgtgggggtggcggagcccgttggtgtgagtggaggagaggcggcggtgggtcgcggaggcgaggtggcttccggatttgggaggagtggcaatcgagtggcggcggtcgctcgcggacgaggcttgtagaactaggagaggaagctggaggtaggaagagaggtagagaagagagttcgctgaggttcatcccagaagcaggttgtcgccgccgccgtggccgaagccgttgatgcctgcttgatctgttcgatgtttgctgcaggagcagtaccatccttttgttccctgtcgcttgggctagcctaggcttgctttggagaatggattacatggcccatgttggtatttcttaacgacattactagaaatataattcttagcaatgacgcagaaatacttctggtatattatggttacagagtccatccgcaagcgcacggatataccattgtaacatttcatccgagagtattccaaggatatcgtatttatcttatcccgtgggaagatcatgtagagagaacatgactaataatttatatattgcttgtgataatcatattctaaacaggggttaagataatccaaggatatagtgacacacaagcataaactgctcattctcataatatattatctaagctaagtggaaagaaaagaggaagataatctattcctatacttctaatatacatagtatatatacatcctagttaactgatatactagctaataccctctttctgataccctcctggtacttcgagaagccacccctgactgtcgagtttcttacgacagtccatcatgactatacaaccggggctaaatacggaggaataccctcctcagggaattaacttaggattatatatcgtactgagctgtcaccatcagcggcccacctctcatccgtaatatataaccccaaataatgatatctcgtaatctagacaccacgtctaaactaccagatactactctaatatcatcgtcatgacatagagtaattgcataagcaaacattatacccgcaccaaagcatctcccagataagctagccgtatattcagtataacaagaacataatgtaaagtaggtactcatatactcggaaaatatttcaataccataaatgtatttagaagagtattctaataaaagtacaaagcttataaaagagaaaagaaaagctgctagagccatatccgaactcttccgaaggcttccagactcctaatttctactctattcctattccaccagctagatactactaaattaagcttgagagaaatgagagagctattgcttgaggtgtgtgagtgaagtgacaaggtgaagtccttatatagaggtagttatgacggttgtggaaggggaattgtccaaagtgccctccaaccgtcattgggatgcaatcctagacgtccacgccaaaacctggatccaacggcgccaggattggttcggccgaacctggggttggcccaatccagcccaatttcggctggtggcctcctctattgctccactccgcagacttgtgaattttggcccaattcatcgtgtcaattctgagttcttggcccattcatacataagtctgattgtcgacatcgtccgattgatttatcgtttatgttgacgtcgattctccttcactttattgtcattctctgcaaaaggttagtaacctaatacttgtggaatattattactctaacatttttatgcattgtaagcatcactagttctctcctattttagtagtattgacggtcgaaactgatcaataacgaccgtcaacagcccatactgcatgcgacccaatagagcttctaacaatcccctcttaagtttcggcttgtcctcaagccgatgaagtaatcctcctggatcccatggctgctctaaatatttgaattgttgactggagaggtacatattaggtagttgtttcttatctgtcttggtgtaagaacttgcagccacatttagtcaacctccttcgccattcaagcccccatgattagcttgcaatggagcacatcctgatgttaccagataagttgtcctcatagctcctatggtcagtccggttaacaataggaaattgacaaaagatatctgacaatgcaatttccatggacatcttttcttggtagcaaatgcctcaaactgatacaccaagtggactcttccggaatgccaaccttgataacaaactcagtgctccactggtcaaccctcgaatggaagtagtgttgttgaagccagtcattcagcaaaattttgagaaggtgaatcttgtcaacactaccaattggtcatgtatctggtttagtggctccaccaaaaggaattgcttgcctaccctccattgcatttgtataattcaggaaaccatagcaatggctcagctcacacaatttcttttccattataaccatagttaacccctctgtggtaagaacaacaaagaatgccaccagcaattttgatatttttccttgaaaacaataatgcttgtttgctgaaattatccgtaaccttgtactaactggaataggcagcagaatgcacaggtgctgtttagaaccccactgtttatgtatactctcgataggaacaaattcaagtgatcttgagaactgacaagcaattgtgaacttagcaccaaaatgattagttctccccattgtttcagatatccatgtgtttaccttgttcctgatcagtaagtgcacaattgcctttatttggtgagatagtgactcagtatactgtactagtacatcatgattagtctcatgtccatatgtgaccagatctccattgcattttctaaaccacatcgtaagatcagaacaaggtatcctccattccattctctgaactgatgtgtttgcagagccaccactaaagcaacaattgcaaatgtatggaagaattggtggatagttattgggagattggaccagaatttgctattactgacatggtgctcccttctatctccatttgaaaacagttgcactgatctcacctttgacaatgccacaaacacattttgcccacttccgttcgtgatgatatgagaaaatctatctattatatactaaaagtccattaaactttttacaaacgctcttaagccgccacgtggcactcctataaacactcttaaaccatcatatagcactatctaatctcacctttgattttcacttaaattggtagacccattattctacaccattagattagatctattattgtaaaataataacttcctcctgtttagataaaaagctgctaccggtctcccgtacgtacgacatacgagtagtacatgcaatttaaatttctactgttcacggaaggaaaaaaccatacaaacatagatagaaaagacatacctaattaaaaacttattccgcttcgtccgtcattcgtcttttgagtccgagtacgtctataactaatataaatattcggatttttccggtcgtcacatctcttttcgtccgtattttcgtccgtcctatctcaatctcaatctcaatcccaatcccaatccgattatgttagcgatggaaaaattccaaaaaaaaaagaaaaagaaatccaattcatcacagattcacatcaacggattctcaatcccacccacggattcgctgccaattcatcacagattaaatccacaagaaaggagaaaaacaaaaagacgaaaaaccgtaaaaaagggtgccgccgcgactgggaaaccaggccaccaccacctcccctccccttccgctcgcgctggatccagccatccaggacgccggatctgggataccgagccgccgccgcctgccaccgtgagccctcccgcggccccatggcgagggagaggaggcgaggggcggagaggcgctgccgcccgttgccacccgcggaaggagagctccgggctgaagacggcggctggagaggaggaggaggtgcggggtcgcaggtagagggagaaggagagaggaggcggagagaaagagtcgccggaggcggagaggcggagagaacgagagagagaggagttgagtcgcggctgggttggtgcggtgtggggatggatagggattaaacactgtgggccggctccggttttttttttccgttgatttttctgggatagattcgcctcttgcgggcacgtatcactgctgccaccgcaaacgctaaaaaaaaaaatgttcgatttttagtctattagatagactttgagattcgtgttcatggaatataaaaaataaaaaaaagctacgcacgagacaagaatcgaccctgggaccttcgttctgggcacatcatgctgtcgccaactgagcaaataaactttcttttaatagttgaaattataccctacttagatcatgattatatatgtatacccatttttcaccgtatgtttagatacgccctttatgattgtaaattagaaatatgcagtattattatttgacaatatattattcttttactaatagtaatttatatcttatactagcaaaatgcccatgcttcactacgatgtattaaaactaaaaatattttttaaccgaagtttatttttacactgctttggtacttttgctcgctagaaaaagtctcaaatgatagagagaaatatagtagctggatccgttcacggttgtcgtcaccaccgacggatccagccgccgatgctgccaccgccgccggatctaccgcgcgagaaaggcgagagggggcggagggagccgctaccgccggatccgcccgcaactgccgtcgacgtcgccaccatcctcggatccgcctgcgtccgccgccaacccgccgccactgcgagagggagagggagatgagagggagagggaggcgagatggggcggagagagcggccaccaatgagggaggtgagacggggcggagggcgcggccgcagccactcgttggggagaggacgccgcctccgccgctcgtgggaagtgggggaagggcaccgccgcagtcgcttgtgagggggaagggcgccgccgctgtcgctattcgatcgagacagagaggagggatcggtggcagggaggaaatgaaatttaaggttagggttttggttgcatatatttctataggttgggattaatctgaaccgtccattcaatcagacggctttggcttctctcgcattgggccgcggcactattgggcctccaaattggtccgcaagtttgggctaggataaaattagtgttttctctctcaataattctcaataattttaagcatctttctatattcagaaatagcattagtaccattttaattatttattactgcttaataatttaattccaactaaattgaattaactaaaaatttgctagatttttctcatgatatggatttatttttcgactaaaaatataattatttatttgtcatgatataaatttagactaaaattaaataatattaatatgaaaatttctaaactataagagctaatgtgaatgctccttttttattactttaaaaagttaataacattaattttttccgttgcaacacactattaagctactatatttctctctattatttgagactttttctaacgagcaaaaataccaaagcagtgtgaaaataacttcacttaaaaacaaatatttttagttcaatacaccgtggcgaagcgggcattttggtagtcttcaaaaatacccaaatcaatcaatcgacacaacaaaaaacagcacgaaaataccaaatttaatctagagctcatgaatttggtcctccccgccgcccgacgaccctagggacctccctcgcctgccaccgcgtcaccgtcctcgcccctccgccacgcccctccaccacggcgcgccgccagcctggccgacagggccccacctcctgccattcgccccgggcactggcctcggcgccctccaccggccggtcacggccgccgccgctgctcctcctcgcttagccgccgccgctcctcctcctcctcctcgccggccaccgcgtcgccgtcctcgccctccgccacggcgtccttcaaaaataaaaatcccccagcttgatccccaaataaatcgaacaatgagacaaccaaaaacagcacaaaaaagccaattttaatctaagagctcatgaatcccaatgtccgattccaaaaaaataaaaaataaactcgagcaaaaaaaaaaagaaaaaaaaaggcgaccggatccgccctcggctgcgccaccgccgcgggatccacccgcggacgtcgccgatgccaccaccgccggatccgccctcggcgccactgctcattagaggctgaggacgccgctgcccgaggccttggtggcttggcgggggcaccgccgtgcgccgcgagggtactgtcgccgaggagagggcgctgccagccagggggagggcgtcgcggctgaggcgctgaccgccaagggtagggcaccacccgccgggggaagagcgccgtcgaccggggggggggggggctgagcagccgcccaccgggtgaaggacgtcgccggccagggggagggcgccgcggctggggcaccaaccgccaagggtagggcgtcgtcgccggaggaagggcgccgccggctggagggagggtgccgtggctgaggggtacggggagtaacgctgcagtggggcagagggggaagggcggagatggagggcgtcgctagctgtgagtagagaaggagaaaaggagtgaaaggaaagagagcgcaacggaggagaggagataagggcgagcggcagaggagagaaacaccgagaggaatgagctcggcgagaacgaggagataatgacgggcggaattatcgaggcgcagggacgccgctctctccgctctgagcctctgatcggcagttaaagaaaagcaaatataactgcttattttaataaaaaagatacgtactatggcagtttgaaaatgctatttaaacaatggttttaaataaatctacacatttaagactcctttgaatcacagaaataaagaaatgaaaaaatggagaaataggagaaacataggatttagacaggaatataagtgtaaaacaaaggattgtaaaacacaggaaaaatataggaatgaccgtttgattgagccgcaagaacaaaagattcttaacatgaggtagaacttcatgctaaatttcctccaaaacttgcatgggaagtggcattccataggaatttcatgggattacataggattcattcctttgattcaaagggctatatagaaaaaattcctataggaatgaaatcctttaaaattcctataaaattcctttgaatcaaagggggccttagttgtgtttctccgtactgagcagttcattaacgcatgattaattaaatattaactaatttttagaaaaatggataatatgattttttttaaaatgcaattttcgtatagaatttttttcataaaacacactgtttagtactacctccgtcccaaaataagtgcagttttacactgttcatgtccaacgatcgcctttttttttattagtatttttattgttattcgataataaaacatgaatagtattttatatgtgactaatattttaatttttttcataaattttttaaataaaacaaaaggtcgaacgttaaacacggatacccacgactgcacttattttgagatgaatatagtagtttgaaaagcaaaaaacggggagtgtgagttgggaactcaaagaaacgaactgagccaggtgtcctcattagtatttctgtataaagtaatgtcaatgccattatatatgcatgcaccgcatataataaatggaactttgcatacgcgtatgtaaagtttgcatacgcgtatataaagtttatatacatgtatattttttatacgtcaattttttggtacacatctataactaatataaatattcgtatttttccgttcgtcacatctaatttcgtccgagttttcgtccatacgcaatccgattaggttagcaatagtgatggaaaaaaatgcaaaaaaaaaaaaatcggcgccaccatcgcccgcctccacgctgtccgggccgccgcccctcacgccccgccgggccgcagccgcctccatgccaccggatctggaggaggcgaggcccggcccgccgcctccacgccgtcctagccgcagcgccgccggatgtggcggaggcgaggtccggccggccgcctccacgccgtccgacccgccgccgcacctctcctccccctcgatctagcggaggggagggcgtcgccggccctcccgcgccgccacacagagagaaaggaggagaagtggagagagtgaggggggtgggagggcgccgccgccgctcctggggagagggcgccgcgccgccgatgctcggtgggggagccgtcgccgacgccgctgctcgcggggggagggcgccactgccgccgacgccgccgttcgcgaggggagggcaccgcgccgccgccgctcgcggggatagtgtgccaccgccgctgacgccgccgctcgcgggggaagggtggtgcacccctcggttgggtttccgggggggtggggaggggggaatgtattctagggttaggttttgggtatttatttaggttaggatcaatctagaccgttcatttgatcggacggctctagctgctcccgcatcgggccgtcggcctattgggccaccacattactgggccgccgaacggactgcgtgattgcatgaggacgtaaaatgaacttcaacggagaaagaatagtccagatacatatgataggcaaaagggaggtaatataaactttttcatattatgcccaaacctaaaagggaggatttttattctttttccaattaaataattgttaaatgatgtttgtattattaaaattagcaattaagctctgaaaatttaaataaaattccaaagagcataactaatcatggagaatttaataaaattaaatttaaccatgtcattttatttctcacacttactttacttgtaaattaatttagttttacacctacctacttaaaatattaaatatttcagcaaatttgtattttaattaattacatagtgtagatttttcttaacttttcctcaattttctggtctatacacttccggttgcaatgcacgagcacttttgctataatttcaaagagtgtaattaatattgcaaaaaaattatatttcattaaattagaatttaatattttttaatttaattttttctttcgcgatgtgagctaaacatgaatatttttatccatcttgattatcattagcgcaatgaacaatttacctatattggaacattattatatacatgttaacgatgtacttcatataatttaaccgttcctttacccgtagcgaagcacgggcattttgctagtagatatataaaaatggacggttattttccacaatataaacatgaaatatattacttcacaaatataatataaatatatatagttaaactaagatctataataaaaacatagaatactcaataaatgttttttaaaccatcttctaaattattttgaaattatatatccaatttgtgatcatgttatatttctttaattaaattataaaagttatattatggtcctaaatacaccacggcacatgaggctgacatatgtatgataatttttcaaaaaaatcacatcatattttacggagggaaatttcacttcacaaatatacaacattaatttaaatctgcatatgtaaaaaataaaagcaacacaatttagttgtgtttttcgagtaggtctgattaaattacaatttgtttgagattaagattctgaaagtatttttatatttttagaactatttgactatacatatttgtcaaaacatagataataacatgatgatctggatactatcgtggtgatatgtctcattagctatattttttaaaaaacatcatcgaattattaaactcggccattttcaaaagagagtattctatcttttcataaaaaaaatgagtagtaatgatcaacaccataaagaaattgtgtttacactgcaccacaaatctactcaaaacatttttaaaaaactactttggtcacctccatcttctctttgttcttccctaaaggacactaaacttagacaacaaagtttattatggtgtcgtaagtataaaatggaatatatgactaagttacagttccagtggaggccaccatcgctaatagtactcaactttctacttaccaatataatactccatgagcatgtgataatgaatcatacattaaaattatgctccaagctggtcttcaggagcatggctacatcgatgcgggactcatgtttcaaggcaatagagaaagaaagtcttggtggctacaatcgacttcacccactagagtagtattcgtgtttaactttaatggtgctactccattaatgaatagaagtggtggtatttttataatatttataaatggatttagaaaaaaaatgagatatgaaacctaaatagaggataatttagtgtattaattacttattaggttttaaagcatagtaagtaatggtgacaataggagaatttatatgtcactcgatcaaagtgtatttttaatctgagatatattcttattattttataacatttaaatagaaatagtgagatgtaacttctttaagcattatttttataaaacaatcaataagatgcccgcgcatttgcgcgggctttctttctagttctactaaatagcaaccggattattcacaaagcccatctggaggatcatactgacttgaatgtatgcacaaggctccatttgtgaacaagcctcgaagcttccgcttgaatccgtcatatgtgcagtaggggaaatttaaccattgtataacacttgaaggtttcatagcacccatctgcatatagcacaaactgaacctcacaacagtagctacgtatatcatttttgtctctgcaataacacaactgaatccattatctaaaaaaaaataacacaagctgaattcctcaaccaaaattgattccctccatgataaaactcagatttaatcacatcttcttgaggcggtggccagcatggcaattcctttagaaactgctcaactccattcacgtacagtaatagtgtgctctccaatcggaacaagtaccacactttgcatcgattacacgcaaacgatgaccatggttctggccatagctcacatatgctacccgttagcttgttcgaaggaggaggtggccatggattcctctcagcatactccattagtggctaacatagagtcataagtctgatagaattgtcgctagcacaacttgatttgacaacaaggatgactgacgtattcataatggtcagaggcagagttggaatgatgctatgcccattcatagctgtaatggtagggaacacgaccacaggttggttggcgctaccattgacatcgaggcccaaagtcgaacacttggcatgcgtcgctatggaacaatgagggttgtcaatgtagatgacactggtttcatcctcgccaaccaacaactccatggaggccatagaagtagtggcacatgaaacccccacagccacggtgaggtctagcatgatgtcagggctagaacaattcgagcacttggcgggcgtgaccttgggtgagtcgttggtgacgatgcagggggcgtgccccttgtccttgttgtctcctagctcccaggcagccgttggagcaagcacctcaccaatgtgacttgaattcgccatcacccaagtgaagttgttgttggggcattttgtcaaacacttggtcggtgttggaggaggtggtgccatggtgttggagatgatgaagccttgaggatggcggtggttgtcctgatggcagcaatcgtcacctcggtagccttgctcctacaagcctctatctcctccaacttctgtagtatttgattgaacttctcctcttgcatgcacttggcctccatcaactcaagcttcccaagattctgatctaaagattcgtccatggatattccctccttgttcatggtggatttgatggaaacgggctctgatatcctttcatcgtccttaaacaccttatgttggtttggtattctatcgaacaggttgtgtgcgctagattcatgagcacctcacttgcccaaatcttcctccaccttgcactgctgccttcccaacacctgcatgacgagaaatcccacgaaccgagcggctctgatactagattgttaggaacccacttcttccaattcaatagcaaggatccaccatacaagcaacaattgttttagggggaaaagagaagaagaaactatggaatacaagttttggaagcttctagaactagcagtggaagctggaggtaggaagagatcggtagagaagatagatcgtcgaggttctagcctagaaccttgacgccgttgccgccgtggctgaagccgccgatgcctgtttgatctgttcaatgtttgttgtaggagcagcagccatccttttgttcccagtcgcttgggctagcctgggcttgctctggagaatgcatggtccatactgcatgcggcccaatagagctcctaacaaggtagcgggacgtcacgtctcttttgaagacgccttggtcggtcttgaggaagcttgcgagcatcgtcttctcacacgccgccatttggttttcaaagtctcgccactcctccttggtccagtcctccttggtgagcttgtcgatctccttcccactcgtcatggttgatgaagatgtttgtggatgaatttcgatcatattaattatagctgaaatattttgaccaaatagattaatatacggtctatagttttcttggtatgctactgtatttggaccaattttatcaaacttagccttgttgattgatcgtaacagggtatttggtactgtagcaaatataccaaaaattaaccgatgttaaataaaatcggccgctctgttcctatttcttctcagtaacagtgtgcagcaataaaaggaaacaatgttgctgctgcttatcttggtgctttctgccggttagaccggtcacctcaccggtcagaccgggcctacaacgtcggttagactggttcagaccggcgcggcggtaagagaatgatgtcgccgatctgatccaatcaactgagcgatcaatttatatgcgtaagcaacaaatatagtagattgtttctggccgtggtatggccaaaattcttgacgttccccagcagagtcgccaattcatgttggcacccttttcggtcccaaccatgactcatttaaagatttgtggtgttaatggagtcaccaaccacctcgatctagagaattctaaatcaagatgggctttgaagattaaaccggctagtggaggcgatttagagatcaaattagcctcggggccgatttagattgatttgaagataaccacccgtctcgtgggcgaacggaaggttataagacaaatctacaaagagataatcgcactctcgtagtgaaggcggacggtttacggcgcaaaccgacaaagatggacaaaactaaggtaaagtagaaaaaatggctaaaagtagaagtaaaaaaacgattcgattatgtatggattgagatttgggggggagggaggtcgaaccgaccttggctattataaaggagttggtcttgtcttctacatgttcttctccacgtttaatttggggtggaaaccaatggaaactcgaaaaatacctttccaagtaaggaaacccgagacccgatgaaaatcggtttggactcccataggcggtggtcggaccggccccgtgaaggaaactcggcgcctttcaaattttggcaatgttcataattcgaatctaggtgtcaaatttagttgtaaacagttttaactggaaggcttcatgatgttttctagagtttactcttgcgagtttagcggatcgttgtcagctcctgttacatatgtaacgctcctcgaccagtccaccatgtgttacatatgtgcatcaattacgtctggttcccggcattcaagaaacaataataatcccagcattagtaatctagctagagtgtgggtacacaaacagtgagaagcataatattgtattgtaacttgtgaggccactagctttaatttatttgtaggtcttttatattgatctactaatacataaatataataaagacctagctaattgcttggtccaaaactgaacaggctggatgaacaatatatactttacaatgacctcgatcgcttcgtgcaggtaaagtcaagatctgaacatttttcattaatcggctattggtctacgtattgatagttaatcatcccatatgctcgaggagcttgtatatatattggcttgctgctttgcaaacgatgatcccaactttcttgaggaagaactgacaatggctaatgaacctgatcagtccgagtggaaggaagttgacggtatcaacagttatgctctgtttatggggtacctgtcaatggccgtcaaggggatgggcttcctagtaggtttatggaccaccgtcgtcctccttggtggcttcgtctccatgcttgagaagaaggatttttggagtctcaccattatcacccttgtccagacagctgggttagacttcttaattctactatacatttgttgtatttcctattcgtcacttttttcttttcttttctgaccatttattgctcccaatgataatttttctttctctgaaaaggggctaacaaaacacactttcggaacaaagattttcataagatcattcttcaggaatttctagtactgttcatgttcatttggaaggaaagatagagtgcaaaggaatttgctagcaatattgtagcatttgcgaggtgcctgactacacggggccataatttctaatccactaagttctagagtaaagcaaagcccatcttgccccaataggaagatttcatttcaacccaatactaaaaggatgatgcttttcaatagaactactgggtgacccgcgcaattgcgtggctagcacccatacaaaattatctactttttacatatgattttttcttaaattttgttaaatagttcacgtgtttctaattttttttattttttaaaagtcacaccagtcgctaccccttactcctttatcactcctttatttgcatgcgatctatgactgcttatattcattcttcttggaacgtttaaaaattagacattgtagtttttagagttcattgtctagttgggttttgttttataatttttagaagtctcgtcaaatgccaccactttactcctttatgaccagcccaccgacttatctctttattgcgattgatattttaaaagacaaacataattatcatttaggtcattttttactttctagaagtcctatcaaactgtcagcggctttgccaccgtactcctctatggaccacccgctgcctcccctcttttttatcatgagattttaaaaataaaatatgattatcgttagggtatattttttactttctataagtcccgccatcgtgaccgtgatgcttaatggtctacccatcgtccctccacttaatcatcagtgacattctatttgggttttgtttatatcttttagtgtcctatcaaccaccaccactctactcatttattcgaactctctatttttagaatttattttattttttattttaattaatctcatcgtgtgttctatgatatcttctttatttgttattacgaatcttagttatttttacttttctaatttataaatttattttattttaatctcatattgtgttctatattcctttttatcacgtcaaaaaaaaatattcctttttttatttccaattttagtttttcttaaattgcattcctatttgaactctcctttttattctttaattttggaatttattttattttattttttatttcgaattttaattaatctcgtagtggattcttatttgtactattcttctaatattgtttattcttatttccaaatttcagttacgtcaaaattgtattcctacctagactcttattattttttaatttcgtattttattttattttatactctgaatttatttaatctcgtgctgtgttatagctaaactattaatttaatattccttattttgtattccgaattttaattatttctaaattgtatttctagttgaactcttcctgttcttttcctaatttcagaatttattttatttttttatttcgaatttcgattaattttgtattgggttcttatatgaactcttttgcaatattgcttatttttattccgaatttcagtgatttctcaattgtatttctatatagactatcctttttctttttttttcaattaattcaggaatttctagcctacacagcgaacatgatgccttcttattttaataatataatataatagatagatagatttgaggtcaattgattgcttgagtacgacatttactcttttagcattaatatttgatgtttattatgtaccgtaataaataatatgtattcaatttgtataattcactgaactatactttggctaaagttttcaattttaaggtcgtcttttgtactcccttgcagggtatgcaattttgaaatgtttttttgttgtcgtggggggtcggaaaaaacccaaaaatttggatattattcgtatgaatattttgaattcaaatatgaaattttgttacaaaaaacaaaatgcaatcaaaatttcaaagttctggaaatttctgggataaaataattagtccacgcaaatcttaatttcttatcggataatgcatgatttccagaaaaaaaaatgagcttattgcagctgaattatttagcagttacatcacgctaaattgataaattgcacacatctcatatccatttaggactggcactctccgttcttcttccaacagttgttgctgctgatccccttcctcccaccccgctaccatcattgttgcccaaatcagttacaatagctgtgcaggcggctgacgatccaggaccaccatgaccccatgcgtctccccctgccaacatatgcaggatcttcttcttccatgaccccaaatcagtgtgcgcactactataagaacagaagaagtgctgagggacaaatcccatagaggcggagagacatatcaagatagtgaaaaaggaaggatggaggatgaaggagcaaatcatgactgctgctgcctcaagaacctgacgctgagtcaccgactccaggagcagctgagctgttgtcgccgccagttataaatggctaaatgggccattcggtacggtccagcctgggcacgaccaaggcacggctcgagagtaggaccaactagccatatcgtgccgtgcgcatctatgggctgcaccttcaatgcaggcacaacccaataacacttgggccgtgccgtgccatgtcggccagaaggcacgaccagtccactgtactcgtccttggaatatgtctatttacctccctcatctctttgggcctgcttattattgggtcttgccgggccgggccaactcattgtgccgagaaagaggaccaggcatcgtcaatggttgggctgggctaaatctccatgctgtggcccggtccatcgggcaacgggtcttttagccaactatactgctagcaggaggagcgccgcctcctagggagtccaagccatagaaagggtttttggcaccgtcgccgccaactccaggagtagttgacccatcgtcgccgctagtaagggtagcatcaccattgcttggaaagttcaggtcgcaaggagtgttttgggcgccacagacggaattgaggtagtgggattagtgtttggttcttttttggggggcttaacttatcggaaaaaatccatcaaatcctatatagacagtcccttaacttatagctatttttttatcctgaaaattttgaccgtatctacttgttccgaaattgcaaacactcctctatcttaaaatatagctatcttcagctatgaatctagactgaatataactattgcttcaactatgaatctacatatctaatctagccatattttaggacggatcgagcattttcctatgggtttcaagttcctaaaaagtagaaacatttccagtacactccgacccatttcgtcgtatctcccttgtccaggtctaacggcgcctctatctaactaaatttacagggtgttcgatgttttcctgaacgaaaagctgcggtacgcttggaaatcgttcgatggcctcttggttactgtagccatggtgttcaggaaagaggacgacgacgacgactcggaccagtactggcgtgcactggtggggattcttgtgttgctcctccaggcgctggtgatcgccatcatactgctcccactggcgttgctctacctgttcggccttctcgtcagcaccggcctctccatgtggcgcctcatagagcgggactacggcggcgaggacggcggcgctaacctgaccccggcgctcaatgtgctctactcactggcgctcttccagggcgtgctcttctgctaccagtcagcctcctacttcgccgggaaacggctggcccgagtagtcgccgacgactacgggttcgacaaggaagacgaagaggggcgcgagtcggtgagggattacatgcgcaagaccaagatcggttgcgagaaggatccatcattcgtcaaggagaggaacctggtgacgtttgccgtggagctgatgaagtccgagtcgtcgtccgccgactacgtctccggtgcgaggatcctggacaagatcctcgcgcaggaggagctgcaggggcagcacgcgctgatcaggaagctggtcggctccgcgtcggctagccaggtcttggagaggcttctgcagtcgcttcgctccacaagcccgctcgaccgggacgtccgggtgctcgccgccaggatcgtggcgcaactcgccggcgagatcagcctcgccagcttcccgcaagggctccggtgcatctcgtcgctgctcgacaccaccaccaccaccaccaccaccaagcagcaagacggcgacagtgccccgtcgggtcactacaaggagctcatggtgctgggccgagacatcctccacaagctcgccgccgccgacgagcacaactgcagcgccatcggcagcaaccagggcctcgtctccaaggccatggtgcccgtcaccgccgacctcctccacaacatcggccacgacgcgtggtccgacatcgtagccgcgtcgctgcagctcctgttccgccttgtcgccctccctgggaaggccggcgacaagctgcgttccaacaagcgcgccatcaacaccgtcgagaagatcctcgggtgcgacgaatgcaacgagaagctacacgtcctggccatcaagatcctcacgcagcttcccatggaagcaccttcgacttcgacagccgatagcaaggagaaaatcaccaagctgctggtcgacatcttcttcactaaagaaaacaaggacgcctccacgagacaattggcaggtgaagcactggcaatgctttccgtcgaccaaagcgaaagcaacgccgccatcatcttcaaggcgagtgacaccgttgtcgatgatctcaagacaacgctcctcgacgttcgcaccaagagcggatacagaataagtgcggcggaaatcctcaagcatctatacatttgttacacaaaggaggatgacaatctcaagaaactgacggaagccatgaaagatgtgctgccaaaggtacggtgtgtgataaaatttcaaacaaatgaaggcatttcatttgtttcatacttatttaactaaccacgcgcaccttgggtctttatcatcacctactaattaataagcataatttctaccactgcagatgctcaaagaaatacttccctctcctccattgaagcaaggagaaaagcatacagaaaaaggaacagacgcaaccaagtttgtgacacaagatcctgaaataggcgaaggtgccgttgctacgaaagatagtggcaacgtcaatgagcaaaaggacgacaacaagaaaatcgtggacaggaaactacatgcagctttactgtcacttagtgcggcaatatttgaaaaattgatcagtaatgatacagatttggctcaacttgctaatgcaattgcaacaggagattctgcatctagctttgccgggaagctcaagaagttggtagaagaaaacagtgaaccaacagccaattgcctgagaatactgaagattgccagtaggatgatcatatcactgataaatctcgaaggaaactaccccaaagcagagctggagagcttgatggaatctctgtccaaggcttccaaagagatgtttgaactggaagcgttcatgatgttctctagcagcgaccagagcgcaatgaatccagtaagcattctcggttctcaagtgaaacaagcacaggtccttctggagaataagaaggaacaaaatgtggcaaccacagcaactagcactgtgagtctgtgaatagaaaccagttgattcagtagattatcaactaatctgctgatcttcagaatgcagaccgttggcgatccctgaaaattatcttagcggtattcttgtaggataaattacttattccgtgtttctgtagcatgtgtgctgaaatctagctatcttgttccatctacttatcaaatgtcatgactcctgtacgggtgtggtgtctgataagttgggactacctgtacatttgtcgacaaattttctcctaaaaatttgacagaatgtagtacaaccgtattgtaattacactgtaacttgtatgtaattacactataacttgcatgtaactacagtgtaacttgtatgtaagtttcatgtaattttgaatcgttagatctattacaagatttgttccggtgaggaagaaaaaaaaatcacagcacacacatgtgaaaggatttattcccacgacctccattttaccgaaataacatgttacggagagatttttgaaagttacatacaagttacatgcgagttacagtataattacatacaagttacagtgtaattacactacgattatactgtaattacatctgtcaaatttttggaggaaaatttgtcgacaaatatatagcaaattcggtttgggtttatggggtcagctgggccattactttgggccttgttaaatgtttagttgggccatgtctttgggctgtgagagtatgtgtttgatgtgtcgtgctagactagcggtggtatccgtgtgcgtgtgtgtggtataagaggagaacccatggttgggagtttatgcgataagagaaaactgaatcctcctgccaactttgtcttcttcttcctctgttcttcttctctcccacgaaagggtcactttggggaaatggaagagagctgaatatgagctcttcttaccaccctcttaacagatggacaaactgagaggctgaatcaatgtgtagaggctttccttaaatatgcagtacatgctttcccaacaaagtggtcacaatggttacccaggcacaacattggtataacacggctttccatactgctttgggcaaatctccctatgaagtgttgtttgcaaggaagccaacacattttggtgaagtggaccttggacctaggatagagtattgcactagatgtgcagtcttggttgcaagacagaactttgtacaatgaaatgctgcatcaccagttgcttcgtgcacagcaaagaatgactcatcaagcaaataaacacagaactaacatgaaatttgaagtgggagacatggtttatttgaaattgcaaccctatgtgcagatgtctgtggctcgacgcacttgtcataagctaagtttcaggtatttttgggccttataaggtgatagacaggattggagcaatggcttataaattcgaattacccccgaatagccagattcatgcaatggtccatgtatcacttctgaaaaggcggtcaaagcaggtatagtggtgagtcctaaacttcctaacccctgtattgatgcaacaacagaagtgcttcctgaagaggtgctccaacgacggttgatcaagagaggcaagtcgctgatccatcaagggctggtacactagagaggaatgtcagcgtagttggcgacctggaaagatctgcgacaacttcaaaagcgttttccagatgcactggcttgaagacaagccgattcttaagtgggggagaattgtcatgactcctgtatcggtttggtgtatgaagtacttgacttatatgtgagtttatgggttcagctgggccatgacattgggccttgttaaatgtttagtcgggccatgtctttgggccgtgagagtgtgtgtttgatgtgccatgctggactggcagtggcatcagtgtgcgtgtgcatggtataagagaagctgtggttgttgggagtttatgcgataagagaaaaccgaatcctcttgccaactccgttttcttcttcctgtgttcttttctcccacgaaagctatcaaatccctctacccttgtcgagatgccacggtagttcctcgagtcgtatcgtcaaacttcaattccaagtaaaaactcactacataactatgttgagaacatgagattttgcgatggtttctatatttcctcacagacttgcaagtaaccaatcggaaataaactttgtcctattacgcaactctcatgctacacaaagcagtacaagagggtccagtaattctacaaaaagtggaaacacaaattttaggggtgagactctctttactattcaatcctccaatcaattgtacaatgagtagccccctcctctctttatatagtgcaatctaatatatgaaaggttcggtgatggggccaataagtgtatttaggctaggccttcatgggccaagcccaaaagtttctcaacactcccccttgagcactcaccgcgtaatgtccatgcctcgtcaaaactccataaaaacccagtgggaaaaattggagaaagagtacatggcatacgtatctatgtcgcacagattgcctcattaaaaaccttgataagaaactgcaggaaaatttatccaaggaaaaaaaaagagtacaatctacccaaattcttttatcgattttcttaatcgatttttgggtactaaattctttagtttcaagcttttgttaatagactggcaaaattctccccttgaattttgcatctcttttaagtgtgaaccgtcaaaactcattgcttgtatccttttcaaaagatagttcgagtgatgctccaatggtcaaatcttgcatgattttccatgacttatatagttcgtatagtctattagtgttgtgcgacgcacatatcattatcttcttgataatggatttggggtttggataaagttcgaaccatgttacttgctagaaatggtgaactatatgcatggaacctatgtattttcacattctgatatactatggttcacttcttcatgtgttgtatgtttacgagcctaagcaacataggtttctatctattttatctcaaactcgttcggaaagagtgagctttctttctttatgtgatgatattcggatcatcaacttggtttcggatttttaatgcttgtatgcgggtgcccaatccaaaatttctctagccattcattgtcaactataggtcagctttgcggtttgatcttttagttgattttcaactccaggttaactgccaatgatttgctgtatgaagagaatattgcccatagcaggtctcattaccaattcttattggttgtatgtgacacttatgtgagtatccatggatatatggggatatgcaattctcttatgcttctattctttgatatgggcatgactctttcattttaccgacgttggtgtgcactccaactgctggttttcttccttgataggaagatgtggtatgcttgttctggggttccataccatttgccagctttgaactcgctcccttcaaattctggggttatttttagtgactatgagcttgagagttcctttttgttccgttttcaccagacgtctcctgttactctagggatttaaggagccggagttcttgtcccattattcttctctaggcctctggacaatatgaggtatacctttgcattcctcggtatttcaccctcctccggtgcattatattcaggtaatgcaacttagtcatgctctgcaaatcacaaaactgataggcagttatccaattacaaagtgtgcttttcatactttgcatttgctagtgcttgattaaatgtgcatccatcctttctttgaccatttttcctgacatttatcatttaagggttatttctgtccccctaaatgactggaaataatccttcttattgtcaaggaatttaagctacgttcatacctctgttaaaaactttcaatttttttcggagggagaccttatggttgtgggatatgcacatgtgtcgagtcaacactagtattcttttaagtggacaacacattttgaatagtctggatattgataattcattgcctttggagctaagagtccattgaagtggcgggaatttcaataatggtgcagtggacatttttagtcctattcttgtggacgtccggtacttagtgcttttcttaatgtgctgatgccaacatgcgtgatcttgcaggatcgatttggcaagagcgtagtgtcaattagacacaattacagctttttcataagcgcagtatgcattggatgatccattaaaggactaaatatgcatgcgaattcatgtggtatgcacgaatttgttccgatataccttttaaggtacgtcggaattcatgtggtggttggcgtttgacacgcattcgatgttcaatggcatgcgcgaccagagtgaccacgagatatgcagccggtgcaactatggtgcatggtaggagttgcatggcgcgtgctaacgcggcatgattcgtccagtcccccagtacagcggggttgctagtagctgccttagtgggcgtcatgatgctgtatgatgcatgccagtgcctggcgcaagtctggcgcgaggcgctaaggcagtgcgtgcgacaaatatctcattgttgcgatacgacagatgatgtgagattgtttgtgctatgttcatttgcaagatactaaattctaagaaaaactgactatgaaatagtctactttagcctacatttcttagtgaggacattgatctcgcgtgcttaggtgatgagtatgcttctctcatcttctaattcctacaagggacctttggtgcgagagtttgccattcccaagatatttgaggtgtaatcacttttctacgggaaaaacaataacctttacaatcattacgtgcggttgtgaaggtagttcacgtctttgcatagactgaacttgtcacatgtctctcaagattacactttgtggtgcttttgttccacaatgctcctcttcaccttgggctatgcatattgtctatgtgaataaagtaaaacatcactacttcaaggcaagaagtaaaactttatcatatagcaaaatgcaacataatattggaaataaagtctagccatgcatggcgaatcacaaaataaatgttatgctctcatagaggttaaatatccattattcaaagaagttcataatgcaaccaagataagataattgtataaggactaagacggagtctggcgaagcctccatctttgcaaactcttctcctatatgacattattgtatcaaggactaagacggagtctggggaagcctccatctttgcaaactcttctcctatatgacattttctttgctcgctacgactatggcaggagcggggatgtcaagtggagtggtgatggaaagggttgccatggcatctactactggggtgttgttgattggaaccaaatgtgcctttgtggatgccttggccttcgatttgcccttgctttcatgtgctttttgggctacctgggcatctggagttccttcatgcatattcttaggtgctttcttcccaccttgcttgcccctcttcttttagatgggcttgtgattcttgtaactgctagtatcgaccttaaggtcaatacttttgttggatggatgggaaatgaagttcttgcaaagaaccttgtcatgggactcaaacatctgcgtgatgttgattatctcatcatacttcttgcatgtcatccgcctgtggttacgagtgctatgcatagcgctgaggtggaaggtggagagcgttttctcaatcttctccttgtccgtgactactttgccactcagggagaggttgatacatatctgatgcaaggcggagttgtattcggtaacgcttttatatagttggcaaacctcaagtgtgcccactcttgctctgcttggggcaaggtggtgtttttccgcttctcgaaccactcctttagtgtggtccaaagagtgagcagacccttcgttgccatgtgttcattcttgagtgtggcacaaaggtggtgtcgcaggaagtacatcgcctgatcgttctcatcaggtgtcggcataggttcttgtactgtgcccatcccaaatgtcttgaggagctttttggccccaaggacaatctggacattggatgcccaggtcaggtagttctggtcatacggggccagttcagcgaactccttgttcgtgattactaacattctgttacaaagacgacaaagcattcaagtgttacttgctattatcatggttgcaaatatgaatacaaatatttcatgatttttccaatatttcttatgcaaaggaaatgctaattatacaaagaaacgcaggtaattcaaagtaaatgcaattttcaataaagaaatactagagttcatacaaattcatacaaatattcataaaaggggggcaaaagttgcatgtattcatataaatactgaaaatgaaaattcaaaataccaattaacattaattaatgcctcgtgaaattcaaattaaaaatttatatgacataaacaaaatgcttaaataagaaatgcaggcgaaatatgcaagtacagggggccctttactaagtttccatgcggtggagggatgaaaatggaaatttctgaaattccagagtctacgcgcaaggaatttccatgccgagagatatgcgcataattttcagacaattcaggggcccttttgcaaaatcgccaatctctttccatctttcttctctttctattcttcttcccgtgaatggtgcgcccggtcggcagccatgcgtggcagcggtgtccatgcggggcacgggcggtgcgcgagcacggctcggccggcggcatgcggtggacatgcggggcgaggcgcggacgccggcgagacgcggcggcacgctgcggccgtgcgggcagcgcagctgcggtgtgccggccaggcgtgcgtgtgcggtgatggcgcggcaggggacggctcggcgttgcgcggcggctatgcgggcgcggcacgcatgagcggcgtgcgatgacgccgtgcgggggcgcggccggcgagcggtgcgacggcgccgtgcgggggcacaatcggcccgcggcagcgtgcagcggcaccgtacggggcgcgaccgaccgtggctcgcggcggcttgcggcgcggtggcggtctgtcacgaccagaaaatcactagtaatttccgaactaatttgtgaataaaatcattgtccagaaatcagccgaggtatacaaactgacaatttaatatacaaattcatcataagaactaaagcaataaatacttacataagaggtacctagtcctcaccacgaagaaaactgtagcagaaaaataaaatctagcgaagtttcagctccactcccacagacagctcaactggggtataagtcaaatgttttctcctttgtaacttgtcttcaactgaggtttgattgattattccaaggtgagtacatggaatactccgcaagccacacaacatgtacacaagtgcacaaggataccaaagaatggcataatatagggctcatttgcagaaggagcatttagcaaacatttgagaattgtaaagcaataaagtaattaatcatcgatattaatcaacactgaacagcatacccatgctgcacaggcccaaccaaacctgaacaaccatacccggctgtacagatctatctccaaactaggaatgtaccattccaaaccaagagctaatcaaattattaccagttatagcatcatttattatggtgagaagtgtgatactaatcacgaaatacattgttagacccacccataaccgcgggcacggctattcgaatagttttactatggccaaagatgtaccactgtacccacaagacatagccccacgacatgtcaccatgcgccttaataccaccacggtacctcggaaaggagctgtgacagtacccctcgcataacacaatcccccacagtgcaccgttcctggatcataatcacccccttataaaacaaggcatggactccccagcgacccccgtgggcttatctccgccacttctcagtctggtgccccgcaatgaaccatgctatacaaaaggtaaagccgttacccatgctggcttgtggttggcacggttaatgtttcacaaccgaaactcgtgaaccggtccttaattgtcatgagcacgaccatcaaaaccacgtgctcacaacccaccattatcaagttttagttagcgaattaattaattaaccaatcacaattaaccatcgtgagctatcattaaatatccatcattaagtaatagtgaaacattagttatcccaattgtgtgctaatgtttctaagcatggctaaccaattatatctaatacatctagttgaaccgatatataaatccgactagtcaaattataacccgaggtaatcaagaaatagggtaatcattgcaaattggccataacaaaggaataggttcacaccacccggtgacattcgaaaataaatgcacgatttaattaaatagagaatttaaatataggatcaacatgctcaaatgaattgtgtttgggatctgtgtgactttccttgcaataatcggtcttcaattagttttctggaatacttccgacacactcgcgaacctccgaaaagacggaaaggacaagctaacacgcaaaacgagaaaaaagactaataaaaaccaaatgaaaagtacatatctataactaatataaatattcggatttttcctttcgtcaccacatccgtacggtgatttttcgtccctcccctccctcaaaaatcccagtcggaattccatcatcacacaaatagaatcccacattgagcacaccttctctccaaatctcaaatcatcacaatccaaatccaaatcaaacacaaaatcccagtccaaatctaaatcggaatcattagaaaacatcatattaacacgagatgacgaggagagggaggggcgagccggaccggaggctgcagcgcactgctcctcgccacctcgccgtcggccacggacccacccgccgacgccgccaacaccgccatcgccgccggatcaggggcaagagggaggcgagaggggaggagggagctgccgccggcccgcgaccgccaccaccacatccggttccacccgcggctaccgccgccgtcgacaccaccggcggatctaccgagagagtggtgcagcggccaccacccgacgaggagagaaggagccggcggtggggggagggagcggcgtcaccatcgccgcgtcgccgcagccgcctgccgcgagggagtgtgccgccgctgccgctcgtgggagggcagggcgccgctgccgccatcgtcgccgctcgcgggaggaagggcgccgccgctgtccgcttgtgggggagaagggtgccgtcgccgctgctcggtaggtaaagccaccgccggtggggaggggggcaagaggtgtcggcggtgggggaggggcgttgagaggcgtcgccggttggggaggggcgcggagaggtgcgccggtgggggtgtggcgcggccggcggcggggagaaaggcgacctgcgtggaggggaggaaggggaagaatgaaattagggttagggtttatttgggttgagggttttgatagattaggagccgatatgagccgtccatcaaaacgaacggctttgatcactcccgcgtcgggccggtctccatcatcgggccgcatcaatgctgggccgcgcacgcctcattggccgcacgtaggtcggccggcccaacaagaacttaaattagatttccaattaaataattgttaaatgatgtttgtattattaaagttagcaattaagctctgaaaattccaataaaatttcaaagagcaaaactaatcatgaagaatttaataaaattaaatttaaccatgtcattttatttctcacaattgctttacttgtaaatttatttaattatatacatacctacttaaaaatatcaaatattcagagaatttgtattttaattaattgcatatttttctgatctgtacacttcccattgctacgcacgggcacttttgctaaaccaaacaacacttttggttgatatacacactccataatcacccagtgcaatgcacggacacttttgctagtaaagtaaacaaacatgtagatcataattttagataaattatgagacttgaacggcctcattccgacttcgtacgaattagttatgaattttacaagatttaatataattgaagcctatttaaaaaggattaaatgaatttaacacaaataatggataattttaatatatagatcttcattttatacaacttttgcaacttgaaccacattaaaccgagttacaatgaattagttacgaatttttgaagtttaaatcgagttaaagcatttataaagattttaattgaattatgacacaataaagaattacttttgaaaaggaaaagagatttactgcgtcatcaaggacggtccatgctaaaccgggttcacagaagcggtccacgaaaccgacggccgagatctaattgacctaaacttgaccaaatcggacggccgagatcgttccggtctaccacggtctacaaatgacattacgatgacgtcatcaccggcgtcggctcggcacctcatgctagccggcgaacgacggcgcggtggcgcaaacggagggcatcaacgtgtagagcgtgacgtggccaactcaccgatggctcgaacgacgacggacggtgacgatcgacaatggcggcgaggtcgagacggcggtggtcttcgggtcgacggtggtggcggcactctagctgtctgcggcggaaacgaagggcgggatggggacggcggcaaccttgcgaacccgacgaaggcaacctcgagcgatggtggagactatagcggcggcacggcacgaccgtactcccttcgacgacggcggcgcacgagctagcgcggctagggtgctacgggtctcgtcggcggacgggacttgaggggatgggtagaggacaactaggggggtgctttttatagcggcggagggcgccagctaagcccatggaggcaccggtggattaggaaagctctagggttttggaaagagaagcaaaccaaatcggcatcgaatccgacgatttccaaatgaattagctcgggattccaaaagagaaaaagaaaaggagatcgagtcaagtgatttcaagagaaaaagaattagctcgggatttccgtatgcgttggaggaatccgttacaaattatggaaaatattcctatgagtcgagtgatttctaaagtcttacttggaggggatagagtttctattatatcttatgggatccgatgtcatgctgcatcggttaggttcgatctactagattgttgttgataatatatatgtcttgttaagccgataggttcatgctaatgttttatcggggtgctagccgataagttatatggacgttgcattggcttgtaaggattgcatatacatataagttggacttagccgatcgcaacaaaggtttcactgtttatctaaaattgtggattttatgacatcggacctccagccgatgtatgctttaaccttcggatcagtgcttattctatcatatcattgcctttatatcgatcagtgcctttatatcattatttacatcgagtgttagactctacattggacatatagccgataactcaaaaccctatcgctataccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgtaacccttatggggaataataaatagtccagtctttaaacatagaaaatagacccatgatcatgaattcatattgcatgtatccagagcaagtccaaattgaaggtatgatacttgtgtttgaactagtaagcccctgagcacgtagtcacaattgttcattgatggtagctgacgcaactggcatagagacaagacgaccaatacagagataatattgcccagcagaggtggcaaaaatattggtggtagtgaagatagtgataccaatcaaaagtgatgaagttgcacagccgtggaggcgaagaaaccagtcggcagcagtcagccagcaatgaatatgaaggcgctcagcaataaagttgtgtagctatggcagcgaaataatcagtcggtgacagacgaggcaaatcaaaggcgatgacgaaatccaccaatcatgaagatgaagaaaatacttgacgacgacaaacgcaaccgacatgatgaagatgacgatgtcggtgatccagccaacagcagtgtagcaaccaatgataatgacaaagacgctcatcagcatttgcatagtaggtcaaccgtgaaggtgaaataataagtcggcaaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgacttctggagttgactcgtgggttgatgaattgatttcttcagcttgacataaaatttgtcaaattttgagccttgtatttgtgtagcccccgactctttgattagttgggaaacaactgaacatagagtcgagaactgtagcatcttgtcgtcgaatagttattgcttgattgaagatatgtgttgaagatgtccaagtagaaatcatgaatgttggagagccacttgttgtagtaaaataacacggcatcgcatgccgagatgtcgagattcacaacaacgtcatggttggtgatgtaacaaaacttgtgaagtagcagcaatagagtttgctggtaccgaagataataaagatgaagtcgctccaccatgttgacaaagttgtgttgccgtgatgaagtgaacacgagtcggcggcaacagaagcaaactggtagcgaagacgcgcagttgtgaagataaaagcactagttggcggcggcataaccagtcggcaacggaagacgatgatgtccatcagtagtggtagctgtataaaccagacgtagaggtgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactaatgcctattagtagtgacagcgatgtagccagccgtgaagaagatagcatcagttggcgttataacaggccagccgtgcaggcggtgacaccagtcagcggcggatgcggcggccggtcggtgaagacgtagacgcccaacaacggcagcataataggccagccgtgcaggcggaaacaccagtcggcagcggtcaaggcaagccggtcggtgaagacgtagacgcccaacaacggcggcataaaggccagccgtgcaggcggaaacaccagtcggcagcagacgaggcaagccggtcggtgaagatgtagacgcccaacaacggcggcataaacgccagccgtgcaggcggaaacaccagtcggcggcggcgaaggcaagccggtcggtgaagacgtagacgcccaacaacggcggcataaaggccagccgtgcaggcggaaacaccagtcggcggtgacggaggcaggctcccatgaacggtggtgtgaccaaccaaccgtatcggcgaggacaccagtcggcggcgacggaggcaggccggcggtgaagtcgtggacgcccgacaacggcggcataataggccggccgtgcaggcggaaacaccagtaggcagcggcggagtcaagccggtcggtgaagacgtggacgcccatgaacggtggtgtgaccaaccaaccgcttaggcgtggacagcagtcggcggtggtgaagtccggccgatcaatgaagacgtggacgcccatgaacggtggtgtgaccaaccaaccgtataggcgagggcaccagtcggcggtgacggaggcaggttcagggtgaagtcgtagacgtccaacaacggtggcataataggccagctgtgtaggcagagacaccagtcggcggtgacggaggcaggctcccatgaacggtggtgtgaccaaccaaccgtataggcgagggcaccagtcggcggtgacggaggcaggctcagggtgaagtcgtagacgtccaacaacggtggcataataggccagctgtgtaggcagagacaccagtcggcggcggtgaaggtaagccggtgatgatgatggccaccaatattgacagggtagtccagcccgttttgtatcctagattaaaggttgtctgtcgtgttccagtccgagttgaagagaaacttgacaaagtcgtcggcgacatatatggcccagactctcgtagcaaaaatcatatgcatgtgcagatcttctgttggtatgtgtttatgcatacaggtacatagttgttccaggcacgtacaaacgcatgcgatgaccagtaattgctggataagtttgagcattgatatagctcgcgtgtgcccgcagccatacgtcttcattaaaaaatactcgagctgaccaagtgaaaattgctgcttgtatgtactgctccgtgtttttgattttccatgttgagtcagccgagtccgagattgatccaatcagctgtcttatgcaactagccagccgtggtatcggtgacgatgacggtttgaagcttccaacttgatgacacagatctttgatcgccgttctctcgactggttaaaacccaagtcggagaaagagagattgttgaagtcgtcggcagcgaggaagtgaaaactcacgaatcgaagacgaagccgacgaatcatgaaattgattccatcacacttgttgacaggaaactcggcgaacccctaccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgccttcgttgccgccga

SEQ ID NO: 58501 - DNA, 2358 bp, Oryza sativa
tggtgcctccgcctacacggctggcctattatgccgccgctgttgggcgtatattacttcaccgccggcctgcctccgttgccgctgagtggtgcctccgcgtacacggctggccttttatgccgccgctgttgggagtatatgacttcaccgccggcctccgtcgccgccgactggtgcctccgcctacacggctggcctattatgccgccgctgttgggcgtctacgacttcaccgccggcctgcctccgttgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgttgccgccgagtggtgcctccgcctacacggctggcctattatgccgccgctgttgggcgtctacgacttcatcgccggcctgcctccgtcgccgccgactggtgtcctcgcctatacggttggttggtcacaccaccgttcatgggcgtccacgtcttcgccgaccggctggcctctgccgccactgactggtgtttttgcctatacggttggcggactccgccgctgttaatgggcttcatcatctacaccactggcttggttccactggcgccgactggtgttttttgtcaccattgatggactgctttattcccacatcggctacttctgctgtcatcgagggaatacgacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacacaatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcttcaccaaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctatgtcttcaccgaccggccgccttcgccgccgccgactggtgtttccgcctgcacggctggcctttatgccgccgttgttgggcgtctacgtcttcaccgaccggcttgccttcgccgctgccgactggtgtttccacctgcacggctggcctttatgccgccgttgttgggcgtctacgtcttcaccgaccggccgcctcgtccgccgccgactggtgcttccgcctgcacggctggcctttatgccaccgttgttgggcgtctacgtcttcaccgaccggccgccttcgccgccgccgactggtgtttccgcctgcacggctggcctttataccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgccttcgccgccgccgactggtgtttcc

SEQ ID NO: 58502 - DNA, 6443 bp, Oryza sativa
tggcctttatactgccgttgttgggcgtctacgtcttcaccgaccggcttgccttcgccgccgccgactggtgtttccgcctgcacgctggcctattatgccgccgttgttgggcgtctacgtcttcaccgaccggcttgccttcgccgctgccgactggtgtttccgcctgcacggctggcctttatgccgccgttgttgggtgtctacgtcttcaccgaccggccgcctcgtccgccgccgactggtgcttccgcctgcacggctggcctattatgccgccgttgttgggcgtctatgtcttcaccgaccggcttgccttcgccgctgccgactggtgtttccgcctgcacggctggcctttatgccgccgttgttgggcgtctacgtcttcaccgaccggccgcctcgtccgccgccgactggtgtttccgcctgcacggctggcctattatgccgccgttgttgggcgtctatgtcttcaccgaccggcttgccttcgccgccgccgactggtgtttccgcctgcacggctggcctattatgccgccgttgttgggcgtctacgtcttcaccgaccggcttgccttcgccgctgccgactggtgtttccgcctgcacggctggcctattatgccgccgttgttgggcgtctacgtcttcaccgaccggcttgccttcgccgctgccgactggtgtttccgcctgcacggctggcctttatgtcgccgttgttgggcgtctacgtcttcaccgaccggccgcctcgtccgccgccgactggtgcttccgcctgcacggctggcctattatgccaccgttgatgggcgtctgcgtcttcaccgaccggccgcctcatccgccgccgactggtgtcaccgcctacacggctggcctattatgccgctgttgttgggcacctacatcttcatcgccggtcgtctcgtctgctgctgactagtgcgcttacctctacgtctggttatacagctaccactactgatggacatcatcgtcttccgtcgccgactggttatgccgccgccgactggtgcttttatcttcacaactgcgcgtcttcaccaccggatttctacttggacatcttcaacacatatcttcaatcaagcaatgactattcgatgacaagaagctacagttctcgactctatgtttagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttggacgagttagacaacaacatcaactctcctccaagtgaagcatctacaatagccataacattaatttgatggattattgtcactgacatcatcaccagcacctctgcttcatcggccctgacatctccgctgttgctaatggatgattatgttttcgccgacttattatttcaccttgacggttgacctactatgcaaatgctgatgagcgtcttcgtcattatcattggttgcgacactgctattgactggatcaccgacatcgtcatcttcatcatgtcagttgcatttgtcgtcgccaactattttcttcatctccatgattggtggattttgtcatcgcctttgatttgcctcgtctgtcaccgactgattatttcgctgccatggctacacaactttatcgctgggcgctttcatcttcattgatggctgacctgactactgccgactggtttcttcgcctccacggctgtgcaacttcatcacttttgattggtatcattatcttcactaccaccaatatttttgccacctctggtgggcaatattatctctatgttggtcgtcttgtctttatgccaactgcgtcagctaccatcaatggacaattttgactatgacaaaaggacaagctatatgctcaggggctcatcaactcaagcgtgaggattatatctccaatttggacttgttccagatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttacacggattttataccacatatgccatatattttcaggtgtggtggaaccatgtgtcttttagggacttaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcgaggattcacaccgcatatgctatatattggtatcaagtcacttggttgactacgattatcaaaaccactcgtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggtggattcaaatccccaaacaggagtagggtattacctctctttggagtagggtattacctctctttgagagggcctgaacctgtctaaatcttttgtctctgctgtttagatatcttgtcagttgcaggatcaaactgactggcacgcacgcttctcaacaaactttggacctgcactaaagctaagcagatctcccaggccaggcccgtgtgtgtaacaaactttggacctgcactaaagctaagcacgcccgcttctcaacaaactttggacctgcactaaagctaagtagattctcaacaaactttggacctgcactaaagctaagcagatctcccaggccaggcccgtgcgtgtaacaaactttggacctgcactaaagctaagcacgcccgcttctcaacaaactttggacctgcactaaagctaagtagatctcccaggccaggcccgtgcgtgtttttcgcatcaacatgtgacagcccagcccagggtccagaaacggcattggtcccatctcatttagttagaccacacctaacactgcaactcactgggtttttcgtcctcgctttaacgcaaaaattccagaatcggagttgtagtgactgggctgctcatccttataagctgctccctctcttctcaaattggcgaggtgggaactaaagctagctagctgtgacttgcttgctcgctagctgatgctgctgcacttgggccaaaggcccagctactgcttgggctgccggcctgctgctgctagctagcctttttttgtttcttttttcttttttcttttttttagggtgttacacaacaccatcatcaatcccatttaaattggactagggctattacctgataaggggcctgcaccagtataatccttgtcttctgtttcccaattctctaatcatctagtctacaagtatcactcgtcgataatttgattcatttttaaatatatacttttatgtatatatatagttttatggagagccgagggtggagaatagacacagtatgtggtctcttatcaactcaattagacaattctctaatctgccgtggctcgttttgggggacttcaacgaggccttgtggcagtttgaacacttttcagtgagacaaaggaatgaaacacaaatgcaatcctttcgggatgttctgcaaacgtgtgatttacatgccttgggtttttccggagtgccctatacatatgacaacagaagagagggaaggaacaacatcagagttcgtctggacagggctcttgcagataatgactggagggagatgtttggtaatgccagggtgtctcacttaacttcgactcggtcagatcattgcccaatatctgtttgtttctctcctgaggattgtcggccgtttcacacaaaatgtttgcattatgaaatatgctgggaaagggaaccatccctacaggaggtaatcactgatgcctggtcagagggtgtttcaaagtcagatctcggtgaaattagtactgccctccatagagtgatgacaaggttgcattcctggagtaaggtgaaggtcaagaatgttgggaaggaactagagaaagcaaggaagaggcttacttctctccttgtttctgatgcagagagcagtctggttcgtcaggcattggatcatttaaatgaacttctctatcgtgaagaaatgttatggctgcaaagatcacgtatcaactggctaaaggagggagaccgtaacacacgtttctttcacagcaaaggagtatggagagcgaaaaagaacaaaatttctgcactccgggatgccagtggcactgttcaccatttgacaaatgtgatggagcaaatggcaacagactattttaaaaccctgttttctgccgacccaaatttggaccactctagagttacaaccttaatccaagagaaggttacggctgagatgaatgaagctctttgcaaggctttctctgatgaagagatatcccatgccgttttctagattgggccgcttaaggcgcccgggccagatggatttccagcacgtttcttccagcggaattggggtcttttaaaggaggaggtagtgaaggcggtgaaggaatttttcaatacgggggtgatgcctgcgggtgtaaatgaaactgctattgttctcatcccgaaagttgatcagccaatagagctgcgggattataggcccatcagtctgtgcaacgtactgtataaagtggtctctaaatgtttggttaacagacttcgaccgattttagatgaacttatctccccaaatcaaagtgctttcgtccctgggagaatgattacagataatgcgctcattgcctttgagtgctttcattcaattcaaaagaataagaagttgtcatcagctacttgtgcttataaattggatctgtcaaaagcctatgatagggtcgattggaagtttttggagcaatcaatgtacaagctgggtttcgctcattgttgggttaattggataatgtcgtgtataacctcggtgagatattcggttaaatttaatgggaccctgcttagcacatttgctccttcaaggggtttgcgccaaggtgaccccttatctcccttcctcttcctatttgtggtagacggactttcgctgttgcttgaggagagggtagcccaaggagccttgtccccggttcacatctgtcgtcgggctcctggtatatccaacctgctcttcactgatgatacccttctctttttcaaagcaactagtgagcaagcaaatgtagtgatgaatgttctagcagactatgcctggtgcactggtcaactgattaaccaggagaaatgctctattatgtttggtgaagcttctcctcccgatgtccaggaatctgttagaagtgttctgcaagtggggagcaccagctttgatgacaagtatctgggttt

SEQ ID NO: 58503 - DNA, 1762 bp, Oryza sativa
ttcacgaagacctattactccaaaaggaaattgtaggttaaaatgggtggctgatttgctagaccaaaatgggagctgggatagggatgtcatctctcagcttttctggcctttggatggtgaaataatcaaatcaataaggctctccagtcggcaggacgaggattttatcgcttggtatcctgataaaatgggtcagttttcgattagaagtgcttatatgttagctgttcagctcgcaaatgctggggagagctctagctcctcaggaaatgatactaagaaagtgtggaatcatgtctggaagtgtaatatcccccaaaaggtcaaagtgttctcatggagagctatctcaaactgtcttcccactatggtgaataaaaagaaacgaaacccggaattgtcggacgtctgcagtttctgcggcctggagcctgaagatgtggcccatgctttgtggcgttgtccgcatgccaggcgatactgggacctaatgagctctgagatgcaagtacaacgtatcctgtatgggtctggggagggttctgattggatccttgactttctggaatcaatttcagaggatgatcgtcctgtctttcttatgtcactgtggcgaatctggtatacacgaaatgagattactcacgataaagcggcgccacctgtggaagtttctaaacgctttgttcggagttatgtaaactctctgaaggaaattaaagctcggccgaatgcaaacttgggatctgggaagcatgtaattggggaagacaggcccaagtgcaagaagcaatctgtcttggcaaaatgggagaaacctccaagtggatggatgaagctgaatgtcgatggctcctatcaggaggataacataggggaaatcagtgctatcctgcggaacagcactggagatgtaatttttgcagcctgtggctttgttgagcagtgccagagtgcgctggaagcagaaattttggcttgcaaggaaggtatcggactggctctccaatggacccttctaccgattatcattgaatctgactgtgcggaggcgttacagctgattctttctgaagggaagctgcgatcggtgaataagtttttagtcagggagatccaaggcatggtgaagggggctagggagatgaaactgaagaaggtgaacaggaactgtaatcacatcagccatgttttagctaataaaggcaggtgtgagtcccttatggacttttggccggacggaagttgtaactttatttccgaagttatgtctatggacagctatggctaagtaataaagttcctgtttttccccgcaaaaaaaaaacactaagtccctatttatatctcaccctaaaatttttcaccctgtcacatcgaacgtttgaacacatgtacgaagtattaaatataggctaaaaaataactaattgcacagattgcgactaatttgctagacgaatcttttaagcctaattgctacgtgatttgacaaagtgatgctacagtaaacattttttaatgacggattaaataggcttaataaattcgtctcgcgggttactgacggattctgtaattagtttttttattagtgcccgaacaccccatgcggcacattatataatacctaatgtgacacgccgaaacattacacccctagatctaaacaccacctaaatgtgacacattctagtacaatgaatctagacagagatatattcaaattcttgtagtaataagatatgtcatatcgttt

SEQ ID NO: 58504 - DNA, 20995 bp, Oryza sativa
attcctgcacccggagtttgaaatcaactatacataaaatactcctagaaagaaaaacataaatacaatgtaatatgtttacttcctacatcctaaaatcaatattttagttacctagtaacctagggcacacgagagtactatcgaaattcgtaatactagtttaatagtatagccaactattagctccaaatcatctatagtaatttaatagcaaattcatacaatagttgtttattatactattaatacatggtcctacttgtcatacacacattacgtcttagagtctgtagccagctgcttttctctcttatcttttatctctttaaaatatttttatagccaactaatagtctgctattgtatctgctcttagttgtattttgggcacttgtattttagaatggaggggtagtatcttatttagtgtccaaactagctagactgataggctagatattaatttgaaaaaactttgtgtacagtaggtcaattttttttttcattctcagtgtattattttccaggttgtctatcaacaactacaacgctgagcttgtgaggttagggcatccacaatgtatcactaaagtgggcattatgcaataaatgcagctctaaggacaggcaatatacattgtggaggtagtccatatggcattaattgctaaagcagtctttagctatatgggctggccacaaggaaataaaatacaatactttttcagttcactgtgtacaaatgaatataaaatctaaagcagttggtgctggtgcgtgagcagccgagcaggtgtccgttgaagtagccattgctgctgggtgttggctctccttctccatgctcctataaaacagaccaacaagagatttcagtttgtatctcttcatttcatcaggagatggattcatccaaccaaaaattcatagatcttctcagtcaagactctccaaaccatgcagaaaagcctagccacaactcccctccccaacaattccccaataattttccccaatctcagtttacccaaagcttcaacccacattttttacacaatttctatccatttcattccccaagcaactatccaccatatggtcattctcctcccagctttcaaggtactcctccaagctttcaaggtattccacatcaaggaaattgggcacaacctaatttagccagcttacaaggtttccatttgcaagaaaatatggtgcactcaccaaatcaggggtttggaactgcaaaccaccaagcaatatttgcactgcaacacccctcagttagagccactcccaacagttctttccatgggtcggagtcatcgactccctgccctgcaagacaacaagaagcgccagttaatctcgagtcgtcaagtgaaagcagcgaagacagaggtgaggagagcaacacgcaccaattggacagaagaggagaacttacggttaattagtgcttggttgagcaactcggttgatcctacagatggaaatgacaaaaagggagagtattattggaaggatgtggctgatgagttcaataacaaccgtcctacaaatggccacaagaggacagtcaagcaattgaagacacactggggaaatgttaagaaggacattgggaagttttgtggagtttatgctcaagttagacgtacctgtaccagtggacactctgatgacatgatcatggaaaaagctcatctatggtacaagaatcaatcaaatcagaagaagcctttcaccttagagtatatgtggagagagctcaaggatcaaccaaaatggcgaagtattatcaaaaaggaagaaaacaagaacaagaggactaagatttctgagtcaggagcttacacatcctcatcaaaccaagagactgaagaagaatcatcaaacaaagagagacaccccgagggacagaagaaagcaaaagagagattaaaaggaaaaggaaaaggaaaagctcaatcttctccgttggggaaccagccatctcagaacatagttttgtacaacgaagctatgaaaattaaagctgaagcattattgaaatcagcagaggcaacagcaaaatcagcagaggcaaaacgggaacaaataaggatggaaaagtggcaggcatacattaaactggaagaaaaagatacctctaattttagtggagaagctgagaaggcatgaagctatgttgaacaaattatctaaagaactagctgaggaataaaggagaagcatgttattgttccactgtagtgcttagtgtatgataagtttagttgtcaaatttggtgtattgctgatgtacttgtcattttcagaatttagctctagtactaatgtaaaagcttagtgtacgattaatttagttggcaaatttttgtgtattgttgatgtacttgtcaatttcagaatttagctctagtactaatgtaaaagcttttactatatccccacttgtattatgcaagaaatcacattttttaccgcacatctctgctcttaatattatttttcattcatgagtcatgataatcttcatgaatacattgcagtacagaaaaacccatacttacaagatgtagggataattttcttcgcaattcagttattactccatacctgcacatataaccataataagaaatatagatgataagcaaaacatagctgttggaatagtgccaaaaggaagaaatagttgtcacaaactagctgttggaatgctgccaaaagtaaaaaatagctgttgcaaactagctgttggaatgctgccaaaagtaaaatatagctgttgcaaacaagctgttggaaatgtatcctacatataagagatgaagtgaggaagacactactcacattctcactacccacttcattcagcctcttggaagataccactcccctctcactgccccctccattcagcctcaaccaacttaggaaaatgtcagccaactcccaagaacaatctaatcgtatagaagattctctcaccagttccaatctagaagagttgatgtgggaagaaatcaatgaccctatggaggctgaaattgaagatcagattgaagcagagctagaggcagaactagctggaccatctactcagcgtgggggctacacacgcaggtacatcaacagggatcatgaagaggatcataacagattgtttgctaaatactattatgacaatcctttgtacactgatgaccaatttcgtcggagatttcgcatgagaaagcatctatttttgcgcattgttgaagctcttggtgtttggtccccatattttcgtctaagacgagatgcatttggcaagatgggtctatcgccactgcagaaatgcacggctgccatcagaatgttggcatatggtacaccagctgaccttatggatgaaacctttggagtagcagaaacaacagcaatggaaagcatgattaattttgttcaaggtgtgaggcatttatttggtcagcaatatcttaggaggcctactcaagaggatactcaacgtttacttcaatttggagaggcacatgggttccctagaatgttaggtagccttgattgcatgcattggcaatgggaaaattgcccggttgcgtggaaagggcaattcccccgtggtgattatggagtatcgactatcatgctagaagcagttgcctctgctgatatatggatttggcatgcattttttggggttgctggttctaacaatgatattaacgtattggaccagtcaccattgttcactgaggtactacaaggaagagcacctactgttcagtttacagttaatgggtctgactataatatgggatattatttagctgatggtatttatccagagtgggcagcatttgtgaaatctatcaagagacctctgaatgacaaagctaaattgttcgcacaacgccaagaatcagcaagaaaagatgtggaacgagcttttggggttttacagaaacgttgggccatcatacgtcacccagcgcgtctttgggaaagggaagaactggctgatatcatgtatgcatgtataattttgcataacatgatagttgaggatgaaagaggcacctatgatataccggatgacaatacatatgagcaaggacatttttcggcacaaatggcagggcttcaccatggcccaatctatggatttgaagacgtcctagagaaaaacttgttgattcgtgatcgagcaacccatcgtcgtctcaagcaagatttgatggaacacatatggcaaaagtttgctggccaacaacattagaatttattacttttatcactcttgactagtttattagtttgttattaatcttgtactttgctagtttgtattcatgctctcatcttaatttgctagtttgtattcaggaaccgaatttaagatttacatgtttcttggactgagattttaactatttgtattttgactccgatttgttctcttttacttttttttaaataactcaagcacaaccagaactggatattcaaccacaagatgaacacatatattattgttgcactaaatgaatcgagctgcatgcatacgacttgcctccagcaaccagatcaggacatcaataacctctagtgccaagcaaatcattaaaatcccaaaggaatatagaactaggtgatgattaacctgcattgcatctgtgctttcgtctcagctgagagacgtgcctgctagcttcttgtcacaagctgcagccttgccgtggccgtccgtcccccgcgcgctagcttgcgggactctagccggccggccgctgcgcgctcgccgctcccgcgatcggccggatggccgtctggccgccacgcgcttgccgccggctgccgagttcacgcgctcgtcgctcccgtggctggccggctcctggcagccgtccgctcctccagatttccgcccggcgacggtagggtttcaccttgctcgcgcgaattggggatctgaggcggaggagagacggggaagttgagaagaagagatattttatttacacgtgggacccaccttatcttcacataggctacaaacattgtgagatttgctataactgatgcctcctgctgtgggacccactcttatgggctgcttcatacatatacattgctcatgcccttatatatttgcttcctacatttctctcctccgaacttctgcacatgagaagaaacaatgggtaggttcattcactattctaagtggcaggaagtaaagactgtcaacaattatgctttgtttataggatacatgtcgatggccgtcagggtgatgggctatcttgtggttttatggacaaccgttatcctccttggcggttttgtatcagcgctagagaagaaggatttttggtgtttcacaataattaccctcgtccagacaatcgggttagtttggttttcaattagtcttgcatattcaatttttcactactagggttgccccgtgtattagaatagctagatttgctattgattatactttttatatataactgatataggaattcagcccccatgtctacatatggatatacacaatcaaagagttgctgcctataccaaatttgctatggaattacaattgtgaatatcaccgctagccatgctcagtatcaataatgaagttataacttatgaaaagaattagacaatatagattattaatgtgtttatcaatacaaaaataaagaaattccaattgatttacactgggaggaaaaggcgccatgcatatactacctctatgcacaaacatatgacattggttagtttaattttgagctaagcaacgtcaaacaaaaaaaatatggagggagcattaatttcctttcactctttcagggtctccactgtatttccgagagaaaatctgaagaaaattgtgttgtcgtacatcctgggctttgtatcgactacatataccttttacgtacccaaaaacagcaaggatgacaagaatattagagctgaaaatatgaaggatgaagatggtgatggtgggcgcaggaccagcaaggaaaaacccaagcattggccacggtggctgcgtagattggcggcatttgtcgcttatctggtacagcagctggtgttcgccgtcgtagcgggcctctcgcgcttgccgtagcggtgctgtacgcttgcgggctggtcatcaccaccggcctcgccgcttggcgcctgctgcatcgcgactacggcgacggcagcaacaacctgcggccggcgctggacgtgctctacaccatggtactcctccagggcgtgctctcctactaccgcttctcctcggacttctggcaatcaaggctgacaaacaacgtggccaaggcgtacaacttccaccactggcgtcatttttatgcattcgtatcgttgcgtaggtacatccatgaaacgaggatcgggtgcgagaaggacccgtccttcgccaaacgaaggaatttggttaagtatgccgtggacaccatgattgagtctgaatttccaaactgctggagcttcgtctgcggggcaagcatcctcggtgcgcttcttgagaaccccaagctggaagagcaacacagcctcatcaaggagcacctggcctggtcgccctccggcgccggcgacttgctccagaagctggttcagtcgttggatcccgcgaggggataccattacataacaagcatctccgcggcgcggatccttgcacacctcgccggtgatctccgccgcgagcagctcaatttcccgcaaggcatccactcgattgcctcgctggtggagccccccggcgatgagaagggtgacgagtacaacgccttggaacacttccaagagctgatggtggagggccttcgtctccttgcgaaactcgtctccgacgaggaatggtgccgtgtcattgctgagaaggaaggcctgctcgccaagatcatggtgccactacgttctgacatgcaccacactaagtaccactccgtttgtagtgattcggagaggccgatctgcagagaaatgatcggcgcgtccatccaagtgatgcgccaatctggtgactactcctggcgccaccggcgagatggtacgctgtgaaatctcaggcaacacggacgcaatgaccagcctggagagtattgtccactgcgaccgatgcgatgattgcctgctcatggaaggagcactggagatctacagccgactgcggcgtggggacgacgcaccttcgaccatagcaacaatgagagagcatttcatcaagagactggtgctcatcttcactcaacataccactgctgaagatgacagagtcgatttgctggctggtgaaatgcttgcgaagctatgttcccatggcaaagaaaacaccaccaaaatcctgcgagcaaaacaagatgtgatcggtgatctcaccggcatgcttgaagacaaaatcaccaagtgcggtataatcgcagcgcaaattctggagcatttgtgtattcatcactctgacgatgatgaatgtgcccagaacctcaaagaacgtataaagtttgggatgctaaaggtaccaaccaaaaaaaaaagaagaagcatgcatatgctttgtttttgtcaacatgttatactgatgatagacttacttttgcaggtgcttgcaaaaccgcgtgacgaatatgtgaatagagaaactctcacagcagttttatctctaagtgtgacgatatcacgcaacttaatgaatgcccgagatttacctcctctgttcgatgctattaccagtgaagccggcggcttcagcattctaggtaaggtccagctccagaagatgatcgagagatcaagttgtttaaatacggccaacgaactgaaaacagtgaagcttgtcgcggatttattaatactaactgttaaacatggaagccgcgacgccatacgggacgcaaaggaattgattgaatcactgtccgaggttgcgaaagaaatatcggatactgagaacttcatggttatcgctggcggtagcgacccaaagacccttgattctttcgtgaaagaagcagaggaccaactcctgcgcagagtcggcagagaggatacacctgaaatggcagtggtaattcaacatcctagctctgtcaacggagcccaggcagagtaaatcatatgcatcatttattcgaaaataaaatcatgttcagcctgtactttgttaatctgtactctaacaatcgttgcaaaaggaattttagtatccttgaagaggtaccattggatgccatctattttgaggtagttgtcacatccaatgttcatttgctaggcatgataggcattaggctgtagacagtgcctatcgctagacatacggctagtcatcgtcttctattttatgatatctccacttctcttccggcgagcaggggcaccggtgtcattgtttaggacaaaaaaatacgaaaatatctccctctatgtttagagagaaaataagtgcgggcgtgccagtgtacctaagtacacaaaataaaacaaaagagatatagaaacacatgatctttattaattgaattaacaacatacattttccatgtataatataaaatgcgcgcgccattgcctgtcgttggacaaatcttgacatcagcgatgtggtcttctgattcccagggcctcgagaagctcctggttaattacctctgcaggtttaggcctgcagagaacctccgattaagctgctagtggtcgtctcattgtctttgcttcgcattcaacatgcatggttgtgatggtgatgtaaatgtgggtgccggcagcgatccacggcctcgtcggtccgtgcgccggtgttggtgacgtagccttagcgtcggcttcgcccgccctcgtcgctccgcctcatcagtcttgagcgacgtggtggtgtagatagattgatcttcagcatgcatggaactcgcgtagcttggacggtagagaagtcacagcagcgacatcgggatagtattaaagggaagaagagttgatgacatcagttggtgtacgcgacagccgaatatacatggctgggcacctcctggctaggtgagatcaaagtgacgaagagttgacaaagacggttggtgtagatggcagccggaataaacatggctgggcacctcctgacccatcatgccccttatacggcagggacttgtaatgaaaatgttgatgaagaagtcggtgcagacaacagccggataaacatggcttagcacctcctttagatgatgggtctactattgatccagttgatatgataacgagcccgtaaaaggggctctatgagggcgccggtaacgacggcgaccttggaagaagtaaatgcctcgtcagcggaaccgttgagggcatttgttggtgtagattaagcatgaatggttccctggcatcacagatgacaccattcttactttatgctgatgtagactagcgacgctccaatacacggacaagcggcgacatctcgatcccaacgaagagggagggaatcacggacggacaacatcgatcgtgattaagaggagagagcacaacagacggatggcatctcatcttggcgtgatgaagtgaaagcattgtagacagatagcgtctcatcatgtggtgtagagagagagatgtcacggatggacggcacgacaactccggcttggcgaagtgcaggcgtcatggaagaacttgatgacgattccgcctagacgaggtgaagtcttcccgaacggacttgatgatggtgtgcgggcaccaagcaatggcgctccggctttctcctcgaacggcatggcgatgagtgtgaggaaagtggcaggaccgtcgaagatgattgagtagacattgacggtgactaaagagaccgcgacgagtgtgaaggcgtcgccggccagtggagtctcagtgagacgtcctcacacaatagtgatcacaacaggggcatctttagggctcggcgtcggtgcgatgatgccggcacaacggcgggctttgatggggtggcactcggtggacagtgctaccagcagcttgatagaacagcgagcgtctgggcgtcgccgatacggtggacgagatgatctcctggttgacgatggctctgatccatcaggatggcatgggcggctcagcgacttgacgacgtccgcggatgcgggtagttcagcgacattccggcagttcgaatgagacttctgtcgggcacggctcagtagtaaccatgcttgctccgatgacattctgcgcgctccggcggggtggcatgatgtcgacctcttacaaattagcatgcccgacgaggtggttgatgtagacggcagccggccatttaaccacagctcagcatcgaattgaaaaagcttgaaatcaacaggatttgtttagccatcgcattgacaacttcttatgcatggcactgaagcatggtgatgatgtgtcaccctccggttggtcggccacgttgccacaccatgtatttgctgaatggagttgactcggcatgctgctgctttgcttcggcttgtgttgctgccatgcgatgtgtgtacatgaggccgccgatcgccgatctgatctgtagcccgacgatatttgttgatgtagatcgataaccaccatcatctgcacgcggcgccgctgccatcgtgaggaagatagtatcgccgtcgtgagaacagtagcagcgccgaacatcggccgcgtcgggggaaagggctgcggccatgatttgatacgctgtgcgtggtggaagcaggagtcttggcagtcgacggtggctccgggcctccggcgatcctggcgtgccccagcagagcagcgtcacgacgactccgacatggtcagtccgccgcggtgaaacttgcagccgacaaagcgaggacgcccgacatctcggcatctcggcgacgccgcagtttcaggtggatgcatcaccggcgactcgattggcggtgtcgactccagggataaccagcatctcgtcgactcggatgagcggtgggcggtggcgccgatacgattacttcccggggagcacgtacagaggatgcaactactacggcagcaacagcacccgcatatgtacatctcctacgcatgcatgcatgttctgcaacaagaaaagaaggaaccaatctaattagttcttttgccttgagcagccattgatctctgcttgccgatgatcagagcgccgcgtctcctgccggacgccggtgctccggccgaagtcgctcgccgccaccgtggatgggttgatcgtcaatggatagatgtgtgttgagtgttttcgggatggatgtgttatgtgtgttgagtgttctcgggatggaagtgtgttgatctatcgatcttgttgatgccaggagttgatggatggatcctctcttttgccgtggttctacatctgtgccccctcgactccatgatcaatctgtaaaaaagaaagaaagagaaggcctggcgtgctggtgtagatgaccgtgcactgcctctctcctctgtcattctgtccagccgccggccggcgtgctgtaccttctcatcaggaagagggatggctggacgaatgtcgatcgcctggcgccgtctcttgggtgaccgcctgtaccctcgccgagcgtcggatgcgccggccggcagccaccggcttctctcgtgccgtcgtgttcttcctccctccgtgttctgccttcggcgcagccgccgccaatggatggattgatgggagttgaatgactgtccatgcatatatgtgctgaaagcctgaaatatacatgtagagagagaaagagataaacagaagaactggacaatgttagatgaaatcgtcctggacggcgtggcgtcgatcttgtcgcagccttcgtctccgggtagattgatcttccagcatcgagcggcgcccccggcgggccacacttttggtgtgccatgctgcgccgccttcggccggccggccgcgcacacgttggcgtgcccttccgccgaggccctgtgttttctcttgcgtgtgttcttcatatatgtgtagatggatctccttcttctctgttgtagttctccatctctgccccccccccttatggctgacgagctgtgccttttataggcggtagccgcgtacgcgagacccggcgccgccagcgtgtatacgactgcgtgatccgatatctccgcacagtcgcgcgcgatggatatatactatccggcagtttgtttggatggatagagcttgaccgtgcttatcttctgatctgtttgttgcttcgatcaacttgtagatgagggcggctatgcgcatgcatgtattagctagactgggctgccattcttgttggtttgccggtctgctgggccatcgacggagctctcgaccacacgcgtgcatgtgtgagactttaattaatttgttggcttgctctctatagctcagtgcgtgcacacacatatatgcttatatgtatagccgagcacacatgcatacgtattcaggctatgtgaatcagtacgtcatagtacatgcatgcatttgcatggcccatgcacgaatcaatatttaatgaactggcttagcacattggcattgctagctaaactggttcctgaaaatgcccatcaatatgcaatatatatgtggttatatattttgaaagtatgtacaaaatccggtcaaacagtcatcaacctgttgaccagtgcgagctcgaacttaacaataacaatacatcatacatgctagtacttgattgttttcggtccaaattttcgaatcgaaatttccagaatttccgaaattttgggtctttctatgggacggacagcgcatggcggtgtggtagccggactgctggagccgaggtggagcgattggctacggcattctccgccagggataaagctatgctgccagaggagcaagagcgacgtgatcctgatcggcgtaccgtagttccagatccgtaaaaaggggagtggtcggatctagctggagcccgggcgatcaccatcacctccctcgatcgcccttcctcaccggcgctggagagagggggcgggcagcggccggcctcaaaccgccaaagaagaagcgacaatgtgaacgtggcctcagaacgacgccttgggtctccctgttggagtgtataaaagtgaattgcccgtctttccttatcagcttaggttttaggtgcaactggttagtgcatgcaacttaatatggtatcagaaccagaggttttgagttcgaatcctggcggccgtcgcgccgcatgaaactaccacatcgccgtcgccccacctcctccaagtagagctccgcccgtggcctgcgagaacggtgccccataccgtgctcgacctacaggctacagatcaaatcctccgcgaatcttcgccggtgcagcgctccacccatcacctaccgcctaggctcgtcgccggcaccttattgccgtcaccactcaccaggtcatgtgacgtggaaccgtgccatgggacattgggacccggttgttggatttcttactagcagaacagaagtttttcgtggaatcctttttcttttcttttcttttcttttttgtaaatcactcaaatctttcgtgggagtactggtttttccacctctattccgcacattgtgtcatcgttgtgcatgcctttctagcttttggggtaaaaggtgactaacctatttctgtttttttttttgttgatgaaaaggcaatttgatttctttaattccctttcatttatacaacagtactggaaaatactaacagagtttacacgactggtttgttatcatccaacacaaatcttctcaaaatgcagataatgatatatcagcaaggcaagaagctaattaaccctctgctcatacgcctacgccattgggtttacctctacagagccacggaggtagattatgccttccttctgtccatccacaatctcctgcgcttcaataaaaagggagacgagagtcttcaacggaggttttgcgccattgttgctatcggctaagctcaggacgccatctacgccgtacatctgaatggaaacttcggacagatagcccatcaactccttcaggttttcctcttctttggcgtagctgctgctccttagtcttaacatcgatatgaacatcataaaaattagcttcacaattctcagccagtgagccgtgagttcatagtttggcaagatgtagatgcataccatctcctttagcttcccaatgggagtaaaggtagcatctccagggaaaaccacatcaaccagttggaccaaatcttgatcttggcttacatcaaatactgttgtaattaaatataggaaagcctccagcaatttgctgtctacacggagccaattgtctccatcttggacttcaatacttacgctaccgggtggtgaaaacatagctttatctgcttttgttcccgccgtttggatgtctccacacccaaacatttctccaagcacctgaaataataaatttgtacagaagtttaatttgacagactatataggtgcgtggctaggaattgagataagagttcagatcacactatatatgtgctcccttcgttccaaaatataagaacctagtatcagatatgatattttatagtactacgaatctgcacaaacaacttatctagattagtagtaataggaaatatctaatccagtcctaggttcttatattttgggacggagagagtattaccaatggttcactatttgatacaaggattaattacctttggcatcacatccttgatgactttgttcaattcaccgaggtactcgtcgtcataggtgtagtggttatataggtgagctaggatttccgctgcacttattctgctctcgttttctttagagtgtagaagcatgtctttgagcacaccaacgacattgccgtctgcctggaggatgaccacggcaatgctttggctttcgacgcagagcatcgccaatgcttgagcagccgattttctgacagacatatccttgttatcatcggtgaagatgcacagcatatacttggctaattcttctctgcttgccacgctcgtactcatagataaagatttatcaaaggctagctggctgaggatcttgatggccatgatttgcagcagtggcttgcatttgctacacttgggaatgctgtccatggtggtgacagcctccttgttgccagagatctcacggcggagcctgacgccggtcactccgggagcaacgacgagaagtgccaccagttgcatcgactcctctacaaccgagtgccacacctcgtggtcgatgcggtggagcaggtcggagctcatgggcgccatgatccttgagaggagaccttcagtgtcgcagatgactctacaattgtcactgtgagcagcgaggatccggaggattttcaggccccagtgaagcatctccatacactggtcaagcttcagggtgtccttgaactgctccagctgtggacctgtggtcgatagctcgagcatgtctgatatgcattcgatgcctcctggcagcttcttgaggtggatgtcgacagcgaagtattcgactatcctcgctgcactctttgtcatattgttctgagttgggctgcacctggtcgcagcctctaggagcttgacgagtatgtgggaagaagacgcggatccggtgagcagctgcctcatcagcgcatggtgtccctgcaactggctttgcacgagagagtcgataatcctcacgccattgatgaaattgtcagtgtcgatcgacgaagattctatcagtccaatggcatgtgtgaccatgttccttcctctgacgaacgacgggtccttcatgcatccagccatggtttcgaccgcgtactcacgaacaggtgattttgccccataattgagattgtacttgtcggccactttcctctccatcttccttcccgttgtgatgaaggtcatgccgtagaagtaaagcacgccctgggcaagagccatcaggtagaggacgcgcaacgccggcttctgcaggttggcgccgccatcggcggcggcgttggccatgccgaagcccaagtcacgccgtgtgaggcggaacagcgagatcgcggtggagatgtacatgcccaacgtgtagacaaacaccagagggacaacaatggtggtgaacacaaggagccgaaacaactgcaacgtagcatacgctacgatgggcccatggtcaagtatatagtgtttcaaccactcggccacaatcttggccggagtcttggccggagtctcggccggagtctctgccggatcagtctctatcttgcgaagtgaagaatatgcaagagtatctgccgtaatctcggccttttgctcggtcgaagttggaggcgacttgggtgtgctaaatgctgtagcgagtaagcgggtgactccagaaaacccctctataactccaccagtaatggcaccggatgccctgttgttaatttatatttgatctcagctcataagttttctcgagagagggtcaacggataaacataaactacattaggcgattttcatatgcaattttgcacgaaattcattttgcatgtagaataggattcgagttgcatctcgacccagtgattagcctgtcctcaccagatctgatggctgcgaagatttcactgtcacgccatttctccatgacagggaggtggcatcaactccatctgtcctaaaataaatccaatattggatttatatgtgtgaccaccttcatttttaggattagatttattttagaacaaagggagtagagacgacaagagggtagatctggtcaccaagtcacatcttgccgacaaagacaggttgacggttgaattttgatttggctggacttttcactttttggttctttttgaaaacttatttaatttgtaaataaatccctaaaaaagcttattctgggaatggatgcttttcgccgagtcaacatcgtcattgtattggtccaagataacagagccaatagcattgataacgtccccctaacctcctcgtgaaaggtaggtggtcacttatatgaagggggctaattaagtaaggggggcgacgccattgtttttggcgccgatgacatatttgtacatatttttttattataaataggtccctttttaattataaataggtcatttttcaaattgttttacaagtaggtcctcgacgtcaataacattgacattgtcccttttctacaagtgacttagctttcgcggcaagcctatagagatgacgtcaatgtcattggcaccgtcatgttgttagactaaggtgctgaaacgttgacgttgcaaaaggattcatttccgaaataagtttttagggtctatttgtaaaataaatttttaaaatctattatattattaaaggaatagaaaaaggagcctccacgttcgctctcatggcctagaaattctcacattaatcggagaaaaagaaaaagcagagtccatatagaaatacaatttagaaatagctgaaattcggaattaaaaaataagaaatattagaagaggagactatagtccatatagaaatacctataggaaataactgaaattcggaattaaaaataaggaatattagaagtagagtatagagtccatatagaaatacaattaggaaataatagaaattcggaattaaaaaataaggaatattagaagtagagtatatagtccatatagaaatacaattaagaaaaaaatagaaattcagaattaaaaataaggaatattagaagtagagtatagagcctatatagaaatacaattaagaaaaattagaaattcggaaataaaaaataaggaatattagaagtagagtatagagtccatataggaatttaaaactaaaattcagaataaacataatgaaattaaaagtagtgtttagagtccgtacaaaaatacaatttacaaataactaaaattcaaaattaagaaaaatatgggaagaagagtttaaagtcaatataggaataaaatttagtagtaactgaaatttgaaattaaaaattaaagaatattgaaagatgagtttagagtccacatagaaatacaattagaaatattaaaaattcagaattaaaaaaatatattaaaagacgagtctagagtccatataggaatatatataatttacaaataactataatttgatattaaaaataattaataactaacacgtatataaaatacaatatgaatattacacattagtagtttcgtaaagttattgcaaaatttaaaattatgttgtcattttgatatatttgaataatacaattcccacgttcactatcaccatctaaaaattcccacgttaactgataaaaagaaaaaaaagtccacgtagatatacaatttatatctaaaattcagaatagaaaataaaaaagagttcatgtaaaaatacattttagaaagaactacaatttgtataaaaatttaaaaataattaatattgagagaagagttcatgtagaaatacaattctgaaatatctaaacttcggattaaaattaaatggtattaagagaaagagtccacataaaaatataatttaggaacatgtaaaattcgcattaaaaaataaatatctgataagcaaagattcatgaaggagttcagtttggaaatattttaaattaggatgaaaaataaataatattatgagaaaaaaagtgtagtttctaagaaatgccattacaaatatcttcaacacagggtaaagtgaaatattattaagtaaatatttggtgtaaaaatacaatttaaaatatatgaaattcagattaagatgtgaaagtatgtacgctattatgtgagaaaaatattataatgatgatatccttgtaatctgttggggacaaaggaagtaagtaaacatattgtagaggccggcggccaccaagctaataagcaagtaaacaacaaaaatattcataagaggtacagggggactaactcttttgtctggcagagggtaatcatcgtgagacaccaaaagtccttcttgtcgagcagggagacgaagccaccaagcaggacaacggtagaccaggtgaaaatcaggacgccgagcccagccacgaccctcgacaagtattctttgaacacagcatggctgttgatataccgcacttcaggccattcttcggaattttgatttacttcaccggccattcttgccctgaacataaagctccaaaacctaacacataatagcaacctctagctagctagccaggcccttaagtactcagctaacgctgcttcagggtataactgacgacatatgattgtttacaccaagaactaaccatattagatcttgaccaaattacaccaattaatctatcctaggtcgctattaaatagacttagccaggccttttagtcatgtgtattaaggtggtcgatttagatcgccacttgaaatcgtcgtcgtttgtactaatggagcatgcatctttcagactacttgaatttttcttgacgatcgagttgacaaggctttgttaacatctctgtacgtgaatcatgtgttggactctctggcatgcatggtatagtatgcccatatgctctgacaaaatgcatgtgctgcttctgtaagctacttcctctatcccaaaatgtaagcatttttgaggttagcacgggtattaagaaagtaggtgagaataattgaagaaggtgtgtgattggttgaaaagagaaagtaggtgaaaaagaatggttgtgattggttgagaggagaaggtaggtaaaaaaatagctttattttgggataaagtattgtgctagaaatagctatattttaggacggaggtagtaagctataggttaattgatttggaataaacttgtttatgttcatgtggagcgagaggcctgagccctgccaatttaaaaatgtacgatgatgttgctcaaagggcacgtgtgggacgataaacggcgaacatcgctgcctctggcactgtcgatcagttggagaagaggaagaaccatttgttgtcgaagatgaatcacaaggaaacacatactaatctagaatgaaaacatgctatagagcaggtacaatagcaggctataagccagctgcaaacatattttaagaagataaattaggagagagaagagcagtgggctacagatttgtagccagctgtagcacggactccaagacgcagtgtgtctatgacaggtgggactagatattaatagtgtagtatgtaactattgtatgaatgaactactagattggctatggatgaattggagctagtagttggctatactattgaacttgctctaaggggtggtctaaaatttgtaaaagtatatagcccaacatacagtttactttaaaaaaatcttctcgaaacgggaaataatctcgcatgcatgataattccattccaataattatctccaatgtcctacaacaaatagccataaaattgtttttatgatactcgctccgttttataatgtaagactttccagcattgcccatattcatatagacatctatatgaatatgggcaatgctgaaaagtcttatattatgaaatggaggaagtatctttccgcatgtacgaactcttagtgtcctctagaaaaaaaatgccttgtactatttcttaatagagctctaccaggatgttctagaacgccttaaaaagaaagctagctaaaaattgcacagcgttgctcaagtcgcacccatgttataatatagacaatattgttgctgatcaacgtttcttcaatacgccagaggagcatcacgtgtgagtaatgtacaaatgtaaacgtgagttcaatgtaagtgagaatgtcagaataacatacaaaaccacgccaccaaatctgaaa

SEQ ID NO: 58505 - DNA, 5174 bp, Oryza sativa
cccctacacccacaaaacccatggatacccccctaagcccccccttcaattttttcatcatagttgataagataggagatgctaaaggtctcataatagcattttagtatagtttaatactgagattatgtgtttatatcggtgtattcggtatgttgagtccccccaactttttatttctggatccgcccctgcatgagtgatgataaactaagagcgcatgtgagcactgaccaacctaactgtaacggctcaaggtaacatgtgacatttcttccaaacaattatcgcatccaaacttccaacacatatacaagagggaacgaatatgttgccatgctcctggtggtcatccaccccttacagaccgatccattgccagctccaccatcatcaacatcaataattgttgtctcaccgtgtttcatccaacatgtatagttcttcaaaaaacctcttcttatcagatgagcatgtgtttcacactaactgatttatatatccctgtaacagctataggtttcaagccgttacatactgggccttaaatgatggctcaagagtgttttgcctatctgtaacggccgtctatgccacccattatagatgcgggagtctgtaacgattctgtttggtccgtcacagataagagtatttgtgtgctagtggcaagtgcaatttgagcaacctcgtgtatttgtatagtatatttgcagcaatggcaacggcagcagcggcggcgtgttttccagtgaacctccaaaacagagcacttcttccagttttccacgaattatcaagatttgtcctaataatggcaaagtgatggttctatacaaatcattttataaaaaatttgtctcagtgcacctgaacttgtttcaaggttgactaatttgttttaagggtgcaagcgggctaacccgcgagtttacttataggtcaaataaataataattcatgggttttcgtgtcgtggcgcggcttgcaacatctaaatatacaagtggatcgattcataaatccatttataaggtaaattaatagttaacccgcaagtcaaacctacgggttacgcattacttttgcctataagaggattcgcggacaaacccacttgcaccgttaatttgttttccagtagcaagcgatggcttgcactgctaatcccagagctaaaacatggacgatcatgcactcccttcgagccagcagcacctgcaaccttcagagggctcagatgccattcatcaaataacggtaagaaacgcattgttgctcttccaattttgtttcaccaattctttcctgcaaaatgaaacagatgaaagaaatggctattgtttgctccatcacgagagataaaaagggaagcagaagcagatcatagaggcaggttttcaccaccaggaacagtcgtcgttgaagtccaagacgatggcaatcgctggagcacctccaactacatctcatcagccaaagagtgggcagtatatggacatggatctactggcagctttgttttcccttactgcaacgatatttgaggtcagtcaagttcaagatttggtccaactggttgatgctattgcccctgtagatgctgcctttacctttgctgggaagctcattgagatggtaaaaaggaagatcatagaaagaatcgattttcttgtggatgaatggtcgagaattttgaagcctaccactaagatggtcatatcaatggtgagacataggagcatcagcttcgtaaaagaagatgatgaagacctggagagcttgatagattatcttatctgcatagttattccactggcatgaacaaaatagagggtgtcatgagctaccatggagcaaagcaaccgttcaagactcgtgcttcccttgttaaagaagcccaggaactttgggacaaaaagaaggaagatgctagctctgtcgaacgaaaccagatcacctaatctgtatgtgagtatatgacacgatttgaaaaattataacacacattcgatctgagaattttgccagagcagggtggatgaccgaaaccagtagatcactctgtttttgtgccattttgcctgatgttagatgtatcatatctctggagttaaatttatgtttgatgaaaataaatcagttagtgtgaattctatatgtatatcaaacttttttctcttctattgtgagcatggaagcaggaggcgcaatgccaaatagtgagctaatacttaacaagcattttactttacctaataccctcatgcattgtcacgccccgaactagtcccgaccggaactagcccgtgacgctccaaattaacctgttaatcgataccagtcacaggaaacagtgctggtatcacaggaagacagaatatcacagcaacagatgtctctttatcatagagtaggagtacagtcatgttgggctgcagacagatcccgagctcataactgcattacaaaagggaaacggaagccaagacttggaccaaacatcacaggcgcgacttgggaactaggccgaaaccctaaaactcatcgtagccggcttgctcctggaagaactcctcgtcagcgggatccgcttcatcttcttcagcaactgggggggggattatttatatagagcaagggtgagtacgggagtactcagcaagccatgggaaataagtgtttaatgcaggcttcaaggaaaggctattgtttttgcgattgattttatttaaactcttttcagaaacaactaagggagtgcttctcaaacgacacggatgagacagtgcgtctcgtccggtcggagtatgtgcaatgtatcagtcttttgaatcgatcaaggttggcacccggccaacagctttcaaacggccgcccgggcctggctgatcccatcagccgcagattttccaaacatcaaacccattccacaacagcaaatttcacaaggcagtagtcaaacaaaactatgctaggaatcacctcacatccgcccatgaccgtgggcacggctgttcgaacagttttaataacctctgcagagggggtacactttacccacacgacattactaacccggatcatccagcccgtacagaacggccacgactagagaccttaaggctttcatgacaaggcatttcgaaagacgacacaggttcaccatatgccaacgagaggggtcccaaaccaacaccagataggtcccagaccttactgtgccaggaagcccaggggtcctccccgacaccaccccggcgaatccatatgtctcttagcatcatggctcccccgataagctagttactcagccaggggtgtcccattccacccatgtggtcgtacttgtcttatgttcggatgaaattccaaggaaacggtccttatgtgcaagagcgggaaaccgtacacccggtacgttccccggtccgcggttttggaaattcatttagttcgcaagcaccgacccaggtgtcgggttttccaagtcttttgtaaaacccaagttttaccaaagatgtttctcagattttaagtttgaaggcgactgtcgatacccgtgcagagtgcacgattaccgaggcacaactaggtgggtacaagggaacatggtataacaattacaatggaagggtcaaatgcaacaaattaggtaggtccgccaatctgccttgcagacgggacaagcagattaagtgcgatcctatcaatgcataatatttttcaagcaacataagtaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttctaagattattggatttttggtctaaaggaaaaggatttatttaaatcctttttgaaaaagaaaagaaaagaaaagaaagagggagggaaattagacttccctcggacggctagggcgcggcccgagagaatggggcagctcggccgagcttaatgggccaaccggcccaagagggcggcccaaagcgcgcgcgggcggggaagggagagagagagccggtgggccgggtccatcccgcgtggtcccgggtgggacccgcttgtcggcgactcggctcaccgtgagcgaggtgcatgcggggcgtgctagggtttggggagggaggcgcggcgcatacgcgcggttcgcggaggacgcggtgcggcgggcccacgcgcagcctctcggctcgcggtggaccgcgcacgtgagggggcggagggaagcggcggaccggggtctgcttgacccggtcgcggccgaggtggcgccgacatggcgcttacgtggctgccacgcgggtcggcgggagttagacgacgacgccggccggaacggacggcggacgacagcggcgagcggcggagcgaaccatggcgatacaggcgaaggcgagcacaccgggatgttgcacaggacgaggggagacgagccaacggctcggatttgccggagggagctcgacggcggcggattgcggcggcggcaaccgacggcgggagaagggggaaacggcgatgaggtcacaaggggccgattcccggcggtgagagcatctacgcggctacgggaatccgttgctagcgtcggattgggcggagctacgccgagcgaggccggcgacgagcgggcgctacggagcacgggcagcgacggcggcgagcacacagcgagcggcggcaacggtcgaggcggcgccagctagctacgggaaggctacacatgctactaccgaaaactaaggggaggagatggatcgaggagggagaacgggggaatgcactaccgagatgaggcggggcgctatgacgagaggccgacggcacgggagtgatctcttcggcctcgggccggggaagaggaagaaggcgagcgcccggagtccccttccgcgtcctaacgcgcactggctcctccggcacacgcgacggcggcggctggcgagagagacagcaatggcgcgggcgagaaacgggaaag

SEQ ID NO: 58506 - DNA, 5024 bp, Oryza sativa
ggggagagaaagagggcttgcctccttgccgctttggggaaaaggaggagggagagagggcgacgcggcagaggggggagctctgcctccgtcccttggaggcacgcgcggggagaggcggggccgagtcgatgacgacggcgatgacggcggggcggtttggagtggagcggcgacacgggcggcagacacggggcaggcgcggcaggcactgacggcggcggcgactggccggtcggccaccacggcgcgcgcgcgcgcgggcggcgcggcgatttgggcggcatcggcgggaacggcagcgagagtggagagggaggagggctcggcgcggctcacgggcagagcggggagagagagagacacagagagagacagagccggggagggagggggagatgggccgagaaggattcggcccatcgagcccgagggaggcgaatcagacttttgcggagggattgattttagaaggatttggattcgggattgaacttgacgatagatcggggatttgagatctgagatggtatggacactagacgacaagcaaagaaacggatttcgcaaataaggtttttaagagatagttttcccgctaggcgccacgacggaacgggcgctacatgcatccatgtgaagatccctcaagcgcacgagaccattgtagtgttttactacagagtgttccaaggtatcgtgtctatgatgacaatagccctgcaccaaacacacataggtaactccaacaaagaaaatacacacataggtatctccaacaaggaaaatattctagtgattgtaattcataaggaataaggataaattgatcatatagcttcacgattctagtttatagcattgaaagatatcgattcattgaaatagcgaacatttgctcctcactgtttttaccatcacatatactccctccgtttcaaaatatttgacaccgttgactttttagcacatgtttgacgtcttattcaaaaaaaattgtgaaatatgtaaaatatatgtacatgaaattatatttaacaatgaatcaaatgatataaaaataataaataattacttaaattttttgaactagttgggtgacccgcgcaattgcgcggctagcacccaaacaaaattatatattttttagtatgattttacttaaaatttattaaatagatatctcattgtcttaagactttaaaagaccaaaccttatcatcctcgtgtttctaattatatactttttaaaagtcacaccagttaccacctcttatgtcatttccttctttatttgcttgctcgatctacaactatttctattcattcttcttggaacctttaaaaattggattttatagtttttagagtttattgtcacgttgggtttcgtttttataatttatagatatcccgtcaaacgttgccattatactcctgtacggcccgtctactgtttcttctctttattgtcattaagattttaaaaatcgaacataattatcgtttggattcatttttactttctagaagtctcgccaaaccatcagcggctttgccattgtactcctctacgactcacccgctgccttccttctttattgtcattgagattttaaaatcgaacatgattattattgggtttttttttactttttggaagttccaaacctttaaaaattggacttgtagttttattttttataatttttagaagttccatcaaacgatgccactatgcccctctacagcacgtccgtcgcctactctttattgtcattgtgattctgaaaatcgaacataactatcattggaattcatttttttattttctagaagtcccgtcaaccgtcgacgggctgtgcaactatactcttatacaccccgcccattgcttctcctttttattgtcattaagattttaaaaatcgaatatgattatcagtgggtttattttttttactttctagaagtcccaacaactgccttacttgtttgcttcacgacctacctgacgtccctccttttaatcgtcatcaggattctatttggtgttttattaataatttttatatgtcgtatcaaccgccaccactctactcctttataggcctgttacttaatttatctcgtcatgtgttttagatggtcttttcttttaatagtctttatttttatcacaaattttagttatttataaattgtattcctaattgaaatcttattttattctaatttcataatttattttttaaaaaaatagttaatattgtattatgttcttttaatgtttttattttttatttgaaattttaattaatctcgtattgggttcttatatggattcttctttcaatattgcttatttttaattccaagtttcagctaattttaaattgtattcctacttgaactcttattttatttttgtttgctaattttggatttatttttatttttattctgaattttaattaatcttgtattgggttcttatatggactcttcttgtaatactctttatttttaattccgaatttcagctatttttagattgttttactacttgactctcatttccttttctaattttggattttattttatttttatttctaatttttattaatctcgtattgggttcttatatggaaacttgtttcaatattgcttatttttaatttcgaatttcagctattttcagattgcatttctacttggactctcctttccttttctaattttggattttattttatttttatttcggattttgattaatctcgtactgggtttttatatggaaacttttttcaatattgcttatttttaattccgaatttcagctatttttgattgtattcctacttggactcttctttccttttctaattttggattttattttatttctatttcgaatttcgattaatctcgtattaggttcttatatggaaacttcaatattgcttatttttaattccgaattttagccatttttggattgtattcctacttggactcttcttttcttttttttctttttctccgattaatgtgagaatttctagtctccacagtgaacgtgatgcctcctttttgagctgtcttaataatatactacctccttccctaaatgtttgacgtcgttgacttttttaaatatgtttggccgttcgtcttattcaaaaacttatgtgaaatatgtaaaactatatgtatacataaaaatatatttaacaataaatcaaatgataggaaaagaattaataattacttaaattttttgaataagacgaatggtcaaacatatttaaaaaagtcaacggcgtcaaacattttgtgatgaagggagtaatagataagacgaatggtcaaacacgtataaaaagtcaatggtgtcaaacattttaaaacgaagagagtatttatatagtcacatctggccacctcctttgctccgctactgcagtcatcactccatgctcggtgcgtgtgggaggaggcgacggagggtctgcggcgagggctagggatgacgccggccgacggcgcatcgtggactcgggaagaaggacgaggccagccgccaccgcgcgcgtcaagctgctggggaggaaggtcgaggccggccgtcgcgtcgggctgcggaggaggaggaacaccggccgccgccgcgtcgagctggatgagggaggaggtcgtggccgccgcatcgggtggctgggagcccaggaggagaggaggtcgaggcctgcgggtgcgggggcacatagggtagcggatcggactgggccttgggcctttgagaccgattgccgagaagtccgcggcccaaagccagagagaatgctttgtcagcctggcccactaacgctgtcacgtaaagcaagctagtagtagcatgttgcatcatcatccgtctcgctaatctaatcgctatacttcactgcgagagcacacttgtgtgatctgtcagccctgtgcccgcgagcgcgatttggtatgcgggagcaggagacggacgccgaactgccgcagtgaagttggcgaccgtacgtccgatgcgcgcttgcatgtcatccagggctaggcatgtccggctgtccgcaaagaaaattgctatgcataccacccatctattccactcacgtcaacagttgttaacggctacagtgcatatgaatatgctttttttcgattaatctatgattcatgtctctagttatctaagtgtatcttagatatagcagtactcatccgcaatctaaatgacgtacagatcgatacatccctctccgcttttgtcacttcttgttttctctttccttttttttccattatttgtcaatcaacattagtaaattaatcattcctaccccaaatctcttatatggtaagtattagaaatattacgacataaacttaaaatgtactcctaagtcctacaatttacactgtgcggtcctgatgacacacaacaaatgggaaattaacggtatatagccatggatcatgagtcatgacgctcccaatctttgtgtaacgactgagcccgtcagttagatggacactcatgcctcgtgccaccgtgcggccttcgttgccgccaactacacgacttcccagttcccacgttgctttgcattcgttgttcaaaactctatggcctctgttggcacttcatctttttctaagttgagcttaataattccggttactaaatgctaatgtcaattttacagtcaaaatttgataatttcggtatgtgttacaattttaatttgggactgtctatagatcatttgacagaaaacccttttataaatcttgcaaattttagaccacccgattgcttcaagattagtccagaccaccaaagcctaaaaatcatctctcttctcccgattccttcacgccgccgcgttcctcagcgcttccccccgcctccgccaccgccgctgccggcccagcgcgccgccgcccggcctcgccggctggctgaaaggtgcccccggccggcc

SEQ ID NO: 58507 - DNA, 1305 bp, Oryza sativa
ggggctaaagatcccggtgatctttagccccggttgggctaccaaccgggactaaagtcccacccctatatatatgtcttcttcctcctccagctgcccgagcaagcttcaaaattacttcaaaaaagaggggaggtcatgccaaaatttctatttaatttattttggtgattacatacaaatcggaggtgcctaaaaggtttgcaacttcatcctccaatgttttttttgtcatactacatttgcacctatgttttgcacacttttttttgtctacaaaatttagttgtaagttgatgagagagaaaatgtgtgtggggaagaaagaatatatagaaatttagttcatttgctaaacaatgttttataaaatagttgagaaggaaaactctagtgaaagttaatcttaaataatagaaaacaaactaaaatgaaaattaaaagaagtaaaacacattaaaattagtttaaaactttacaactagtttttaagaattatttggtgtaatattttatgatttttgtatgaataaagatatcttataattattgtatgactgtcattattgtaagaataattatttgtgtgcggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctaatggtaacgacgttgcggatgatcttggtcagatgttgcaggacgccagtgaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcg

SEQ ID NO: 58508 - DNA, 844 bp, Oryza sativa
catattcattttaagaaatcatctcatcctacctgtccttaaactaaacatctttaaaacaagttcgctttaacccaacctattatattcctccaaccaaacacatgattataaaatctatattatattaacaaatccgagaataatcacttgccaacctcaatacatattcgtaaatcgtctagacctcatcttccgcagctagataacatgtaccatcaatcaaacttcgacgcgtgatagaaacatttcagcaatcaatcaagccaaccagcctaccgaattattggcctctcagtaaaacgcaaaaacacatatacaaactattacagaatcaaaaacaagtaaaattaagccgtggctacatgcaactcacatggtttaccaaagcagcacccaaccaattaagtgacgtccatcgatcggtccatggaaccaagtggggcccaagcggccgcttagctgtgggacggtgacaggtgggacccacgggatgaggagcatttacgcagatgggcgtcaccatcgatcgtggccgtcgctttcggttccttacaacgcccgtatgatcggttgtacggccgtggctttgtccgtttgtgctttgcgtacaccgaccgaatgagtgaatgctgacaaacgatagtgtcacacgtttgttagcggttgccgtgctcctttctcgcatcaaagaaacagtatcctgacccgtatcctactattctatactattctattatatgatactacgattctatcaagccgaaacgatgccgattctatctattatcttaattttcatcgtctctcgatccttctatttattattatatgatcctacgaa

SEQ ID NO: 58509 - DNA, 3168 bp, Oryza sativa
tcggacgtcgtcggttggaaatgcatgtcgatcatctttgttagggcatccacaatgtgatgcaaaagtagtccataggaaatataatattctattcagccacctattaatattgtgcaactagtccatatagagaaaataataaaaggtactcatatgcatatagctaaactagtcatatgaaataaaaaatatcatctatctctatttctctctcatctcgtaatgctatcttgtatccatatacattatgaagattgctatagttaaaatccatttgtgtgggtcccatatatatggatcactttagccatatacattagtgatgcccttatgcctacttttatagcactattttccttccgaccatgtgtacttacatcaaattgggctgcctcatcctcccttgacaacataaataaattttattacatgatacttaaaatttaaagtttgtgtagtttgttgatggatatttaaaaacatgctacagctaaacgatactacaaaaactgataggagtaatttgctagaagacgctgcaacaattattttattatttcgcatgcaattagagagagatttttttcaaaaagacgagaatacccatcatgccacaagcttctaacctagcgctggattgaataaggaatatgatatatggtagcaatttacttgaggtgatgacagattgagaaagcactactacgaaaaggatttttgcgtgcggagaaaaaaggttttcgtgtgcgggtgggcgaaccacacgcacccaggtgtctggaaaaatcgctatttttgtgtgcgggtgcctatgtcgcccgcacgcaaaaataaaaagccaaaaaataaaataaaataaatcaaccctaaccctataaaccgttgtagccgtcgtcctcgtcagatctgccgccgtgacgcctcctccccaccgccggcccactactagaaaaataatttatcaccacgaaaaaaatgtaacatcaatgctaaaatttttgcaatagatacatgttgccataatcttaaaatcgttgctagtcgtggtaataaatagcgtgataataggttattgcaacgatttttatttagttgtaataaattttgttatagctataaaacggatgtgtcaaaaaaatatatattgcaacacttcacatcattgcaataaataactattgccaccactccatatgtggcattagttctacgcaccaaactaaatgtttcaatattaatttatcgtcctaattattttcttttgatatcttgtcatggctaggattcgaacccaagatctctccctcatgtgcgctctccatgatcaactcacctatgcatcaattttgtttaaaaatacatataattccatttgagactgcttaactgagatttgaatcaagaatttgagcatttaaaagatttcaaatgaaaaatttaagttgcagatctcatcgagagctgtaaattttatataaaatttgtcctaatccgtgtccatatgaaaagaataagttaaattatgagatgataaattttttattgtaacggatttgttgatcatggcaatagaaaatagtgaaaagtaccatgtactatgcaaattgccaaaaaaataaatttgtggcgatagaacatgtttttttttgcaatagtaatgtttttgtggcgatagctcattttctattgcaacaaaaaaactgaataaaacaatgattgtaaatcgttgtaacaaagtataattatttgccacataaaaattatcattgcgatagtacaacatattgccatgaagttatttttcgttgtaacaaattggtggcgatagctcaattatcttgtagccgtcgtcagatctgggcgggggatggccttcatcgccccagaccgccttctgcgcgtggccgccgtcgcacgccagctgtcacgcgccggccaatgcgagcacgccggacaccgccgtccgccgagccgctcgctgccacgcccgagcccgtcgagccactcgctgccactcccggccaccacctcgtcagcgtcaccgccgagccggccgccgagccgcggagaggagagaagagaaagagatagagaggagaggagagagagagggatgagtggaaataaaagggagagaggtgaaaaaattaaagtgagtgagaggggaaaagagggaggggcatttttgcgtctatttaagaggctcacacacggaaatcgatttttccatgcagtccttttaaggagctgcacacgaaattggaggacaattttcgtagacgcgaccagttatggtccgtctgcaatctaaagaggtctctgtacaggaaaatcgttttttatagtgaagccacaaatttaatgtagttgtggctaccactctatggttttggaggacattggggtagagatggattggttccgtcatgttcgaccaaaccaagccgagtaacaagtgctggcttcagggacaaattcatcatttcgggaaatttaactatttgccactattagctttaccaattatccaaatacccttattagattagcccttaattttttgcccctctaaagtggtggcatcttaactatttaccacttttgcccatgtggcatcccaacatagcaacacagtgtaaaaatcaacatgggacccacttgtcagtcgcacacttctctctgtcctctttctctggtctgcccgtcggctaccggcactgctcctctcttccccagtgctagcggcgacgacggcggtgcactggctcacggctgcagaggacgagggggagccgagcgctgctcctctctttctcggcggcgaaccatctcaacgacggcgacggcgcgccgactcgcggcagcagaggagggggagccaagcgtcgccgcggttgaggacgagcgtcgtgcgaggtttgtaccgacggtggtcggcgtcctcgccgagcgcctgcctccctcgccaaggaagccatggaaggaggggggagagccgagtgccgacgcgagtccgaccttcgcctcgctgcgctgaggcacaaccacggcctccaatcggccgacgcggcgtccctccctccctggccatccaccgacgacgctgacgactccgcggatctgaccgagccgtcccccgcctccgccgactccatccggtgggtt

SEQ ID NO: 58510 - DNA, 854 bp, Oryza sativa
ttgtgcttaaagtacattgataataaagtaagtcaaaaaaaaaataattccaaaaatttttgaataagacgagtggtcaaacagtacaagcaaaaactcaaaatcccttatattatgggacagagggagtaggtagtaagcattaaatcttctcctgttaacaacaagtattgtgagagtgatgaataactactactcggtcatatggctactaatggaaacaaagaataagttatgttatttgtacaatgtcaatgagtatcagcggattgttttcttgtacgaaggagtcaccgtagctcaggattggtgagtttttatagtgtgccccgcacaaacaatatggagttcatatcctgctactaccaccaggcacgcgggcccatgttattaccgaacttggtcataaaattgggcatgcccttactccctttgttagggcaacaccaatgtataaaattgaagtgagcattagtatcaggttttgggtcagaggtagtagttgtatgcaggcagcacaatgtgtatgagatttcaaggtggggtccaccaataaaatattctccaaccctcaaccattcataagtaaagatgctttcatcctgtactctctctgtctcgattgtgtaaacaacattatttattcccttgctatcggtagtaagcatactacccggtactacttatttactggttccacaatggctattaccaggttgtagaggagcattgaatgcctattacctggtttctcaacacattgtggatgcccttatgagaaaagacgatttctagagtggagaagttgtcccagtataaacgatttctgcgcaaagaactagaaacatcgaatt

SEQ ID NO: 58511 - DNA, 2453 bp, Oryza sativa
tgttttttaagaacgcgttggacagacacaagcatatatcacgacattccttgatcatgttaagtggttgtgtaattctcgaaaatgagatcatgctgattgcagaggagctccgtcaacggaataattaactatttgccactcttacaagtggttctaaaggatttactattgaacccacatatcatagacatgagaacccacacatcatagacaacaagtgacaaattctaaattaccatatcttaaaagtggtatataaggtggtatatagtttaaatgtccctccatcaagagacgcacaccacaatagtgaaatatgtgaccgggtctttaccgaagtctttgtggacatcacttagcttgtttgaggacgtcacatagatcatcatagacggccagcctttactggaagcggacctcactttccgcatgacacagcagcgccgacaaggcctttgcatactcttaaaaaagaaaagactttaatatgttttactttctaaatttatttcttgtttcttttattccttaattgtgaggaatggagtctaaataggttgtaatgtttgcctgtgcatatccatgtatggatatagaaaccggatttttatctattataaaaaaatactccatccctagctttcgtatttatttctggtaacttttttttctattttctgctcttacttcctttctttcctcctcccttgcatgtgtcttcattcgtcatcttttattgctgtgttttgtttgtctcaactcaaaccaaatacaccctccgtttcaaaatatgtgacgccgttgattttttaaaatatgtttgaccattcatcttattcaaaaaatttaagtaattactaattatttttatatcatttgattcattgttaaatgtacctatatttatacatataattttacatatttcacaaaagtttttgaataggcaaaatttgctacaagacattcaaaaaacgtgtaattcgctagaggacatcgaaagaatgtgtatttgctgtagggcatcataaaaaactggtaattagctcctggacacccactgcattactttattatttctagaggaataggagagagaaacgatcattaaagacaaatttgcccttagctcaaatgaatccacgtgggcccacatgtaagcccctctctctcccggcacagcgccgcgtcggccagccagaacatgccggcggtggcaggctcttcgccgtgcaatcatgtctcgcgtcgcgtcgtcgtgcagcgaggcgtcgacggccgaggggaactccatgccgtacgaccaccagtccatgcctgcgccgtgcccaccgccgcgcgccacctccggcgccacatactcgtgtgtgccgacgaacgagctcgaccgtgcgtgcactggttctgcccgcgatgcccatcatgtgcagatactcgagcgcgaggagcacctcagtggcgtagaacctggcgaacgggattgggaatcgacgaccgggcatgctttggcgttgtgagtgagggagtagatctggccggcgtcgaagtcgtctaacatggcgagcatgtaaagggtggtcgagccaacgcaggatgcgcttctccgcggcggcgtggcccagctcgcccttcttggagagcgcgcggcagttcaccaccttcatggcgtactcgcacgaggacgatgagccgacgcattctccttcataccatgtccctggcgcctacttggtggatgagggtaagtcccgcgggcgtcgcggcgacgaggatgggcgcctaagcgaggtcgaccgcgtggtgcgggcgtggtagggaagaggtgggtgtggccatgtcaagtgagaacatggaggagctgaaagcgacacccactgacccaccgtgctactgctgccgctggcctgctgctacttatgcttgagctgggcatggaggcagcgtgtatgtgcatgtcgtggtaggcctgcgcgcgacagcgcagtgccgcaccaggcccgcgcctcgccgcaccgtagctgatgctctccctctccctcgggcttgcttggagaaaagagcagagagagagagaatgagagagaaaagaacaaggaagaaggagcagggaaggatagagaaaaacaaaaagaaaaaaattcgaagggtagaaccgtacttacacagtttttctctctccaatttctccggatataataaaataatcccgtgggtgtccagcagctaattaccaatattttgtgatgccctatagcatattcgcgttcttgcagtgtctcccagctaattatacgttttttggatgtcctgtagcaaattttgccttttgaataagacgaacagtcaaacatttgctaaaaagtcaacggtgtcaaatatttagaaatagagggagttttacgtagtacacaccaaccgatcgtgccctagccacactcgtactcattgaa

SEQ ID NO: 58512 - DNA, 2199 bp, Oryza sativa
aaagtttcaatctttttaaaagttgaaatacaatcaacacctcatgaaatattttgctaccacgtataaaacaacggttctgaatatattgaaacatgaatgatgtagctatcaaaaatcattcgatagccatttagccttcccgttacaaatttgcctattcacataaatgtcattacctccttccttttttatcttcttccttctcactccccatcttcttcttgtcttgaccacgctgcccgacacgtggatgcgagcaaagagggaaagagggattgatggatggatcagtgcggcggaattggctgtagcggccttgagcaagacctgcacgtcgctgcccaatccgccgcatgccgctccatcaatggtcgtccatggagatctagcccgcccccacagccgccgctgcagccgtggcttgcattttcatagactgcaacacaataagatgggaagaaaaaaagacgaccaaataaataagatgaatggaaaacgtaacagctagtagtatcacgatttcaattttataaaatttctatggtatagttaggaatagacgaattgtaataatatttatctgaatagataaatttacaatggcatagatccaattaactttttttttctcttcttgaactcagccgcaccacagcaccttgaacggttacatctgaaaatggtttgctcggtaacttttgaaggggaataactcacgagggattgattgtcatagtttcatttttacttctcatccctcaatagttggatagtataagattattagctcatattaaatctaacatgtataatatatttactatacggttagttttattttttttcttttctctctttctcttactatgaatttaatgtaaatattttggagcatttgtatagctagctcttgcatgagagacaacacttctcacttttatttatctttctatttcacacaagtttatagttggcttatagcccactaatatacttgccctaagagatgagaattatagttaattcaagtgagaattaaattttatgtgatgatgtacggcttaggctatctcattgaaattaaaggggaattccctcccaattaccacttgtacctaaatgacgcgacaaaatctaacattatgccattgtcacaagtgggattcgtttaaatgtcattccctagaagggatttaatgaaatatcactctcaatccatagctacatgctaaaaaaatgtttgtgaccaaatttcccctacacacctcttattcctgtctccaacgccatcatcccttaagccctagctcctcgtcgctcctcattggagcaggcggcactaaacggcagatgcatgcaaggaggagtaagaagctcatcgaggacacatacgtggggaggagcggagaggagcgaggttggccacggtgcatgctgggatgaccttaattaccagttgaaggcataggctgggagaagttagaggacttcgctggccagaattagaagagaagatggagatggaggaagcaaggccagtctagtcttagtcttagataatattttagcgtgtagctatgggttgaaagtgatattttatcgaaacactcttgcatagtggtttttttttaacaaaaaccatgtattgaaaaggtgggagttcgctcttaaattccctttcttaatccctcctaaaacttctacgtccaccaaccaagacttaatagcccccgcccccataaacttctatgcccacctaacaatttcaccccttcccccaaccaaacacattcttaatgttttggagtcaacttattagaactttgaatattaataacttccaaaatatttagttcaaaggcattaattagaacaacatgtaaaagattagtgttaaaaacagtactatcgtaaaattaaatatttatttattgtatatactataatagaaaattacagtgaaagatatgtttgcgagaccgtattattgtccaaaactttaataactatgaaacggatagagtagtactaagtactaatctagtgtaaatatcaaagggcactttaaaatttttaattgaaatatcaattgatatttcatcccgaatgaacagttattatcatttacaataattgaggatagatatgttgttgtggtaaataatatcgaccaatataacccgcatgctttctaga

SEQ ID NO: 58513 - DNA, 2279 bp, Oryza sativa
gtgtggagatgcttttagttaccacatcaagaaattgagtaactcattggtataggttaagctcatctaagttcatctgcataagtatttttccactctattggatgagtatagttcttattagaaccttaccaacttactttgtaatgtaatataagcagtttatctatgtcaaatatgcttgtataaagcggttcaggccattttaggatggtagcaatatatttctgatatagtagttcagtagttgttaccatcggtacagaactacaggtgcccatctcgattggttccatggagcataattcatggaacactttgattttggcgagatgtgtacaacaatcgatacattgcttttaagtgttacaacttgaagtcttgaacattcttgtgcaatcaagagatagtgttgaaatattattcctcactggaagttggctatgctgatatcccgacaggaagttgagttagctaaacacattgattactttgcttgaacctgcagagacattagacatagttgttcttattcatatgttgtactcttttcatggaattaagaaaccacaagtccttagttcttgatcatgggaataattgatattttgtattactaacaagtagtacatcccccgtttcaaattacttgttttaggtttgtcctaagtcagacattcgtatattttattatcaatttctaaaaattcatatagtttgaacgatgttcaaattggtggtcaaagatagacatgtttgacttaggacaaaactagaatgatgctgtgcatttgaaatactatgatcccaaaatatttttattggagaatgcctgtatgcatcagcactccaacatactatgcacagatcattaaacaagttagcattatccaccctattcatgcttgttttccttatttagagcaccatgtaaagctctcccagagtcatggactcatggtccttcagatatctttatccatctttatgagaacaattctttacaacatgacccttcaagcaagaaaagctcacataaagggaatttaaatatatttctcaattggtcaaggattaaagcatgaagtgcacgactgcatgttgtaaagggtacaagttagcatatttttcttgaaatggtgtggccctaagtctatagatggaaatggtgttgctgacatgctgtagtgttctcatgtgtgactgaggagcatagcgtaataaaaagagacgagatttggtggaataaatattatgaggaataaactttttctttaatgataaattcgcttaaatcattttgattgtgctggaagcctggaatgctatttctttacccggcatacatcttatatgtacatctgatatattatagcaagatatccttgtagaatcatcaattgcatttgccactctttgtaggttaatatcataatgtttgtagttacatgttgcccacaatgcatatgaatagagtgaaatgtatacctctatactactaaaaaagacaatagtggttgtggtggttctgccacatgcccaccaccactacttttgcacgttctacaaattagtccctgatattttctgttattatgcaatagtctaatatttgtttgaatcaaatgaataacatatattcaaataagcatggccattttacccatagcaaacgtggacatattttgctagtactatattactagtaattcagtttatgcacctagagtgagatttaaatgtgcactccacatcatcaggttacttctctttcagtacacaggacagcttgaggggaaaattaagtagatttagaacctttttttatgtgtttttcacattagttagttaattctgccaaccgtctagcagttctatacattttttcccctattattttgcaggttatgtgcactgagaatgtcaaggaaaagactgagttattacatgctttgatcaatggtaagaagctttcagaccttccaaaaattaaccaggtaatgatttgccattacaagcagttgatgcctgtccatgttttttttacagttaatttaatctcttgcctgttgcattctgtttatttgacagcaaaccttgataatttggggagagcaagatcgggtctttccattggaacttggcctacggcttaagaggttggtctaaataaaattgtcataatattcaagttaccaaggcaataaattctggtttggatacagacatttgggggatacatccgagctagtcattgtcaagaacgctggacatgccat

SEQ ID NO: 58514 - DNA, 1260 bp, Oryza sativa
acataagatcaaattgctttatgactttgttgaatccatattacctccattaaattgaatgatactagcactaatcaatttcaaacattgatcagtacttccattcagataaaaaaaagtataaataccttgaaatatggtgtattatggaagtatttttgtgccacagatataacatcaaaatcaaatagttattgacgtaacttgtggtcaaagtgtgataagtagtcaacaacactagtttatttgagagctcccatcccatgctacacccttctttttctcccttagactgtctccaacagccctcacccaaattcgttcgtttgggtcatgcgggatgtccgggtcacgcacccaattctttcgttctccaacaacggaccaaaacgagcgctgagcgccgcccgcttccctccccaccgagcgccgtgcctccctccctccccgccgcggacccgcctcgccgcgccggtcgctccccgtcgcgggcccgactcaccgtcatcgtccgagggctcgcctcgccgcgccggcgtctaaacccgactcgcctcgtcctccgcttccgtgtccccgactcacgcgggagctcagccacaagtccggcagcgaagaccgtgcagtggccggctgatgcagcacccacacgggaaggatgaccgcgagcatgcggtggcggcgagcggcgagcctggacgaggcggtggcggggcgggcggcaccgatttgggttgaggagagagaaggacgcatttttgcgttctcactcgactccgacgcaaattgcgtctccggtttgggtactctgttggcctccgattttttcatcggatgacccatatttgggtttaggtaccattatgggtagactgttggagacagtcttagggcaacaataatggttaatatcaaagtgagtattattgtggaactgtgtggtgtcagtggaattatgtgtcagtggaattgtgtaggagtagagttttgtataccatgtttccaaaagtttgttttggggagcctggttcaacatgtgcataaaacctttgttgtgggatccatcttctatgtcgtgtttagtttatgaaattggggagaagtttggggaaagttggtagtttggaaaaagagttaggagtttatgtgaggctgtgtttagttcaacacaaagtttggattttggttgaaattggagatgacgtgactgaaaagttgtgtgtgtatgacaggttgatgtgatggaaaagggctgaagtt

SEQ ID NO: 58515 - DNA, 1030 bp, Oryza sativa
aatgtaagaaaataaaaaaaatcaattacacagtttgtatgtaaattgtgagaggaatcttttgagtctaattatgccatgattggacaatgtgatgctacagtaaacatttcctaatgacggattaattaggcttaataaatttatctcgcaatttacaagcggaatctataatttgttttgttattagtctacgtttaatacttcaaatgtgtatctgtatacttcaaagtttttacacctaaagaactaaacacaccctaaaatggcaaagtgacggcgcgctctccgtattggcatttttaacaaaaacgcgtttttgggatggtgttctagcaaaatcgcttttcaaacctgtccaaatgtctattttctcagtttgcatgtggaagagcaatgtgctgttcgctttgggccagcaaaaagagaggtagaaataaatccaggaagaggaaattgggacgcacaccaacacgaaagaacggagaatcaactccgactcggattcatttctataccgcatcttcccttacaatacctcgacagactaaccatcgccagcgtcaacaacgtcttgactaccaccaccgtctcaactctctctcagactgtccgccatggcgcagccaccggagttccaggacgtccaatcccgcgccgccggtgcggtggcattcctcggcaatgttaaggcccggttccggcggaggccggccgtgtaagtcgagctctgcgatgtgctcacggcgtacggcagagaccccgccgcccccgccgcgccggtgctccgccgcacggcggagctcctccgtggccaccctgatctcgtcgccgagatcaacgcggttatttatccccgcaacagggtcgagctcgtacccgccgccgacgacgacgatggcgatcatgcagcagcagcggcggcggcaaggacgcgtcggaggagcgacgcacagcggcgccgcccggacgatgccgccgtggcggagagctccgccgccgccgagcgacgagcgaaggtgcccaaggc

SEQ ID NO: 58516 - DNA, 1329 bp, Oryza sativa
tgtgatgaacaattgggcattggagattattggttttgtatttggaatttattcacaaggtaattttggagatgattggatttacaggtgaatttacaggatactgctgtgattttatgtggtccggtcagaccgggcaggggttgccggtcagaccggcggtgatcgagcggtcggaccggccagcccgcggtctgaccggctgacactgtgtcggtttcggtttcgggttgtttatttggatatctgagtttatttcatgattatgacttctagatggataatatacttatgtaatactattgtttgctgctaatgagtcaagttagagatagcttggtctcggaatatggtttctttgtttgttccatgtgtaggtgactcgatgtctcggaagagtatttgcggtgatggaccgggagtcggcttggggataagacgacgtccgttgtggtcagagatcatgcgggatacttaggctagagttgatgcacgtggttgatggagatttcatatggcatacgatggagttattgtgtgtgtatgggatgcggagtcgaatttggaagaagtccaaatttggtacgattggttatgtaaagtttctttcttgtactagtgggtttcctaaggtgtttaggactcctagtatgagtttggttcgtggctttaggctgcctacctcatgtataaatagagggggagcgtgaggcttccctgtatcgctttagagagtaattgagttgagttttgagttagggtttcgagtttagttgaaatttttgtaaggagtgctgttggtgcactttgtaaacacagagagaatcaataaagttgtcatccactttaagagttcttcgatttgtgtttaccgaggttcggcggtctaactggcagcgcaccgacggtcagaccggcggcattgcggcggtcagaccggcgggcacacggcggttagaccggcggcgacaggagtcggcagccggcgttctcggcggtacgaccgatcgatctacatcggtcagaccgatgttcatcaggcggtcagaccggcgcagtaccttcggtcagactgcgatccatcgatttcaagggtaacttttatttccgctaaaagttttcggtttttgggtataccaaccattcactccccctctggttggcttagttcttgtgattcgatcctatattttagaggaaaataactagatcatttgtctcttgcaatccttttttttcagttgttgcaatcagacacatatctgaagcttttcatgtggtttatctttcctatgaattcagagtccatgtcacttgattttttgtttt

SEQ ID NO: 58517 - DNA, 755 bp, Oryza sativa
tctcgccggccgccgccgtcggtggccgcttgggccgccgcatcatctaaccggccggccggtttgaagccgagccgggccgaccgggcgcctcgccgctcccccccccttttgtgacactgcccagtggggcccgcctgccagccgccccctctccctcccttagtgccgcttaccaatggggcccgcatgtcggcgccgccccaccccttgctgacgtcagccctgggatgaattattgcgcaataaattcattaaggtttttcttttatagtaataaacacagataatcttctaaaaatcataattaattcatccgagctccgattaagtccattcaagtctcagtaaatcaagaaaaatgtgtagaatccattaaaaatggttttgttctctgtttcaatagtcttatagcatgttttgcttgtgtgctttgtttgtcgcatagatttcggccgtttcgtcaatccgcggttccttgaagacgttgctgtggtctcatcagtgcgagagcaagacaagtcatgcattacaattgatcatattgtacctaatttacaaatgtcccgtatttctattaaatattgcattattttacaatatcatgtgggatgggtcttattactcagctatatgttgtttcccttatgccattgataacttgggtatcgaaatgactagatgttggtttaggaaatgcttagccatgcctagttcaactagtacacaaaaggggaatcacattaatgcataga

SEQ ID NO: 58518 - DNA, 1019 bp, Oryza sativa
agtgacttatttaagcaatttgcaagatgagtgactaaactataccaacctcgcaagttgagataccaccgatgcattttactctaacaaaaaatacggtgaatttactctttataatcgaaaataccttaaatggcacagctactatgtggcattgtgtatttttgctcgaggtagcattgtattattgacatgtagctttgggaggcccgcgcgacgagctattagctcagtggtagagcgcgcccctgataattgcgtcgttgtgcctgggctgtgagggctctcaactatatggatagttcaatgtgctcatcagcgcctgacccgaagatgtggatcatctaagacacattagcatggcatacaaccccactatttcatttatttatatgtttatctgaatagtttattagcaaataaaaattatttgtaagtaaacttttataaactatgataaaaaaccaaaaagtcaaattcaaaatcaagttctaaatattaaattttggttttggcttataatcataagcataagcgaaacaatgagtcatatagtcagaaaaataacatggtcaaaaatcttatgcttgaaaattttatgtaatgcatgcaacgtctatttattttgtgtgcaaatgaaaaattaatataaggtacattatgaatatatattatcttctgatattccgttttcagttggtggacaaacctttgcaggggaaacttatccagaaaaatgtagggtatgggccgtatatggtcttaaagaaaaataccatgccgtatctcttatttttttgttctttgctgtttctatcctcttctctttggttcttcggtatgcttctatctagctataaatcctgtggcttgaaacattcatgtaccttccataattgtcctagcttggaccatatcacctttggtctgcgtgcacattaggcatagcacctctctagttggctcattcctataagagatggttatcctataagttaacttatttttttataagatta

SEQ ID NO: 58519 - DNA, 1373 bp, Oryza sativa
tgcaaccaacattactttcgaagaacacaatgtggtacatttgcaaatcaactaaggaaacaacgtaaaatactaaccgaaacaattaaatgaagcacttgcgatatttaaacaaatccattaaaaacctaacttttttttgtcggaatatataatcatgtgcggttttgttgtaaagatttaactgtaagaaattattggtacaatcgaattgtagatcagataaataatttagaagaaaaaataatttagaaaaaataataaggttattgcatgcatggggttaaaagagagaacaattagataagaaaaaaaatatgtacttataattctaatagcacgtgcaagtaagaagttacgtaacatacaagcatgaaacaaagcagtaagaaggagaccacccgattttatgattgggatcaggttcctgacccaaagcattatctggtgagttttgctttgttatattgtattttttcttgcggatggtcgttcgggtgagattgagaacactagttgttatggactccactcctactacaatattgttgagagaataatggcctatttgacatagtacaggtctcagatatatggtggattcgaagtttgtatattaaattatagtggattaaaattttaaattttatatagaaaatataaaataaatgatttatcgaaatgttatctatgtaatcatagatctatatatatatatatggatttatagacgtaggagttttaagaaatcttggactgaggcttaagaccgcttagcatttccatgttttaagtatggtttggtttgtggacataggaatttaaaggctagacagtcttaagttttcagtattcttcaactgaggcgctagggaagacaaaagagaaacaaagatcggatatggcgtgcgatgtgatgcgcgccagaaagcacgagaaaatggtaatttggccacgataaaaaaaacggttttactgaaatgctattccgaaaatgcatttcattaaaatgctaatatgaagcgtgcaccaactgctattttgccattttgaccgttttgtgtatttttgaaatcattttcgctggaatgccaggtgatgagacggaattgcgcatgctcgccatgcgtacagccttgatgctcatgctccccaacgcctccacctccatgccggtcaccaccgcgaaccgctccctcacctccgtctcctcctcatcttcctccgcggcggccttgaatcgccagtgctaggtcgtcgtcttcgaggcatgctgctaccgagcgggatgaggtaggacgccaccggggctggacaaaccttgtgcggtggcagcaatgggggcgtggcagtgaggtcggaggcgcggaggt

SEQ ID NO: 58520 - DNA, 1379 bp, Oryza sativa
agaagaagccccgcgctgccgacccccagaccagcaagagcgcgctcgacggcggcggcgacgacgacgacgatgacgacggcgccgtgttgccgagccgtgcggccaagaagccccgcgccgcggacatcaagatcaagagacgacaccccctcgacgacggcgaggagagcgacgcgtgctggcaagtcaccaccaccgacaacccgcacgacgccgcgcggacgtttaggaagaccctggagttcatcgcgtggtactcgaagctggtgaccaccatgaggcgcgctgaggagctggagaggagagagccacacccgcatggcgccctcaaggatctcttcccgagcagcgactgccatgagatcctcgaggagctctacggcggcggctggaggacagtgcaggtggcgctcgacgacggcggtggggggcgcgccggccgcacgacgttggcggcgatgcttgtcagtctaaggcagagggagaacgcagccgtggagcttgcaaggcgccgcgcggacaaaactcgctacggtgaagaaccagccgccgcgtggggatcgcggcggcggcgacgccagccgtgatccgtgcgccgccgcctctggacagatgtgtccgaacgggcggcgatgccgttccttccggctgtgacaaacttgacggagtgcatcgtacagcatgacgatcggcgcgttccccaattatcacacaagaagtgtcgaagataattggggaacgcgttgatcgtcctgctgcacgttgcagcattctttgttggtgttcatgattagtataatttcattggatatttatttagacttatatgcgagaaatgactagggatgtttcggctagctctataaggtggtgggcttgtcggcctgggtttaaagcctcaccccttctatttatttgatattacggtttttttatttagatttatatgtgcgtcaatttcattatttccaatgtagaactgtttacgcttggacagaaaatattaatgttgctgagagagggatgccattggctgaaaaacttgacaggaagtacttgtggtttcatactctgtaaaatcagtagcgaaacagagcagaattaatcaaccaaatcgaagttccactaagttgctttgcgttctgtgcgttgaagatttcttgaaaaattcttgattgtccactatgaagaataatagtcacatgcaaatttagttggccaatttccatgtgaaaaattctactaccctttgcatgctcaaagtttcttttttttttaatgcttcacatccatgactaatttccatgtgaaaaattctactaccctttccaacatgcattttgaacgggattttcatatcattggtatgaattccc

SEQ ID NO: 58521 - DNA, 844 bp, Oryza sativa
agtagtggtaccttctattttaaaaaataataattgataacctggatatgatttaaatcctaatgagtaacatcataaatatgtccgtatgattggtcatatcaataggccatgcatatcgatgtaaagttagcacgccacatgcatacactaagtgatagcactttccacgccctctaatcaacgcgtattcctccgcttgtgtcaaagcaaaatgcatggttccaatccctgcccatccgtcgggtgcattcggatggaagggttgggatcttcaaccactacattcggatggaagggtagtgattgatttttatggacaccactccattttgtttccatactatccataagtttaattctgccttgcacgtagaacatgataatttattagcacataattaactaaatattatctacaaaggattttaaaaatagattgacatgattttaaagttttgtaatgaattctcttaaaaaatacaacgtttaatggtacggcaaacatgctaatgaaaaagtgggagtagctacaagatactccctccgtcctattttaagtgtagccattatttttcacgtccaactttgatcgtccgtcttatttgaaaagtttttgaaaaaaatgaaaaatataagtcacgagtaaaatacgatttatgttttattatctcataacaacaaaaatactaattataatttcaaataagacagacgatcaaaattgggtatggaaactcatagttgcaattaaaatgggacggagggagtatttctgaacgcagtccttatcacacggcaacctccatatcagaatgatgactggactgtcacgcgcgcgcat

SEQ ID NO: 58522 - DNA, 714 bp, Oryza sativa
ggtatgtacctacatactttttcttctttttttttcgtgaatattgtgtacaaatttaagtacatacatgttttttctttctctgcctttttctcttgggccatcggcaggagaagtggaggatatacgtaccatatatatgggctaacggggaagaagagtgtcacgcccagaaattcacgaaccagaatttctaagctgaatgtgcattaaacccctgtccaggactagccagggtacacaaacgacaattgttgacatacagatccacgtcttacaaaaatataaaaaagattactaatgcagcggaaaagataaaagcgagctaagcctgaagacttgactcctgcagcgggcgactccattccacaggcatccttgacggctgcgacgaaaccaacctcttcgagacatcttcaactgagaaggacttcaactctggtgtgggggaaaaaagagcaagactgagtactacccactgtactcagcaagtcataccggaagaggaggtaggatgcaggatatacccaaggtaggctaaagggctcatttgcataaagctagcattaaaagcagtagttgaaagcagtaaaacagttgtagtaattaatcagtattaaccagtcactgtccaacgctacaccacgttgcaacaggcccgaccaaccacctgaactacgccagttcattaactaactaggggtgagactaatc

SEQ ID NO: 58523 - DNA, 1893 bp, Oryza sativa
atgctacgtagtgtgtctaatttgtgactcaaaagtgctatatattgtcaatgttggcttaattaattccatctctgtttgattttttagcttcataaaaggtgttaactgcataatatcggcaaaagaaatgtaacacagtactcttctgttaggcactcattgattttaagaccaagtacaggatcaatattttttgctgatgtaatccattttttggtgatcccaaaccattaacaatcaacggtgctaattttcacagattacttattgacagggttagaaggtgtgcagttctttactttatggagtatcaagtttttgcaagtgcgcatgacagtagatatattaccatccaagaaattcatttgtatagcttttaatagtgtatcatgtattcgtgttcatgcctaaacaattgggctgcaaacccgcatgggcattaattttatttatatatattcttatccttttcacaaaagatatagatgcagttcttttgattgctctgaaaaacatataattcctgcaaagaactatgctggaaaaatgtaaacattaagcctagtacttttatcagattcacttgcgaagcccattcttcatagcaggcatgaactctatctttctgtaagatataaacaacaccggataatactaacacacacatagcatttgattggtgataaacagagagttctgactggcagatgcaacactggaacaggaaagtggaaaatcaaaatcatgtatgacgttatattttactgtgaagtactactttagaacaacaaagtaaacaaaggggagcagattcgcaccttttgttggtcaaaaggggagcatatgccctaagctttcattccttcctgccttctctcttcccatatactccctccgtttcacaatgtaaattattctaccatttctcacattcacattgatgttaatgaatctatacatatatatctatttagattcattaatatcaatgtgaatgtgggaaatgctagaatgacttacattgtgaaacggagaaagtatattgctacctttgcaatctgcaaataagaaggcaggtagggtctcctcaacacagccaaatttactctcagatatttaacatgcttctacactacctgcaagactgcaaccattgtgttcatagcacgaaaatgcatttcattttccagagcgctggccgctgagggagctatgaacttttttccccgatctaaaactgaaatgccattccagtaaagccatgctacagtaaatactagcacactaaatcgacagcacggtagatcaacgcgatgaagtcttagttcttcctcaaatccaacgatagaacgcaggtcaagccaaggccgtgcaccgaagaacggattccggacgagtcagtagcggcgaatcggagggcaccaccgaggcaatcaggaattgggggaaatagtaacttgctgcgcagaaacgaacagcgggttttcacctcgcgtcggggcctcgagggagagaagatcacctcgtcggagaagaagcttccgacctggtctgtagcggcggagtagctcgccgtcgccggagttccggtgccctggacccggaaagcaaaagctttgatttaggtctagttttgtttgggccttacggcccgctcgctgtaatggatccgacccatctgcaaggagaaaatggacatttagcccagttcaaaacagggtttcgctagattgccatcccaaaaacgtgtttccctaaaatgctaatatgaagcgctcgtactcaccgccactttgccattttagcttttttgtgcattttcgaaatcattttcgcttcttcagtgggtaatgagacgaaattacttccatccttccccttccgtggtgg

SEQ ID NO: 58524 - DNA, 2129 bp, Oryza sativa
cttagtggtgtattagtcccaggttgcttaggagtgggctaggatgcttggagaccctcgaaaacaaagcggcaagaagacttggagccgagttagactagtttaccttttcgctttgagtttaagaaaaaccgtactattaagaggggttccaagtgtggttctaagataacacaagtgctcttagtggtgtccaagtgttgaaatatttttaggagctatttttgaaaatggctctacccgggacagagagtcccacccggaggttctgtccggaacttcctggcgccaaggtgaggttgaaaaattttctaagtgttgcccggaagttcctagcacccaggcccggaacctcctagcaaccctccagttcaaatatgtgagtaacggctagatgacgtcacctagccgttatatatagccaactcgactccagctcattctttggccattccactttagttcttgtgttccctagcttgttctagcctctcccaatgtgattttgcttcccccacccaaatcttgtgtatttcttgagtgagagagtgattttgagggtggtggtgaggattggagaaggttttgaaggctaggatgacttgagcacttggggtatctcgttgggctgtcatttggagcttgttactcttggagggtgacctcctagacggttaggtgtcgcccgcgagtttccaacaaggttgtggattgacccgggcaagtttgtgagggcgttattccacctccgaaaggaaacggaatacacggggagtgaattccgagctgaggtttaggaggtcgtcttggtagagcaagcctcacttgtggtgttcttttggtgttcaagttggggatcttagtggtcacttgaaaccaaagagaagtacctaggggtgttggcttgaagaccggagacctcttcctaggccttttcttggtgaggcaaggggttaatcaagacccggctctttgaagctcctcaacggagacgtaggattctcagtggagaatctgaacttcgggaaacaaatcgtttgtctcctctcactctctttatctttgtgattgtgatgcttatctccttatttgcctagttgtgctatcatgtctcccattgtatgatcacttgtgatatcttgtgtattttcatgtgtattactcttgtttgagacatgttgtacctctctatggtttagacttccttgtgatttaatttacttattgtgaggtgctcgaaagagtaactcacaactccccggaagttcctaggaagaaccccggaagttccgggcaactttctttgctcagcataaaaagctgccaggaagttccgggccttttgccaggaagttccgggccctgattttaaccgctgcaatttgaagtaaattataggaacgcctattcaccccccctctaggcgacataaaggtcctttcaaggctcgccaatagctactgctgcctctccatcgcgtcccccttcgcctccgtcaccggcgaggccatggggccgcctcgaaaccctagccaccgtcgtcgaccgcggcgaagcgacctcgtcggagaccgtcggcgaccgcagcaaggtagtcggcggaggtggcgaggtcgagggaggggaagatgtcggaggacttgccggccacctcaccatctgggctctcccatatagcaccgttctggatgccatccatggaggaggacgaggaggaagacggtgagctgctcgtggtggacatggagatggccggcgaggacaagctcctcttcctcaatggcggcggcggaggacatgaagggcaattttgtctcatcatctggtggagaagcgaaaatgatttcgaaaatacataaaagggccaaaatggcaaaatggcagtgagcacgcgtttcatagtcattttagttaaacgcgttttcggaatggcattctagtgaaaccctgttttaaacgtggctaaatatccattttctcatctgcaagtggccgttatgctgaactgaacccagttttgtaccatcacgcatttgaagtattaaatatatactaatagcaaaacaaatttcgcatgtaaactgcgagacgaatttattaattaagcctaattaatccatcattagggg

SEQ ID NO: 58525 - DNA, 849 bp, Oryza sativa
ccggccgtgtcatcggctccgacctcgccaatcgcgagttcgatggtaggacgggcgtgctcgatgaccaggtgtctcttgttggtgacataagccgctctttgctctctctggagcacctgagtgacctccaactcggctggaatttcctggaggggcgcactggtcgtctcccggacttccttggctctttcaaaaggctggaatctcttggcctcaccggcataccattttctggcaccgtgcctcctaagctcggtacgttaataatattttatttcaaaccaattcttattaattacttacattaatctattatcactaaattaaatatttagctaaataagtaaggacgtaaattagtagcattggtgtgggtagcgcgccgtgaacactgtagcaaacgcgggatccgtatggcagtggacgcagcagtggaccgggaaagctgagtactccctatgtcccaatacaacacggttcctggattccggttagagtatgtatccaatatatgtacagagtctgttacagtttagaaattggagttgtactaagtacattgaaatagagtcggactctttattataggatatcacttaaatagagggatggacatgttataaccgtatggcaacttagcatggcgaaatagagcggctgccgacggcatccggccgagggtcattgtaactctaatacgctgtaatatggtggatcggagaggagcgcccgtaatcagtgccccggggatataggcttcggctgaacctcgttaacaaatattgtgcctggtgtcgtcatcatgtttggatctcctatgacgtcttttccatgtttggttactaa

SEQ ID NO: 58526 - DNA, 2668 bp, Oryza sativa
acataaaggcggcagtattctactagtcttgtgcatcgctcgctagtggtagtagtgggaggagtgacgtccgaataatcctccctcctaccgtgtgcccaccgcgtgcctttgctttccctccagcatccttccttccttcctctatttctacctctcctcttctccttctccttctccatctcctcctcaggacactcctctcctctgcttctcttcatcccattcgcatcagtgctcagcgacctaatcaagatctttactcgaacagaagagtataagtccagcaccggagaagcatctgattctgaattcggtttgctgctgcctggggagaggaaggttaggttcctggctcctcctgactgacttaatttcctttcgctgtctttctccaccaggtgtggtgcttgtcttttgtgttcatgtgtgattcaagtgattcttgtttggtcggtctctgcctttttgttctagagagatctcctggtgctcttggggcactctctgctcctgttatactggtgatggccttctctgttcttgtgctgaaatcctgcttgaatcaacagagtttctttaggttttttttttttgattcttgattcatgtgttgttcttgaggaagaggtcaggagagttcagttgggttggagccattggttgttgccatgcatctttctcttcttgatttttatgtgtgtgtgtgcagtctctttctggatgattctgtactggcagtttgtggtacaaacaggggaagaaaccaagatcggcttcttaatgtgtagtaaacaaatttccagtcttgctggaagttgacatggttaattagagaaaggaaacaaattagagttagttttagtaaatcccaatgattccttcagggcttgtactgcatgaagccaagaatctgatagctttcaccacattagatttaacccagatatccaataaggagaaagagcatgcaaaatcactgttctttacttcttgttttctacagcagcaataattttgccatgaaatcgcatagctgtcatggcgattctcttctcaccaaccaaatttagaacagaaacccagctgtgttttccccccttttaattttaactcttctgtgaattcaccgcatgatacacgccaagaaagtgttttaaatcgctagctaaaaaacatttagcgatcggtcttctcaaacagctaatagccgattgaatggggctgtagcggctaaattctacatgaggcgagaaatagctagagacaccctcctcgaacagctatatctgaagatagcggtagctatagccggagatttaagacctcgcaagaaacagggatggtgtcacatggcataggcaagaagagtctttcttcttcctcctactcgccgccgtcttcgtcgtcgtcgccgcctcggtcttcatagctcggctgcaatgtctgatcgtcgtgcgtgtgcgtaggattcagctgagtttggttcttagtggattcgtttgaaattggtgcagggtaaggtttgccaagacggctccgcggcggcgtctccggctaatctccggtcactctggccttccccgtggcgccgccgccgcctcgcgccgtgagtgaggtgtgtggtgctgtggggcatgcgatctcctccgccgtcttcctcctcgtctcgccgtcgctgctccggagagtctctcccgtagacaacggctaaaaggtctcagaaacttactgaaatttggaacgaattcgtctgaacagaagaaaattcgaagggatttgcgagttttgagtaggtcaagatgaccaggatgaggtgcatcccgggtctgctcgccggcaggaggaagaaacgagtggtaaatgtttgatcgaattttgcctttctgtttttgtgagattttggttttgagtttgtaatggttggtgagtgttcgacaggttgctgatgccaagaaggctagtggggattgtcccaaggtgaagccggtggagttcatcgactcgccggcctccgaatgcggcgacagaaaggtcgcgccgtgcgatgtcaaggtcgtcgtcgacgacacggttgtcaccgccttggcggcgaccaaaggaggcggcggcggcgacgatcatggcggcgacatggcgttggcgaagaggggcagcatgtcgtctgacttcgagttcgagttccacgcacacgagaagcccgacggacatggcgtccccgccggcgcctcgccggacgcggtgatcgcgagcgggaaggaggtggtggtggccgacgcgtcgccgaagctgaagcggtcgtgctccaacatcgagacgaagcggccgggcacgcacgacgcggcggcggaggcggcgccggcgcggtcaagatcctacggcgacctcgggaacctgcccggcggcggaggcggcggcatctccctggagacaaccccgcgcggcgcggcgccgcaggcggaggcgagcccggcgtcggtgaggacgtcgcgcaccgccgaccgcgtgatgctgaagaagcgttcgtcgagccaggtgctcccgtcgcggagccgcaagctgtggtggcggctcttcctctggagccaccgcaacctgcaccgcccgtcgccggcggcgcgccccgcggccgccgcgtgcacacccgcgggccaccacggcggcggcg

SEQ ID NO: 58527 - DNA, 3455 bp, Oryza sativa
cgagcaagacgacgacgaccaccaccaccaccaccattaccacggcgacgccgacgacgacgacggcgagcacgccatggagcacggtgactgcgtggcgcgggcgccgcgcgccctggagatcggcgagtcgtccgggaaggggcacggcaagtcgaagcgttccacggccgccgacgaggtcgcccaggccaacaccatcatccagtcgctcaacgcattctcgtcggtggcgcacatctccggcatgggcctcaaggtggtgccgatgatcgcgccgttctccagcctccgcgccatcaacctctctggcaacttcatcggtgagcacaactgacaacagtagtaacattttttgtcgctgtagcatttcaagcaaagtaactagatactgcacagtagttacttactactaccttcagttaccgaaaaatttgactgaatttgggttctaccacagttcatatctcgccgggatcgctgcccaagggccttcactcgctcgatctgtcgcggaacaagatcgccaacatcgaggggctccgggagctgaccaagctgcgcgttctcaacctcagctacaaccggatctcgcgcatcggccacggtaaccgcacatcttgcctcaccaatgtcacaatcttcagagtatcctgcatgtccaaaccctccaaattttaccctctcactagtagaattacaattttcagactataccaagtactgagtagagttcctttttccctgtggagtgatgagtgatagggacaaagattagagtttttaatctgtagcatctagtagctgacaaagccagtctggaccagaacaaaatgagcattccaggacatgtcacgttggttctagcatgaatctgcttcatgtattggctgtcactgcctcgtctgtccacagtttccgtgatccaggaacattattaatacagttggaaatggggccttatcatcatcatcatgatcaaatccctgtccctgacttctgtccatccataccctggatgtaaaagtgcactcctccataattccaacctggtccatgcatccactgaatccactgctccctaatgatctcaacttaattctctgaaaaaaaaatcaattcagagcatgactctgttttcacttgagaagaatcttgctgaaaacctgccactttggaaatgaaaaataaaaaaaaaagaaaatctctgcactgcaagtctgcaactgcatctacatgactctgcatttcttcagattttgcaatcttgagaagaatcaagttctaaccatgcaacttcggaaagaaaaagaaaaagaagaaaaaatctctacacttcaactacttcatctacatatgactcttgagaagaatcaagctcaaaccctgcaacttcggaaatgaaaagaaaaagaaaaagaaagaaaatatttacactgcaactacttcatctacatgactctgaatttctttagattttgcaatcttgcccagaattgttcaaaacctgcaactttggaaaccataaaaaaaaataatctctgcactgaaagtctgcaattgcatctagatgactctgaatttcatcaggttttgcgaaatctttcagagatgagatgatcattcatggcggctgactttgtgaatctgaacctggcagggctgtcggggtgcacggcgctgagggagctgtacctggcggggaacaagatcagcgacgtggaggggctgcaccggctgctgaagctggcggtgctggacctggggttcaacaaggtcaccacggcgagggcgctgggccagctggtggccaactaccactccctccgcgccctcaacctcgtcggcaaccccgtccaggccaacgtcggtgacgacgccctccgcagggccgtcacgggcctcctcccccacctcgcctacctcaacaagcagcccgtcaagccccgcggcgccgcccccgccgacggcgccgtgtcgcgcgccgcgctcgaggccggcggcgccgggggaggctcccgtagcgcgcggaagcggtcgtccgctgcggcggcgtcgcggaggctggggcagcgcggcgaggggagcgggagcgggaggagcaggtccaaggggaggcagccgtcgagcagcttgccggcgaggaggtgaagacggcggcggcggcggcgagtgcgaggtccattttgtgttgttgcgatacattcgaatttagaatttgaagatcttttgaatttggaatttggattggagagagagagcgtatgtattgctgcgggtgtgaagtttgactgaatattgttgttcagtttgcaaattattacagtgcatcattgcagctaatagtaggtgtgtgtgatgatgagtggaaaatgatgccaaaatcctgttcttggtcgatcttataaatccagtcttcgtttaaactcaaccttttttgtttcctgttgagatgagaaaatcttagttgaaacatttcgcagacttacgaatgaaaattacttcaaggtttcatatctactactactttaaaaataaaactcgtttccgtcgtccgtttggaaaaaaaaaagcgagaaaaacaaaaagaggaaaaaaacatcaatcggcaaaaaaaaagtccgactcctctgttagaaaaaaaaaagagagaaaaaacgaagagaaaaaaaaaggacgtccgactccccggtggagaaaaaaagtgagaaaaaaaaagaatttttccggtcgttatctcataggtgcggtgtttttttcatccccctcgcctccccccaaatcccagtcggaattgcatcacccccacccaaaaaaattcccaatcggaattcaatcaatcttcacaatgggaattcaatgaaaccccccgaatcccaattgcactaagaatcagataagggaaatatcttccaaaatcggcacaaccaaatcggatgaacacaccgcaagaaaaattcaaccaatctttgtccccaaaaaatcatcccacatacatacatcacaaaactacacaccctcggccgtcgccgccgccggcggatccatccgcggccaccgccaccgccaccgccaccgccgacggatccatcgtcgccggatctagggcgggagggaggtgacaggggaggagggagccgccgccgccaccgccgacggacccacgcgccgacgccgccgacaccaccattgccgccggatctggggcaggagggaggcgagaggggagaagggagccgccgccgccgccgtatccgcccgcagccgccgccaccatcgccggatccacccgcggctaccgccgccaccgccaccaccggcggatctgccgcgggagggaggctagagggggtggagggagccgccgccgacaccgcctcccaccctcggatccactgcggccgccaccaacccgcggccgccgacccgagagggagaggaggagggggggcgcc

SEQ ID NO: 58528 - DNA, 2632 bp, Oryza sativa
aggggggaaaatgaatcctagggttagggtttgggtatgtttatttaggttaggattaatctggaccgtccattcgatcggacggctccagctgctcccacgtcgggccgccggcctattgggccaccgaatggaggatgcaaaatagacatcaatggagaaaggaaaaaggccaaacacatagaatagacaaaagggagggaatataaactttgctatattcagcccaaacatagaaaggaggattttgattttttttttccaattaaataattattaaattatttttgtattattcaaaattagcaattaagctctgataattccaataaaattctaaaaagcgtaactaatcatggataatttaataaaattaaatttaaccatgtaattttatttttcacacttgctttacttgtaaattgatttaattatacacctacgtacttaaaaataccaaatattttaattaattacataatgtaaatttttctttaactttttctcaattttttgttccgtacacttcccgttgcaacgcacgggcacatttgctagtggtacgaaaaattccaaaaaaaaagaataataaaatacttcaaggtttcatagtacgaaaaatacaaaaaaaaactaagaataaaaattacttcgaggtttcatagtacgaaaaatcaaaaaaaacaaaaaggtcagatccgacctgccggattcgaaccagcgacctaaggattgatctgcaacgactacagtcctccgctctaccaactgagctaaggtcggacactgcttcgtactacgagataaattttaatactttaattttcaaatttatacagaaattagctagttccttctgtcgctaaatggtgactgttattttgtttgcttactatataataaccacgataattctgtgtcccagaaaaaaatatctcttctcaaaattttttttatctaagttctgattctaattaattgctgcatggtatcacgtcaagtatggcccatcattggcccttgggctacacatgatagaaattttccgtttggacccaaattatgattgttgtctgcagcagtgtcagtggaaaactgccgtatgtacggtgtcggtagcaaaactgaggatatgtaatatatatcctacgaatctctctaggggaacaagctccctacggtttaatgtcctttccctagtataattctccctagggaacctggggatttccagtagattgttaggtctcctttgattcaaaggtaattcataggaattttatagaataccatttatataggaattttttctatatagccctttgaatcaaaggaatgaatcctacaaaatcctatgaaattcctatggaatgcctaaagacatgtaagttttagaggaaatttagcatgaggttctacctcatggaaactttcctatgagtcttcatctctcatctaattcctgcatttttcctgtggtccaatcaaacggccatccctgtgtttttcctatgctttgcaatcatttgttttacacttgcactcgtatcaaaattctacgtttttcctattcctacgttttctcaatcatgtgattcaaagtggccctaatgtgatatggtctacattttgttgtttgtgaacatcaattcaccgatatttgcgactaattgaccattcttcgtttaatcgtccgcatgatgtagttgatgatgatctaaagtagttttttaagacattgtttagtatttgtttgtgtttcttacatacattttatgttttattacttattcaatataaccaaacttgtcaatgaggtgtataaatacggcgttagaagccacatagttaatggtaagttatggatgtctattgaaaaaccaataacatattcaagttttataggcgtacacatttaaatccccaaaggagtatgtaatattataaaacatgtttgtatatttacgaacattaaattaattttcatcttcgagaatcaaaggaacaccaaaagctaacccaacgcatacgcaccacgcgaagcaaagaaccgatgcagctttctgcgctaacttagctgaattcatctgcaggtttatctcataaaaaacaagcaaaatctgcaggtaattaacaagattcaagcaaactaacccccaaccgaaacgccacgtactcacgtgcatccattcccatgtgcagccatggcacgcaagaacacacaagcccgcatttcgtcgaacacccacgccacgtaacgcacatatgcctccctacttaacccgcgtcgcgctctccgtgcatcgatcgtgtaagctagctaagcttggcgaattaaacggaggcgatgccgcgatctcatcatctcctcgcggcggcggtggcggcggtggttgtggtggtgatgggatggtcggcgcggccgtgcgaggcgtcgctgtaccagccgccgccgccggcgatggcgtaccacgacggcgcggtgctggagggcgccgtgccggtgtcggtgctctactacggcgcgttcccgccgcaccacagggccgtcgtcgccgacttcctcatgtcgctgtcgccgcgggggcgggaccaccagccgcacacgttcggcgcgccggggccggcgccg

SEQ ID NO: 58529 - DNA, 1614 bp, Oryza sativa
aatatagtgatacatacaaatgaaatggcattagagaggtttggcctgccaaagagttatatttgaatcactctctgtgtctaagacactgaacaaatctgtttttgagccaattgtggaacactattactatgtctatgccatttccccagctgtgctccactgatttttatgacctattttcatgcatggtttctgccaatttgaagcaataaaattcgttgcatgtgtttttttttccaacaggttatatagacttgtgattgaatttcacagacacttcttgactgtgcgtatatattgtagttgttgcctactctctctatcccataaaaattaacttctggctacgaaactagatgtagccagaagttggtgttttatgggatggagagggtactttcttgataagagtgcgcagtgaacagatagtcctataaattgtttggcacattaatagcagtgtcctggtggtggtttgtgattcatcttatatcatattaatgaaacaaaacatggatgggagtagtcattttctttcttagtttgctctttctatgcataactgataacatcaacgttgtggaaatattgtacataacaagtttgttatggaagtgcattagtgcaatataatttaaggacctaaaagaggttttgcacacaattgttttctctatatacacaaaatacaagtaagctcttgccatgtacattcagcttgatgtcctagtgttacttcaagagtgttagcaatgcattgcagcgacatgagttacttgagttgtgctgttcgtactctgtagcttgtgatgtttgttctgcagaacgggggattatgaatttagcaatacgcatgctttcttttcacgaggatgtgatataacatttagtttcttttggttcagaatgtgcatggtttttaatggccttacgctctcctcatatcaattttggaagtctttcaggagaaaaaatagggtgcaatttagtttgtgcacaaccactggaattgattttctgatatcttgaagataagttcttcagatggacataagctgactttagcatgagcttgattttgatagtagtcaacagtgaggatgctagaagagatacaattatgcaacatcataaacttgaaaagcatttagacaagatgatattggttggctccaaaatcgataagatagtactcctatctccatataggaatcccagtgtgccacataatatcacagtcaacacccatgtacacacacataaacatacttccccaaacatatcacagaatatatagacaaatgtatagccccaaggaattgcacagtcaagaagctgactttagacatgattatgatggttaaaggttaaaaaagaggtggatctacaagaatcctcaaaacacaattgtgttaatctgttccactacctcaatctgaggttgtagatttcattcttcacagccatcttagatcagtattatcaagattaacttgtttatgcttccatctgtacacttatactctccgctctcatttttaccatgaatttttcatctgagttcagtttcagttcgatacctaagcaatgttagtacaccaataattgtgt

SEQ ID NO: 58530 - DNA, 1062 bp, Oryza sativa
tttgaatgcacttgggttttaaacattgtcttttgcagcactacaccgatcccattaaaaattatgtattccgtactatgaggtcagcagcactataccttgaaacagggaaagtaataatacgtgcctttgttcaaaagacaagtgtccatgaggtgtactcttttgaaaagttcacacatttggtaattgttcttcacaatttcttacacttcatgcttgttttactttcgataaaaaaatcacacaattgagtgtaattatatggaattaccatgttttatatctttagatattctgaaaaacgtataagttctaagccatctactttaaaaaggtatatccaggacactcctaactatagttggtctctatcatgatattacgaccaatattcttaatagaatccttctacaatatactgcttccatgtgttattacaatatgcttttcaatgagttgagaagtaaaactataacttaagagggacgaaccagctgtgcacacagtcgtcaaaactccaaaagctttcactgaaagaagagattcttagtgatgagcaaggttcatctagcggtaaatttgttcctgaggaacaaaagttcatcaggtttcttgtgttaaatcaatttttagacatatttgcttcttataatgctctcttcaggttgtgctatccagtataattttactacaataatatgcttcaaattctatgttataaaaaatgataataattaatatagcccaaaaaataagacatattgatcctagctagaaggccaatatcattttaggtgacaattttgctataagctctgataactgattaaatagtgcacctaagaagcaaatccgtatgaccccaatcatacaccattagtttaattaattttcacatcctaacttccacgcaactaaactctacattttggctaatattttcatttttttatataaagtagtactattaaaactaggtccaccttatttacaattagatctagcattccaaatatttgcaaaaaggagagtcttgggggtgacatggttgtctatatc

SEQ ID NO: 58531 - DNA, 717 bp, Oryza sativa
tgcgcttgcacaaaaggtgtatagcattttttatgataaagagaaacactttgattttatggcatggctccatgtttcaaataaattcgacgttgaacgcctaataaaagagttggtacagtcagttcacctttgtacagctgctgagttgagcagcatcagtagtttagatcaagctcagaggatacttaaggacaaactgaaaggtagcaggattttggtagtatttgatgatgtatggaatgaaatgagcagccagtgggagaatctgtgcaagcctctgcagtctaccagtaaaggcagcaaactaatagtaactactcgaagtcaaaatgttgcaaacattaacggggcaaccgagatagtgcatttagatggcctagaagatgaagactactgggaacactttttacagtgtgcctttcatgatgcaaatccatcccaatttccacaattggaaagtattggtcaagaattggtaaagaagttggctggttcacctttagcagctcagacagtagggaacttattaaagtttaaactagatgaaaaacactgggagacagtcaatggaagaaaattgtggcagatagaacagaaggaagatggtattatgccagcactgaggttgagctatgtgcgtcttcctgatcatttgaagcagtgcattatttattttgccttattccctaagaattaccaacttcgaggtgatgc

SEQ ID NO: 58532 - DNA, 2231 bp, Oryza sativa
gacatgcctttgctcaaagaacgatcttctgaaacttcagcgcagaaacgaaccgcacttcaggatccttcggaatgacatgaactacatgaagcacacaaaaaaaaagataaaaccctattcaaaaagcaaagatcagtacataagaagcacaaccatggattctttaggttataattaagaggcttgaacagatagattcagagtttgtatgaccaaaatatggtcatccaaagcttatttgttgtttaatggagatctacaaattattgaattaattttgcaatataaaacatgtttattgctcctagaatgtcaacctcgagaccatggaggaccaagtgcacagaaactgctcacgggtctatggaagtggacccgcgtgtcaaccgaagccagttgcccacaagcgggccccactagatgcaatgcgcgcaaccacgtggcactgacgtggcctccacacgtgcacaccatgacaacacgggtggcaaccgatgccagcagcacggggatcaaagccctctagaaaacggtggtgaatagcaatgccacaaagagagaagccacgacgagaggagaggaactagcatggctagaagagagcggtgacgaacttgacatggagaggatggcttgggggacatagacaaatgggtcggtaattgggagacaacttcggtggtgacttttgggtgaagacgaagcagacgaagcaatgttagcgacgcgtagggcttgatgacgtgaagctggcgatgatgacgacaaagcctgatggctgcaagggcttcggcttgatggaggaaggggcgacgcggacaacgttgttgcggcggccttcgggtgatgggagtacgaggccgtgctagagctcactgttatgacaaaaaatgggatgttttatgacaaaaataactatagaaatttctttaaagaaactcaaacaaatcatttttttaagtttataatggttaatactcaattaattatatactaataatccatcattgatatgtatatgctagaatcggctcatcagtcccagctgtctcgtacggctgcgttcgagctagcacttcggctagcagtttaagcgctaccagaagcagtttaagcgataccagaaaagagagaagtcattaccacatgattaagtattaattattataaactgaaaaactagattaatatgggcttttataaagctttaatatatatttttttttgcacataatacaccgtttagtagttagggatgagtgttaatagaaaacgaggaagttgtttagagttgaagcttataactcagccttattcacaggctgattaagatagcttgactgggtcgatcgactggccgatcgaatattttgttattcctaactggctaaaaactgttaatacgtttatataggatcttgcgctacttgacatatacttttctacctttttctatcattagcagatatatgcatgaaaactccattttgagcaaacaattagaccattacctggcaatgtttaggccctgttttagttccccaaaagtttttccaaaaacatcacatcgaatctttggacacatgcatggagcattaaatataaattaaaagaaaaactaattgcccagttaaggagggaaatcgcgagacgaatcttttaagactaattagtccataattaaccagtaaccaatatttgctaatgacggaataattaaactcaaaagatttgtctcgcggtttccagacgagttatgaaattagttttttgattcgtgtccgaaaactccttccgatatccggtcaaacattcgatgtgacataaaaatttttatttcgcgaactaaacatgctcttattgtacagaaaacgaacgctacaatccaggtttaatgaaaggacacagctagcgtattgagctagcaaacatgaattatactgtcatggtatttaagcggcaaaaacacgcagagcaaggaaggtcgtcctggaaaacatgtagcaataaacaagaagatgtaagacaccattttgcttctacctttgctgtggaatatagtaagcagtacaactaaactacaaggaaaaatataatcttgcatcattactcatgaatgacccttcttggtctagaagacaatacctgccattaaattaggcatgttccaagtaatttcctcggcgagctataattggttcagagggtatctgcaattctgcctagaa

SEQ ID NO: 58533 - DNA, 1826 bp, Oryza sativa
ttggtcatcagcgccaacaatatcggtgccgtcccttttatattagtgacttagcttccaccaaggggcatccaccaaggggatatggggatgacgcaaacgtcattggcaccgtcatgttggaccacggcgccaatgaattggctccatgaaaatgatcatttctaaaataagttttctaaaaggataaaaaatgtgaaaaatccaagaaaactaggcaaccaaatcaaattaaaaagaatcaattaatgatttttccactgtactgacaaatgaagctgctcggagaatatagctttttagtttaaatcataatgactctttctttaactatctctaaaatacaagttttctctaaatcagcaacccttccactttcattatcaaaaataacaatccttcctctttatgcagcaacttggaaccagcactgacgaactccatcgagctaaaaatggcagcataaaaaatacggggatggatagccaaatctagttgacaggatacgctcttatgcaggagatgagcatgaataccaccgagaagacgcaaagaacaaactgagatgccttaaggagagtctactgacaatccaagaagtgagacacaaagatgggatattacaagctaataaggaaacaaacattggaaataacagatgctacttatacttatcaggctgaggatgttctggagttatatggttaccgagttctaaaaggacaggctgaaatcatgggctgctatacctgggatttaagcggcaaaactacgcagagcaacaaaggtcctggaaaacgacaggattacatgaaacaataaacaagaacaagagaccattttgcttctactcttgttgtgaatatactatgcagcaagcaactacaagaaacccaaaacgaaaatgagtcttgggagacactacctgcaattttttaggcatgttccagcttccaagtagtttccacatcgaactatcattggttcatacagagggtatctgcaattcaaccacgacaatactgccactccaaaagtacctagttattagaacgaatgtgagcaccagaagtcagaaattcataaaaaattttcacaaagatattagtcacctgagcattaaaaaatggtccccttgtaatgaatcaccaaaactttttttacatgcaacaactatgtttcaatacacataattaagcataagagactatgtggcagctcaatatttttaaaaaaaaattgcagtaactttgtgaagaaaaccacaatcagtgtagtgagcatacacagaaaactaaacaacgaaattacagtaaaaacaagcaatattttttctattctaccataggacattagaatatgtagtgtatgaagctgctcggagaagtaagacagctttttttgtattataatgattctttctctttcttgactacatctacatacaagctctccacatcaccaatctttgctctttatgcagcaacttggaaccagcattgaacaacttctcaaagttaaaaatcacagctacagaaataaggggggtggatcacctcagcctgcatctcaattctcaaagctcattgattgatcagtattaatgaagacacaaaggacaacctgagaagctttaaggagagtactggaagtccaagaattggtagacagagctgagagattgaacctgcatcgaacaactccttggggaacaatggcgactacagcaatagggggatggatcgcctcagcctgcatatcaaagctggttgataaggtgtgttcttatgcaggagatcagtacgaataccaacgggaagacacaa

SEQ ID NO: 58534 - DNA, 1969 bp, Oryza sativa
ccacttgcaagcattgagtctgcagtctcggtatgtgaatagactaaaaataggactcgaaaatggcatcagcaggttgacccagttaagatacttagatgctccaccaggaataatttcaggcataaaattgattggcaagctcacattcctccaggaattcaaccatggcaatgcaaagaaaagaaaaagaacagcatcattatagaaaaactgtaagtatgacaagtgaattccctccttaatcatgaattatggattaaagaaaaatctataagcaaatgaatcatgtctagtttgtgggtacaatgtatatagttgtaacaaaaaatcttctgtgagaggcacaatggtacacaacaagtggttagtagttgtaaatcgtcatgcaattaatttagtaggtggtcgaattcctaataccccgatattatgattacatataacagaagatcgggaaacaacttcatgctctggttatgacaaacatacataaaaattcaattagttaactgaggattatgtaggtcactacatataacgtctaaccactgttctaaaattgcatcatatcatttgattttggctaatacttctcttctgattctattacagcaatcaagaatgcatatgcgtgcactcagccttttatggacaactgggtcactgcaaaaaactagtcagaccaggaacctcacaccagaaaaaagttcatactgtatgtaacgaagaaatcagttttttcactctcagttgcacatgatactctaagaagaatatatatcgtgaataaataactaattgtgttttctatcttgcaggcaccgtgttatttctaaaaaggaaacgacatgttttcaactgctaacatggtgagacattgtcattgcaattaaacttaaggagccggagacatcagtacatcgggagcagataggttgagctacggcagctacaggaaaattgaaggtagaccatggtccttgataatatgtgtcatgtgcaaaagctaaattgtaaataatttagctgctaagttgtgaaactcactaggccaacatgcaggaacatctcaaacaactcaggatttagatgattcggttcacatgaacaatcttcacagtgcttgttatttttatgtgaacggagtcatctaaattttccctgttcgttatcggcttcttctttatgccatgatatgcaagtcatttgtgttttccctaaaagttcacatgaacaatagtacttcacacgatagaatgtggaggacatttgagagcacaatttccaagccttttcatccttccacttctttatttgaagttgattcacctttccataaagtttcaccattcataatcttatttctacttgtccaaaatgttcttccatttttggctgtcaatttcagtgaggaagtagaggtgaaggagaactttcgtccaaaaagaatattgtttcatctagatgatgttttgttatttttctcaatttgacacttatacagcataattcggtgatatcacacattacaatttatttacttttccatgctagtaccataaaggattatttttcaaagaatagggagatatccaaggctccggtaatcattcaaaatatctgcatctcaagattacaacaatctggtactctgtaacaaagtaattcttggatgacaaaagcttcaacgccctattgtccaacacaaaacacaaacaatatgctaactaaatggaaatgcaatgaagccatatttgtgcaatcatatgtagttacaaaaagaattagtaggcccccacggacggagccaggattttgagtcactggagtcatggctttcacttgcaatagtgtcgtttttgaggggactccaactttaagtatctttagctcaaaagtcttttgtagctagaactgtgagcaagttggaattatttcattttactaaaaataaatacataaactc

SEQ ID NO: 58535 - DNA, 2307 bp, Oryza sativa
acataaaggcaagctatggatgtagcttactgccccctccatctcaaaatgcccttcttttttaagagattgggggagatgaagaggtatatggaaagtactatattttaaaataaattaaaatcctagagatagctatatttcgagatggagtaaatagcttaaagaaacacacctaacatctagttattcgattagcagaactactggcctaatgcattgatatgcatgccacgtagctaaattagatcattaacagcccaaatatgtttaattgaggcattattggtgctgtggtggattgacagtagcataacaaataagctactactatattgttttagctttcatgagctccagcagattagcgggctgaccgaggtcatcaaactttgtttgctggggtcattagctataaaatactgagcaattcatttggttggttgaatgccatcggggtcatctgaccccggtgatattactgtggctccacccctgatatgtgaatatcatgtatctggggctccaagctatgtctcagaaaccccgatctgagccccaacctccctgattgtctcatctgttatgagatccaagggaaaagaattcatccggattggaaccaaccaaaagaaattgaaactgggggtaggacttaggaccacaatcattcacaagaacacaaacaaaaaaatttcaccaaagaaaatgtagaaatgcatcaccaaatgaaagaatattaattggccgctggcggagagaaggcttttacttagatgaaggtggcgagtccagaaaccagaaacatcggggcatctccgccaccactgcagactcccttctctcatccagacagtagacatcgccggtgagggcggccttgtcttctttgaggttttgacaaagatgatctgactaggacgaagagcatcaaaagagcagcttccaattagaacaccttatagaatatatgactactcctagtcctagctaggacaacaccatcttgaagaaaatttcatcaagcactgaagatgctctgaacttacttgattacagaatccatgaagccatatctgaaaccatggacaaggtgacacctgaatttgttgattcttcaactgctggttatccctcttccatgatgaccatcatcattaccacttccaccactacaagcagctcaacctcaacagttaaacaaccagttcaagaaaatagatgcaaaagtgagattgtgtcttgtcaaaagttcatgctgcagcaccaaatgaatttcaaaattttgtagatgaaaccataggagcggtattgtccatcacaaatcattcagagtagtccttttagataaaggtcataggaccttgcttttcattgaaagcaaagcaaggaactgcaggtatttccaacatacaggataatatcaggttttctggtcagaccccagtcatctaacagacataactcaacaagttttaacagaacatcctaaagacagtaaactaggactataaaccttcccctggcttcacctagtcaaagtgatagcacatacctaatagacacaatgtacaactccagcaaagataaaacaccaagcagctacatccagcaagactagtatcaggtcagccaactccagaatgtggtaatcgccaagcttttcatggcatcatgtagcgctgaagacaagagttccacccaactgacttcatcagataacagatgggtcttacactgcaaatgtaaagacaattcaaaaggagataatcagaggggatgaggcaagtttatttctgaagattgtaccatttctggtcaacaagagttgccagcaaacaacaataaatagcataaagtcaactctagcacttttggacccaaaccaataaccaaaagaaaaaagtcaaaatttgaaggaattctgctccagttcagagcatctctgcaaatgcaccacaaagcaacaggccaacagcaattgggaatttgaaaaggatatgattagcagtttcaaattcccaacacaactaataaaattcagagccattgcagttccttttctcaactggactgcagattggattctatctttataagccaaccagagaaaatgtttcattttcatggagaaaggagctgatcaaatatccttcaacctcagatcagtcacatcagcaaaagaaaaagaaaaaaaaaagaggctatcaacatgtcctgaagtggtaatttcatcgagatgtaggagagtatgcattataagaccataggacactatgaagaaacaattcatgcagcaaaataggg

SEQ ID NO: 58536 - DNA, 3149 bp, Oryza sativa
cagatcgagaagcggacactggaatgggcaccgatggccctcttcctccagaggacaaggatgccgtcgcaggaggcctcctccacgcagaagacggagctgtcgaaccgggcgacggggtggaggagccggcgccggcggtcgacggcgaggacgtcgccgtttctgcagccggtgacgagggggagggagggctggtggcggtggtgggcgaggaggaagtcgcgggtggaggtgaggcggcgccatgcgcggcacaccaggcggcagcggaggaggggtttggggggaagccgtaccaggatgtcccagacgacgaggacctccgggagggcgacgccggagctgagcggcggcgggagtcctgtcgccgccgccgccgccgccagtggagtgaagtgacgaggccagagacgggctgacggcggagatacccttttgggcctttggctttttctttcttttttttttttttttgaaaattcgatcagcagcacagagaaaccccgttaacagagaaacccttttggcctttggtaccgttttctttgctgtgctatgatcgaattttctccacagagaaacccgttaacaaatttctcacttcgattggaagcacatatcatcggttttcctactatacataacactttcatcacattttgagctaacggtgttagattaaagtagaaaaatttatcctgtaataactaattttgagttaacggaagtgctatatattgaaggaaaatcgatgacatgtgcttctagtcaaagtgaaaaattccttgtgctattttttcgtactggtttttttttcctatggatcgaactctctcttttttgggccggtagagccacgactcattaaacgttcattttcatcttgaacatcagagacaatttcttacgttcaaggcattaaatttcaatcaccttaaaatttcaatttcatttctaaaatttcttctaactgaaatgtgacttcatacatctccttatcatcatcctccttttgccttttccctgtactttactattgaaccatttttttaactcaaatgtgacttcatacataagcatttcaggggtagtcaaaacaaatattaagggtagagcaatggggttcataacgcccactttgatcctcaccatatttggagttgtgacaaacagtccctcaatattcaatatcttgtacagccccaaacatgacccaacttcataaaatgccaaatgattcttcatttcaaggcagaccaatcatgcacatccacccgcacaatgtgtaatttgccggcagcagcagccccttgagtccatttcttgataaaaaaaattctcatttcagctcctttaagcttaaaatcctcaaaatctgctagtgcacctaggttccctttgataggaagtcccattggattgtgctttggctttccaattccaattcgatttgaattgcatattaaggctgtgttcgagaggaggggttgtctcccggcacgcaaaacgaagcatatattattgcatgattaattaagtattgttttttttgaaaattggattaatatgattttttaaaacaactttcgtattgaaattttttgtaaaaaacacaatgtttagcggtttgaaaagcatgcgtgcaaaaaacgagagaagtgagttaggaaaagtgggggaagaacacagcctaaacccctcttccacttgtttcgctactagtacaccaccaaaaaggattgacactatccccgttggattggcatgctctttactcacaaccgcccttgcgttttggatgagaatgtaacccaacccatttgctgcacaacccacaaatttcttactctccaaatagcattctaaagtacgatgattgtccctcccacatatgacacaaagaaacttgaacattgcaatctctaattgtatgaccatgaatcttacacctactgcaaaaacctttgagatcagcttgcgattttaccagttgagtcagctcatctgtcgcctgctcttttccttctagacttgctttgcccgatctctgggtctccgcttgcgactccgatcaggatgccactgctgcggattcgtttgtttatgaatccgcagcctatatgtgcccctgcattagcttctcttgatgtgcttgagcaaccccctctattttgcttctgctgcacctcaatagtcattgccttggtatggtgggcgacatggttgccacctattcggcatgagtttctctcccatcagctctcctcgtgctgccttcaccgccgagacgaaatcccttgaatcaccggattttgtccccttccagatcccacccctcccaccgatgctctccctcggccactttcttccactactcgccaatgttctccatcccgccgccaaatccctcatgaaaatccggcacaaccctcctcagatgatgaaatgggttcgagatgtgggggaatggtggcgtgggagctaggtgcctaggtttacccttgattcgagtggatcgagagaggaaaaggggaaaaggggtggatcaagtttttttttactcaacagctgtgcttccaaaaacatgcggccacagctcacagcagaaaaatgactcgttgttttgcttcaaaatgaaaagttggcctctgctctctacctccagtacatcaagatacagggcaaaaacattcacaaattcagtcaccacgtacacgaccatggttacagttaagaattcacaaattcaagttatcaacagtacagtacaagctgatgcacagctctaaaaattcaagcaccacatgattaggttactaagatttcggcaacaccatgtcaccatcactaggtctgcgagcgtgaaattgaatttattccaaggaacacgtaacaattctggaggccgagtgagctatgccagtatgctcttgtgcaggagatcaaagcaaccttaggtgcaggtgcaaccgtgcagctgagagatgtcgaaacaagaattcaagcatggaagactggcaaactacttatcaagctgaagatgttgacttatttgattaccgaatccatgaagctacatctgaagccatggaacactgaatttgttgattcaatccctctttccatgatggctagtccaccaagca

SEQ ID NO: 58537 - DNA, 1493 bp, Oryza sativa
attaatagaatatgaatattactagctatgacaaaacacccgttgggggaagtttcagacgacaatagtaccttcttttgcctattcagattgtttctttgagacttaaccatgcccacttagctaaattgcagtacttttacatgtatgaaacataactagaaaccagcccatgtctgctccttagacaatcaggatggaagcctcatttgacagagtctgcctgcccctatgcaggatatcagtattactaccagagggatgatgcgacagatagactaaacaaaaatgctacagtacagcttgtgcagtatgctcttatgcaggagattaaagcaaccgtgcgtgcagctgagagatgtcaaaacaagaattcaagcatagcaaactggaaaagtacttatcaagttgaatatgttccgtacttacttgcttatctaatccttgaagctatatgtgaagccatggacaaggtgaccaatgaatttgttcattcttcagctgcttgttctccctattccatgatgaccaccatcatcaccaccacttccgtcgctaatagcagctcaaactcaacagttacacattcatcttatattctcaaatgcattttttctccgatgaagaccttaatggcttaattgatttagtaaacatatttgatagtattgatgaacatatgccaacattcctggagatagattaataaatgcttgcaaacactagcttcgatggcacagaacctctttgccaggcgaatccttttttggtaggatccatggaagtaaagaaattgaaaggaaaacttttggataagaatgacggtagttgaaattgcaggtgctggcatgactgctttactgcgccaaatgtaaacagccctgctgtgaatgcgtgcttcaaccatttaacagttcaattttttcaagatatcaactattgtttccaactaattataaaaatcactaaacaatataacttcctggaagaagacaaacatgcccaacaattgcagaatgcaatggactctgtcagtaactaccgcgaactgttcatttcattgaacactgggctctaccgtaaccatttcattaagagtttttagagcattagagcactcccttgagtgtaaaaaacatagcaaatcaaatgtgcacaacatcccggttcaggaaaatacaagcaaaaaaccaggttaatgtttatagtgcaacaccaagtaagtttcatttttttttagataaaaccatgtgagcagtattgttcatcattaatcagtgagagttgtttccaccttggaccaaaagactatcgacatgtcgtatttgtaattcaatcaagacgtagtaggttttgcattataagtcacaatgaaccaactattcatgtggccaaatacaattattgtatcctggttgcacattcatctacaataagttcagctaagaagttttcatacataaaagcacaattcagaaaataataagtttgtg

SEQ ID NO: 58538 - DNA, 1243 bp, Oryza sativa
caaccccaagaacatgaatccggagatcagcgggaggtcaccgaattggcgcgtggtcgggttacagatggagtattgcggggggccggtgttccgggagatgagaaggagtccatcgcaggacgaatccaggtagtcggcggtgctggcgtaccgggcgaccggatggagccgcgcggcggcgcccctgcggcggccgagggtgagggtgaggacgtcgatgaggtacataatatcggcgtagtcgcaggcggcgatgagggggagggagggctggtggcggtggtgggcgaggaggaagtcgcgggtggatgtgaggcggcgccatgcgcggcagaccaagcggcagcggaggaggggcttggggggtaggcgtaccaggatctcccagaccacgagctcctccgggagcgggaggccggggctcaccggcggcagccctcgcgttgccgcctccgccatggtcgccgtcgcggcagcggcggtggagccgtggaaggaggtgaggcgaggcgacctttttcccttttttgagaggggaaaggcgaggtgacttgggttgggtaggagctttgaatgagccttgggccttttcctttatgggccagcggagctatgtgactaattaaggaataagtttatctgaggtctcttaacttatcaacgaatccgattttcgtcctttaaccggaaaaccagatacaacgggtccctcaactgttaaaaccggtggtctcattttagatggcagtcgctgtgcaccacccctcctcactcacgcttggagagaggacaaaggagatgggagagagatgaatacatgggagttggggagagaggaggaagaagaggggtgagaatgacatgtcggatttgttgacagttaagggacctcatatgaacttattccactaattaaatggtgattttcgtgttgagggctagtttagcacagttctagctccatgtcaaatagtttcaactccaccaaaaatagaagcggagttgggtagagttctctcacaaaataaactagatgaatggagctgggtttaggctgctacacaactccacttcagacccaactcctgtagctaaattcaatgtaaggaaagtatctttcatgccatatataatatactctctctgtcccaaaatataataatttagtgcatgtttggtagagctacaactcctaaatttagcttcaaaagttgggtatggagtggagttgttaaactgc

SEQ ID NO: 58539 - DNA, 3308 bp, Oryza sativa
cgtggcagtttaagaaagcaaataaaaagaacatggacagttgatcggaagaggcaaagcaagaactggagaagtggaaaagtaaaccatgtcaatgaagaatttatagtggggcgagctaggtcaatggtttccgaagatgaggtgcttggatctcggaaatgctgttctgcgatcgatcgctctggggatggggcagcgatcgatcccctcccttcacctggttttcttttttggtaccgcattacttttctattttagtaaatttttacacctaaagtttatacatctcaagtttacacatctaaagtttagagaccaaaagtttataagtcaaaagtttatatatccgatttaaatttgaatttgaattcaaatatttttttatatatagtatttctgtaaatctaaagtttatacacctaaagtttatagatctaaagtttataagtcaaaagtttatatacccgtttcaaatttgaatttgaattatatctgattcaaatttgaatttgaatttaaatattttctatatatagtatttctatacatctaaagtttatacacctaaagtttatagattcaaagtttataagtcaaaagtttacatacccgattcaaatttgaatttgaattacatctgattcaaatttgaatttgaattcaaatattttctatatatagtatttctatacatctaaagtttatacacctaaagtttataaacccaaagtttataagtcaaaagtttacatacccgattcaaattttaatttgaattcaaattttttatatatagtatatctatacataaatttttctaacttttgtttttttaaaaattttgtgtggtgtactgtagtagaaagagaagaaggggaggaggaaggaggagaagagggaggagtatagggggttgcgatcgatcacccattagcctccccccttgatcggaagacacagaaacgcaccgattttgctaaacgtttgtcgcgtgatttctcatcgaaaatttgacgtttttctggccgtcggatggtgcgctagattggtggtggatttcgcgtggggagccacgtgggccgatctggtccgagctcgtgtcgtcctagccgttttctcgctctctcgcctgcgctttcttttctcgttctctctctccctttcttttctcgttcgctccggagagagtgagagctctcgcaaaataaatctccttcccggtgagttggtttctcgattttctccgtaaaaatcgatttctttaaccattgaaaaataagacaattgaaactaaaattatacatgtaaatttagttgatatgacatgtaagtgcactgtaattttgataaaaatattgtgtaagtaaatttgtattagttattttatttcaaatataaaattacaatcctatataactaaaattacatatgtaaatttagttgatatgacatgtaaatgcactgtaattttgataaaaatgttgtgtaaataaatttgtattagttattttattttgtagtccgttagatacaaatccaagggaagaaaaaatctagacccgagtgatggataggcggtcccgaaacgcacatgcactggacatactagacaggtaagcacggcgtaacgccgcgcggtagctgtcgtgcaccgtttttctttttatacggtggctcaatatctgttaaatattacacatggtcgcatacgcggcaacttgagcaggattatgtgcgctacgactacaatttcatatttttgtgttggagaaggcacttagactgaatgctagaatgtgtgtgtatccagtgctatttttagaagaacccctgcgtctatatacgaaaccttcttacgcaatacataaagaaaattaaaccaataatattattgcccaaggaacgtcacacacaagtgtaaataataccgagcaaatatatatcaaagttgatatctgcacttagcatttgaacacggggacaaaaaatagtaatatcccgatattcaagaaaagagtaattcatccaacatccaaaactaagtatattaatagacaaaacataaatgacagagaaacatctgtaggctatttcttgtgcagtagctccacacatcaagacagaaaggattaacatgtgtaaatcaaatagcaaaattcgcttaactcgcaaagttctctactaaatgccaaatatatatatatcctaaacatttgtataaaatgacatacaacaattgagcaaaaagtatcagtgtgaagttaaggtttagtgctcaactatgacgctagcacactattttgtccttctgcagagaaaacaatcccaaccatagagataattagatacaattaggaaatttgaaaatactaaagactaactccaaaatccaaatccaataaccccacggcaataacacaaggaaaagcactattttcgcggcaattaccccgcagctcccagggccccaactgctcgttcgagtaataccgttggagacctcgacaccagcgccatctcttcgtgccactcacgcttcacgtccctgctcctcctcgcatgtgacccgactcacgcacctactaccttgttctggcccttgtttagttccaaactttttcttcaaacttctaacttttccatcacatcaaaactttcctacactcacaaacttccaacttttccgtcacatcgttctaatttcaaacaaacttccaattttagtatggagtaaacacacccgtaaaatctttttctatatggttcagaataaatatatatacccatcaacctatgttttcaatacttttagggaccacggatccattgtgagtcaattctatcctaaaatagcccggaattctatcctaaaatacaaaggagtgattgatttaattaggaatagtaaatttaattgcagaaaaaaaaagtaagattaggctgctgttgaaggcttacacttcacaagttgacataacatgcatatacttgcatgtctgtagcgcttaactgcttgtacaaaactacaacctatgattttgtctggaagaacatttataagattgtgttttctaggttttgtttttttcccatgccttgccaaatgagatattcagaaaaccagattacttggtctgaatccatttttccatattaccatttggagaagattaacatactgctgtgctattacttatttggaaattgtgttatatgcatagattgtttaacttagtctacaggagaagttgtattttttgtatatacataggagatcacttttgctactttgagcagctgtcaac

SEQ ID NO: 58540 - DNA, 1397 bp, Oryza sativa
ctcccacacgaaaaacagagtggtccattagcacatgattaattaagtattaagtaatttttttttcaaaaatagattaatttgaatttttaagcactttcatatagaaattttttgcaaaaaatgtaccgtttaacagtttgaaaagcgtacgcgcgaaaaacaagagagtgggctgaaatgaacacagcggcacggccatgcgtccatgcccgacaccgaatgtctcaatgatgttctgcacatcaaccttaacgatatcgatgctgcagggggcaaggtaggcgtgacgctcaccgtagaaggtaggcatgggcagtatggtgtgggtggacggaccccatgtcgagtacgtacgtagaaggaaaccatgatgatgtccgggtggctggttcctcgatcgtcacccctgtgactgcacccggtacgccaacgtcgcctcataccacacctacggtccgtccccttcactgtccgggtcgcacactcacattactccagtatcccgccatcgcatttctcacgtacacctatcgaacacaacaaaacataagacaccaaccaaacaagaaatatgcatggcagcggaaaaaggtatgacaacacacaggaaacaactcaagtagcactgaagaaataaagaaagaatatatattgatgtgaagaatgtatgggaaaacaacgagatggtcggacttaaatagcaaaagaaagagccaataaagtgagagaaaaaataccacatacttaaggagcaaggaggagcataaacattggaaagaagagacacatgacaacacacatgagcagcatgagagcacgcagcacgcgcatgtcggcacgaggcaagcagaagcagctagctagatgtgtgcaacattgtagcttgccatgcatggactgtaagaagataaggagagagaaacaatccttagctcacaagctaaaacaaacgacaagaacataatactgcgtgtactgtaagaaataacgaatcaggaaggggcacgttagatataaccggccgttaccggctaagtaaaacacaacgtaaaataaaatggaaaaaatcaccgacacgtacgtgggcaccatgtgaagaaagttggccaccagtaacatacaccggatacgtcaccccaataggaaatcaaccggtcaccaaatcagtggaaaactgtaaaaaaaaatcagcaggacacgcggcaagcaatggaagagactaaaaaaatttcaaaaaaccaggaaaatcggaacctgatcggtgactactaggtaagtatttcgatgcttcgcctggtgggcctcgaccatggttcattttccagcagcagaccaataaaaacgatctaatcctaccatacaagttcaaatcaacagttcaaaagcaatcaagg

SEQ ID NO: 58541 - DNA, 2443 bp, Oryza sativa
tgattgtattttaaaaattaggaattgagctatgaaaaatccgagcaaattctagagtgtaattaacctcggagaatgtaataaaaattaaatccagccacgttttgtttaggaagttttactttacaagcaaattaatgcaaattaatgtacacttcaatataaattctataaataatttataaatcaccgaaataaaaattaaggtgtgataagcagtcgtagcagcagccgcagtagctgtgcacacaaccgtttgggaccaaccaccgcaaacatataaagaaggaggctctccttagcaaagcgcgagtcgtggccaccgggagcagcctagcagacgctaggacaacattaccagtgcagaccactcctctaactataatggaatacccccgtcgtttggtgcatgctgctctttctcaggtagaggttatcatgaccttgaatcgagggtttgcggacatcacccaacagctgagagcgagtataatagtgagctataagcctactataaatttagatggaggagagatagtgaaaaattaagagtgttggagcttatcataaacttcaaaacaattacattaaatgtataagaaagagatagaaagaagagaaaaaaattatagccaaccttatagctaatatattatatatgttgactttaaaataagctaatagtaagaagtgagctgtactattagctctgatacagcttgatctctgaaccgaccagaagcagaacccaccgaacagcatgtccatgagacccacacatggcagcagcataccgatggccagtcggtgaacatcagcgccaccgtacagaaaagtcaggctaacatgttggcctttccagtcaaagggattcaatccctagcttggaggaggatccccacactaaggtaatttggatatatatttcaatgcattgcatttaaaaagaaaaacctataaaaatttgcaaaagttaaaaataccaaaaatatgtgctttccatattcagtaaggctgtgtttgctccttcgggttgggaaccatctctaccacacaaaaaacgaaacggtgcattagtgcgtgattaattaagtattagcaattttttttcaaaactgaattaatttgattttttaaagcaacattcgtataaagaatgtttgcaaaaaatgcaccgtttatcaatttgaaaagcatacgcgcgaaaaacgagagatgtgagttgggaaagcgggagaaagaactcagcctaagaatgctctagttctaatagttgaaataatgaatagtttctctattttgtttcctccagtgcttagtttataacttagtctttgcttaagtttttgagtttgttggataacaatctttgtcttgaacttgaaacttgtgggttgcacacgcatgatctatgtctaaattgttacgggatatgagatggtgaaatagagactctatgatatttctccaagcgatacttgaactccggagtccttattttcaaaagaatgaaaaatttgtaagttcctcaatgatgaaaaattcctaccaaaaccatatgatgagtacaatgaaaaaacctttacaaatatgctacatgttattgcattgagttttttgaaattgttgtgacccttgtgagattgttttcgtactttattaatcaaggtcacacatgcgcacccaccatatatgcttgacctctacattggaggttagcaaaaaatgtcatacacccaccatagttgttttgcctctacactggggattagcaacattccatctaccaaataaatgctccatttatgtcagtaaaaaatgtctcacatggtagtttgcaaaagagatgactgtgatagaagaggaaaaaaaagaggagatagaaaatagaaaatgttctcaagcattatgagaaagaaaaaaaaaagaaaaaggagtgtatgcgcacgattgttcttgagcagcatgggacaaaaaatagaagaagaatagtcatgtctccgattaggaataaaagagagtctatgacaaggattaccaccaaacactttccaccatatagccacacagttgcacatcttgatcacatggtatttgtgttctccatggatcctctttttgattttgcaatatatgtgtgatacaggtattgcctcatgtttttttccaccttgagctcgacatatgatccttttatacgtaggatgaaaacgaggcaacataatgcattcgtgaggaattatacacattaagtgatctgagagtaccatttgagaaacttagattttatttgcaaaattctttataacctccggaaagaaagttgaacaaagaatactcgaggactaagaaaactattataattctactccactggcactagaacactaaactaaactttgaagagagcttgattgttgacggtccttaaatcataatatct

SEQ ID NO: 58542 - DNA, 4413 bp, Oryza sativa
tttcaataaacactgacctttgacagtttgttaatcacatagattaaattaccaccttgatttcacaaccgcccccttgatgaacacattggccatattttgaaaatgcaatttgtgtttttgaaaagaaaaaagaaaaataaaaaagcacaaagactgaaaaataaaaaaaagtaaaaaagaaaaatctccccatatttgcaataaaagcacaaaattgactattttttaaaatcgaaacaattctcccctttcaagaagaattcattttgtatattttcctgcatgtctaatcgtttagtttgatccacataatatgaatcgctctagtttatccggtacccgttgataccaccacactgtaaacactgagtgctacctagaggtcacaatgatgtctttatattatttattatctactccttgcatgagcatgacgagtgttattccacactaaatgtagaatcttaatgccgttaggtttggggggggggggagggggagggtaccaacataacgctgtaggcgaactggtacagttgtcccctttttaatgccaaaatttggtatgattctctagtggattcggttaatgatggaaattgattggtagatgaaactttatccagatcaagctgaattcaaataagaatcgtgaagaccgtgacaaggctgtttcatatttttagtatatatcttaaataggcaagattagttattttcgttttcttgttaggagtcttatctcgtgtccaatcaggacttgtatcaatccaagggtataaatatgtacacccggggtttttgtaaactatctcttgatcaatatacaacttttggtgcatcgccaccttttattccgacgagttgttagtttcgagcggggttgcatcggttaagtttgactccggcaagaggtaagttccatctagttcgcctgtatcagcgtggctagaacttccacggttaggttcgatattctattcaagttaatgcaagtcttgcctatatgatatatcgagtctatcttccacggttaggactttcatggttaggttcgatattctgagtaagttgatatttctctaattaaattgttgttttagatttatcgatatagatctgtcggctaaataggtttttcttattatcttcaatcttatagtgtctcggttaggtttgatctatcatattgctgctaataagtttatttctattaagctaataagtttttatgcgatgtttcatcgaagttttagctgatgagttatcatgttactatttctaagtgttgcatccgctcatattgatgatcatacatattttggttctagccgatgatagcatgaatgtcgacggtggatacccgtagaccagatatagagggtatcggggtacgctggtatgaggatctacgtagtatgacatcaaacaagcagaagaccaagattatactggttcaggccccttgataggtaatagccctaatccagtagatatgggattatatgatggaaaccacagattacaaaggttgcggaactcgatgataccgacgagaccgtaatcgagttggttcgactagatcacccgatgacttggctcctgtgggctccgactttgtaggctgaggtggatgtgttggcggtgagattcgatgccttaggacctcccgggggtcccttagagacatagagttatcgataacattgtacgaagttcaacggtcatgagtgaatttaaattgaagtctgaaaactgctgcgcgtaacggacccagaaatttccggcggccatctctctcctttccttggactacgcaccgtcggtaatgcgcttatttaaaggagttttggggatctattttgaagttcgtttgccgcagaactctccagccttcaagcgcccctcgtcttctccgctcccacagaaaaaaccctagtttgctcatctcagtttgttctccggcgatctctagcggtgttggatcttgataagtctacctccactaccgcgtccttgaagaagctgcaggacgacggcgccctccctggtagcgggaccatggagagggaagcaggaggtattgaacctgaacccctcctgggccgcatggttgcggttgaggattatatttcttgcggttttcttcctccgccctccgaatttcttcttctcgtattgaatttttatggcctttccttgctccatctgaaccccaattccatcgcattcctcagtatcttctcttatctttgtgaggcctacattggggtagagccattccttgatttctttcgtttttactacgagttgcgctggatggaatccaataggatatctggatgcgtcggattctgacttcgggatggcgggcatccccttctagtgcccctcttctcgtagcaaatggcgggcgaggtggttttatcttcagatagaaaactcggatccagtctttgttgtccctgaggagcaaccagacaagattccggaatggaccgccaaacccgccctaactccctcccttcagtctttcatcgatatcatcgatgacctctgagtacgagggttgttggggtatgaagttgctgccgacttcatcggtaggcggatccaactgctccaggctcgagcccacccggcctttgactattctgggccaaaggacgcgtcccgggttctcctcggggtatttttctcgtgtttcagatttcatttcttatgtgcacgttcctcctgacttattgagttctggttctcgatctcacaggtttgaatagcgaaaccgtggagcgccgcgtcggtaaagtgatgatcagcagccctacgatagcgagcaacatccccgtccccctttgccagaagggggtggccgaatgcgaggctgtgatcaacgtgagtatacttgatgactcctttatttctgtcatcctaggatcgcgtcgtgacttcatgtatgcaggctctccctctgacggatgtcatcgggccgcttgcggaccatcaggcggcggcgtcattgaaagagggcgtcgccaaagaggcgtccgacgttgctgctgctgccacgacgagtggcagcaacgttccgaagaaggggaggaagttctcctccgtgcccgggacccactggaaggcgcctaacccatcggtaagcctctcttgtcctttaacacgtagtcggaagatcttgacctcacaccatgcttatcatacttaggcctcggacgcgtctcccccgccttagcgacggcaaaggctggtgacgctcagcaaaaagtaagtagatgattttgaggtcctttaattcgcaaaaccttggccgcctgactttatgaaaatcgtggaaatcattcgcagggcggcgcgggcaaaggcgacgcaagacgggtccggtgcggcctccagcatgtcccctgtggcggcctcgacagatgtcgtggtcgtgactagggactgggaggcgacgctgagtgggcccgtcggcggccttgtgcccgctcggggcccgcccgttgatgccctcacctagggggagctccaagccgagataaagcgcatcctccaggctggtgctcgcgcgtgggccgcgagatcaaggaagccagggcggcggggtcgtcggcaaaccacagcgccgagcagctggcgcgtggtctggcggaggcccgcgaggacctcctgaagatgagggagttggtggctggtaatgaatggcggcgacaagggctcgagcaccggatgtcagagctcgagaacttgtcggagatccgcagctcgctgcgggtgtcttacaccggcctacaccaactcgtcggggagtgcggcgtgacgaccactatcccggcgacccctgacgagttctcgctgacgtcctcgctcgcggacctggctgtggcgatggaggagatcccctccaagcatgcggccagaatcggcgtggagacgtgtaacgggatctacaccggggcgtgccatgtcctcgcatgcgtgaagctggcataccctgacctcgacatcaagagggttctggatcaggaggtctgttctccccctttttgaagagtaggattctgtttcccttgtaccccttaatcaacacactataaaaacttctattggcccggacctcttttatgtatgcagctgttttcctttgttttcttagcatgtgattccgagtaccttgttgtcgttgtagagatgtcgacattgaggatgtccagcagcgcgggcagcctgagacgccggtggtcatcccggcactagcgcttgagccgtacgtgccgcaggatgacgtcgatcagagcctgtccgcggaggcgaacatggcgatgacgtctttaggtttgcaccttgggctttacttccttcactcttttgttcggattgacttaatttgctgggttc

SEQ ID NO: 58543 - DNA, 11849 bp, Oryza sativa
agatcgtcggatccaatactggaggacgaagttcgaggtggccgaactcgagaggaccatggtggaagtgaaaaaagaccaagctgtggaagcactccgaggtcgcgaggtgtagtttaactcgtacctcaggagctgttgtatggcgatggctggagtctgtagggaacgccgagtacctcgcgggaatcccgaggagtcggtggctggatatatctcatggttgaatagggcctgtgctcagcttgaaggcatcggcaagcgtatcaacgaggcgctgaagcaggagtgtcgtcggtcgagccgatatgccagagggcacgtgctggcctgtatctgagatcaccgcccgtagctgcacctcgagttcctccacgaagggttttcacgttctcggaggactcccgcagagatagagaatctggcgaagtcgattgtgccgcttgccgagaatgtctttcagtccatggactggcgtttgccgtcctggtagtctttgtatcctgtaaaaattatctcaaggagacatgtaatatattttggagcaattatgaattgtaagaagtacttgtgaaatagacaaggaatctatctaactaagttttcttactctggatatgctgtgtgtgagtgttttctcatttcgcgacttcgatcaatcgcttgagtcatacactctccctagcccccagccttgttgtcggagaaacgttctcggaggataaggctccttgacccttgacctgcctcggttgaaaaagcattgaccctagcccccagccgtgaagttggaatactcggtttccgattacacgggttggttaatacgcacgacgagagctcttacatgacctgatcttacatggtcgtttgtctctacatgatccgacaaggccttatctgctctgggtgtccccagccgaagttccctgaggttccttagaggccttgtcaagacggcgtaaagggacatgagggtaggtttcaacgctaggtgtcgtcgtggtaagggatcgtcgggaagaaacactttgattgtaatctttacctgaaaatcaactttattgaagctgtaagatgtcttgcaagtatggatgctattgatttatacataaaatttacgtaattgatcaatgttccaggaatttgctaactcacaaccatcgccgtctgcaatcttgaatgcacctggccgcaagacttgcgtgatcgtgtatggtccttcccacttaggtgagagctcgttacgccctgcttggctttgaacccgtcggaggacgtaatcgccgatcgaaagcgtgtgtgctctgatgcgcttctcgtggtattggcgaagggcctgttggtagctggctactctgacggcaactctttctcgatgctcctcgagtagattcacattgtcgctttgctgctcctcttgatcctcgtcagagtacttttgtactagtgttctctcgatgtcagagcatggcttctgaaccatacatgtggaagaagggtgtgtccttgttggatgtcgtcggtgtggtacacacggcccatagcacagaggagagttcttcaacccacttcttgtcatgtgacatgagtctgtcatagacacgggtcttgattccttgtagtattatgccgttagccctttcgacctgtccattactctgagggtaagagaccgaggcaaagcagatcttgactcccagcccaatgcaataatcctggaagtcggcactgatgaactgggagatgttgtctgttatgatgcggtgaggcaatccatatctgcagaatatccctttaatgaatttgatggcgttgtcggccttgatttcccccgtgggcgtcgcttcgatccacttggtgaacttgtcgatcgccacgaataggaacctatatccgccctgtcctcgtgggaatggtccgagtatgtcgagcccccagcatgagaacggccaagtaagagggatagtcaggagcgcttgtgctgatagccttgtgtttttactgtggaattggcaggcttcacaccgctgaaccatgtcgcaagagtctttgagggcggtcggccaaaagaacccctgttggaaagctttttcgactaaggtctggccagcggtgtgtgacccgcagatcccttcgtgtatgtccaggaggagatgtttgccgtcgtcggacgagatacatttgagaagtaccccgtttggcgcctttttgtatagatcgttgccgatcatacagtagatcttgacttgtctggataacttctcggcttctgtatcatcctcgggcaactcgtcgctacttaggaatttaatgagtgggatccgccagtcgtctgtagtctcgatgttggcaacggcgcgttctgcctctgtagcccctgagctgatgtcggggacgaccatgctatcttcgtcgtttgccactttcaccaatggctttgtcaggacgtctaggaaggtgccgggttcgagtggctctcgtctggacgcacgccgtgctaggtcgtctggtttgatgttgtccttgcggtatacgtgtcggaccttgattccatgaaaccttttttccagcttcctgacttctgcgaggtacttggataactcagggctagagcacttgtagtctttgtgcacctggtttgcgactagttcggaatcccctttcacaatcaatcgcttgactccaagtacggctgctgctcttatcccagcgagtagtccttcgtactcagctgtgttgttggtcgccctgaagttgaggtgaattgcgtgcttaaactgatcgcccgaaggtgatatcaagatgtgtcacatcctgattttcgttttaggatttataaattatttaataaattattattagaatttatattaaatattcattcatttacaagagaagttaaatgtgggaaataaaatttcctaaatataaagcatggatggatttattttttattaaattctccatggttaattatactctctggaattttctcggatttttcggagctccattcctaattttaaccatacaaagaacatttcagtaattatccacatattaaattaatcattaaatggactgattattatttttttaagtactttgagtgtacaagtattttcaggatttttcttgaaactagttgaggattggaagtatttttaacaattcaaagatcatttcagtgattattttaattggaaaaagtttttaaatcctctcctaagccgttgggctgatttcagcccaacatctctctccctcgcgcgcgtgctgtgcggccgaagtcggcccagccgagctcctccttctctttctttctttgctttgttttcagccagcccaagacgaaaagtctaatacgcgtccctgctacagtgtcgtcttcaagcttggacagaagcccgagctgccgtcctgtgccctgtagccgacgccgcttcctccaccaaatccaccgcatcccgtgctccgtttgcaaaattagttgaggggaaatatttctcttatcctcctctatcatttcctccaagaatcggactttatcccgaagaaatcaacgcggaatcgaattcgttttcgagtttatctctgcaactaaccctcggtttttccggctcaaatcctctcggttggagtccgatctcttcaatccaagcctataaatagcatcccctagtcgtcctcttccgtttgccccaagtcctgagctccctcgtcgcccgtagcgccgccgccacgttgccctagccgccgccgtcgtcggtgaccttccagccgcgtcgcgccgccgcggtagccgtgtccgttgccagccgtcgccgccgttgggtgcgcacggaggaggggaaccccggcctccccttcgcagccgccgaagaccgccggagcgccgtcgccattgttgacccgagccgagccgccgtcgaacctcgtcgccggccgtcgttcgtcgtcgtcagtcgttgttctttgcaccggtgagttcgcgttgttctcctctacgcgtaggtaccctccaaaagtccggccgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaatttttctaaaatcaagatctacatgttaaaaatatccacatgtactgtttttgcttgtttttgtactgttttgttgattttgttctttcattttagtttccgaagttccgaagagagcgttttcgttgaggaaggttcggaagtgtttgcggaagctcaaggcaagtcacacagatcccaaacaaccctttgagcatgttgaacccatttaaagctattgttttatttcaacttatgcattattttcgaatgtcatcgggtggtgagcctttcccaattaattaatggccgaagatgactttattttcctatgggttataatttgattagctagaaccttatatattggtttgggttcagctaaatgctatatatatataattacttagccatgcttagaaacattagcacatgattgggataactaatattacactatcacttatggttatatttaatggtagctcacgatggtcaatcgtgattggttaattaattattgccaattaaaatttgtcaatggtgggttgtgagcacatggttgtgaaggtcgtgctcatggcaattaagaaccggttcgcgagctactgttgtgaaacattaaccgtgccaaccacaagccagcgtgggcaacggctttaccttttgtatagcatgattcattgcggggcactagactgagaagcggcgagaagtccgtgtgggtcgctggggagtccatgtctctggttatatttatagagggggtgattatgatccaggtatggtgcactgtggtgagttgtgttgtgcagagggtattgtcatagcctctattcgggtactttccagtatcgcgacgcatggtagacatgatgttgaggctgtgtcttgtgggtacagtggtacacctctggccagagtaaaactattcgaatgagcttatattatgccatcctttggtatccttgtgcacttgcatatttgctgtgtggcttgttgagtatgtcatatgctcattcttgcaataatcaaatctcagttgaagaaaaaggatccagaaggagaagacgtttggcttataccctagttgagttgcctgtgggagtggagctgaagccatcgctagaccgttattccgctgctgttgtttttcttttcttttgtaagtatgtaacgttattattatgatggatttgtatattaaattgtcagtttgtgtacctcggctgattcctggacgaggattttatgcacaaattagttcggaaattattagtgaatttccgggcgtgacaatatgaaccctgcccctgctccttgactgttgagtgcgccatcgaacgccattgtccatgtttcgctgtcggtttgactgtccgacctattttcaggcatagtccagtcagctacaaaatcggcgaggagctgggacttgatggctgttcgtggcacaaagtggacatcaaactggcttagctcgactacccatttcgcgatgaggccgacagcatctttgtttctcacgacttcaccaagagggaaggaggaaacaactgtgaccctgtgggtttggaagtagtggtgtagctttcttgatgtcatgattactgtgtaaagcagcttttcgatctgtgggtatcttgtatttgcgtcatggagagctttgctgacgtagtaaactggtctttgcaccttctctctcgacaacaatgacggtactcacagaatatggtgtggcggcaatatagaggaataattctttatcaggttggggagcaacaagtacagggggatttgacaagtagcgcttgagtgcgatgaatgcctctttggcttcctgtgtccatacaaatttgtcttgtttcttcagcagagcgaagaaaggttgtccgcgctctcccatcctagcgacgaacctgctcagtgccgccatgcatccagttaggatttgccttgatcttctccggatttgcctcgatccctcttccagagacgaggaacctgagcagcttgcccgatggtactccgaatgtgcacttctctggattgagcatgaggcgatatcgtcggaggttgtcgaacgtttcccggagatcatcaatcaatgagtcgcttgtcttggtcttgacaacaatgtcatcgacgtaggcctcgacattgttcccaggctgatcgttaagtgccgcttggaccgtgcgttggaaagtatttcctgcggttatcagtccaaacagcatcttaacgtaacagaatacactgaacggcatgatgaatgctgtcttctcctcgtcctcttttgccatgctgatctggtggtagccagagtagacatcaagaaagcttaacaactcacaaccagctgttgagtccaccaattggtctattcgaggaagagggaagtgatccttgggacacgccttgttgaggtcggtgaagtcgacacacatcctccacttcccgttagccttgtgcaccatgactggattggctagctactctggatggataacctctctgatgaagctagctttgagaagcttgtcgagttcttctcgtatggcttgtttccggtttggtgcaaatctgcgcagtttttgttttactggcttggcatcgggtcgcaccatgagtttgtgctcaatcacctccctagggaccccgggtatgtcggacggctgccaagcgaacatgtctacattgtcgcggaggaaggtgataagcgcgagttcctatttctcgtctagtgacgccccgatcttgacggtcttgtcgaggttggcgctggagagtggaacgatcttgattgcgctgtctggcttcggcgtcttgtttgttttgctcactttcttgggtggctcagctgtggcaggtgggttgggcgtgtgttcgaccatgtcgaggctccgcatgtcgcactgcaccgccagctttgcgttcccctgaatagtgattgttccctttggcccgggcatcttgagcacttggtacgcgtaatgagatgcggccatgaacttcgcgagtgcagttctcccgatgatagcattgtatgctgtatcaaattcagcgacaaaggtgatctgctctgttcggaagttgtttgcttggccgaaagtcacaagcaacgtaatcttgcccaatggcttggacgatgactgaggagtaattccatggaagggttgatcagtgggcgtcaagtcacttcgtgggatccccatcacgtccaaggtgctggcgaagagtaggttgatggagctgccgccatcgatgagaactcgtgcgaccttgatattccgaatagtgggtcgaccacgatcagatatcgacctggggtgacagcagtcttggggtggtcttcctctgagaattcgatcttctgctcagaccacttcatcttggactcagccccttgccatgtcgaacaaacttcgcgctccactttcttgtactctcgcttcgaggagtatgccgtggaacctccgaagatgtgcgaaacatggagatcggaatttgggtatgctgagtccgagtcctgagtagctgcttcagcggccttctcgactacatgtactcgcttgcccttctccaatgcaagttgctttgcgagtgactttttgaaaacgaaacaagcttctagggagtgcttgtccgacttgtgtatagggcaccatattttcttcgtatcgtcgccttgtgagtctgggtacttgggtgggtccgcatattctgctgcgaggacttccatttgagctttccttttcccactcttgcaactcttcttcttgcttgactcaggtgtgtccttggctggttttttctctccccccgtctttggcttgtcgttattgcgtctcagtgcgtcgtccgcgtgagcgcatcgatcgacaatctcgaatagctttcgagcagttgtgatctgtcttgtcaccaactcctgggtggtgtagcgatctctgacaccagtcttaaaagcgcggatcatggaagcgttggtgatctcggggatcgtatttctgcactcattaaagcgccgaatgtagtccctcaatgattcgcccggattctgtgtcaacgcgtgtaggtcgtcttcgatcgcgtggcgcttgtatgttccttggaagttagcgacgaactgttgccacaaatctacccatgaagaaatcaagtatggtgggaggtggactagccatgaacgtgcagatcctttcaacgccgccggcaaataattcgctaacgcgttgtcgtctgcttcggcagcgtagagtactatggaatagacctgaaggaactcctcagggtcggtgctcccatcgtacttctctattgctcccggtcggaatatctcaggccatcaaacatctcgtagagcacgactgaaagctctacacccaccaccgggggcggtgggttgtcggcgattgtatgtcctccgtggatgtctgtatgacgacgaggatgatgaggatgatgacgatgacaatgagtcacttggttccggggtacgattacgaggatgacgtctgggttctcgagaatcctgtcatcgcccaccgttgttgtcccgacgccgatctccgtcgtcgtcatcgttatggcggcgtcctcgaccattatcgcctggcatccgttgtttgcgatcatcgcgttcgtggtggttgtggcggttatcacggtcttggttctcgctcgggtgtcctcctcgctcttcgttctctcgatgtcgtgaagagacgcgatgccgggaacgatttttgttgtctcgcgcgcgtcgtgcttctcggcggccattcaaatggtcacggagatcgttggtgccgcgaggtggtggagtggcttgacgatgtgattctgctcaggtagttcgccattggcaccgccaattggcggttgttctagcagtactccagcggcggtctcctcgaacgcgttgctgaggttagccacttattctcgtagtcgttctgtccattgtgcgagatcattgttcagaacgggatcataagaggtttccctcaatattgcgttgatggccctgatgtgctgggccggtgtaatcacttgatcctccgcttctgtgttagcgcgcgcagacgtgctggtcccatcgatagcaaacacatcgcgtggtgtactcgtcgacgatgtgccctggtcttcaagcaagtgtagaactgacaactcgtggggatcgatgtcgattaccccaacaaatcgatctgagataactgtcgctcctcgttccttgttcgcatctttaagagagatttgtgactgctggaccttaggaggtgacgtcctcatggcgctgagaagaaccttgcagcttgagaggtcgtgattctttgtcttgtgaatagggcaatagacatcacgggttggagaagtacgttgaattccacgctctttgcaggcacggatctcagcttgtacatcgagaaaaacccagcaagtttgcaaggtgtgtttcctggttttgtagataggacaccaggaccttgttgcctcggaagttctccttgtcggctcgtgattctcatcggaaggacaagatttggctgcattaggatccttatcgggctcaaacgtcgtcgatgttccgctctccacgtccgcgggaggatccttcgacatagagccgtccggggtcgtaaccacgacgttctcgcttccggtcattgatggaccagccgagatcggcaccgtggtgaaaactgggaagacgatttcaccgacttgagtccacaccagcattgttgaaggttaaactccttggttgatgctggtgttgacgttattgttgatgaggcttgatggcatagtagtagaaccttgagcaccaagtccccgtacctagcgcgcaactgtcgacggtggatacccgcagaccggatatagagggtattggggtacgctggtatgaggatctacgtagtacgacatcaaacaagcagaagacaaagattatactagatcacccggcgacttggctcctgtaatagccctaatccagttgatatgggattatataatggaaaccacagattacaaagggaatagcggaactcgatgataccgacgagaccgtagtcgagttggttcgactagatcacccggcgacttggctcctgtaggctccgacttcgtaggctgaggtggatgtgttggcggtgagattcgatgccttaggacctcctggggggtcccttttatatcacgggtcagttgatctccaagtaggactcggagatatcggacccttcatgatacagtgacgacccagtcttgtccgagtaggacttctctcatatgtggatactgctcctattacgtgatggatttccttaacgtgtacaggaaacatccgtatgcgcgcaggtataccttatcggtatacaacatatatccaagggtagagggtataccttatccgtaaccctgacaatgaacttcattttttatttgattatttgaatctacgtcgaacctatagccgattgatcaaaactctatcgacattggctggcctcgctgcatcacatcggcctattgtccgattggctcattgatcttgtacagtcaatttattcatcttgttagttgcaggatcaaactaactggcacgccctgaacctgattaatagggcctgcactagagataagtggatctcccaggccttcgtgtgtcgtgatgaatttcatgttaacacctctatgtggcgctgaacgttgtacgtgaggtggaacagtgaggcgtcccctcaagcggaacaatacagtcgtcccctaacaaatcataaataaatgtgaggtagaacattacagtcatcccctcataaacaacttacacagaaaaggctgatcaatgcactctgtaacaacccactttagttctttgttgcataaaaacttttttcatgtgcattgcaccgcatgccttatttcgtgcatgaaaaatcatagctgagcagattaatgtttgtaccatcgctctaaacggttcccactgccctaaccaaccttcagttttgaaacttctccaaaagttatggttaaattcctaaaacttccataccttactaccaaccttgactccaagttacattcagattgaagcaagtctgcccatctaaccatttagtcaaacgctcagccgaaattggagtcctttctctcttcttctcgttttctcttgtttcgttgacctgttggtccccacctccaattcgggcgccacagcacagccaaacacgagctgtttcctcctgcgcagggttgcgcaagccaggctagccctcgtgcgtgactgtgcgtctcggctgggccacgtcccaccagaccgccctggagaccacacgccacgctgcttcagtcgcattgcactcgccctaggcgatattggctgatctgtccttctccaccataatttattgctgccaacagcacctcctcatttactcgagtgtgcacgagagagaggcctcctgcctcaggacctcgcgagattccctctacgagcctctgcaacaccctgccctgtcccatttgtttgccgcatgcttgcccgcacacataccatctcgagaccgagggtgtagagcaagcaccggccccatctctccccttccttccctggcttccgccttaaccgagaccttgt

SEQ ID NO: 58544 - DNA, 7791 bp, Oryza sativa
tgcaaaagtacacggtggacggacgccactgtgtgacatgattgttgtaacatcacaagacaaattgcaataggaaagacaaaaagaatggatagtgcatgggctcaaagcctgagactggtgcctatgcatgaagggatgcataaatgctcggttgagatgacaattaagctagctggcggctgtcttcctatctcggaatctatccccattccctgctatttattctagagttctgtgaattttgagtaaaatctaacaggttggttccacttttccaatcccgcacatcaattgtaaaaacatccaattaaggtcactaccaccgtcttctctgatttcctgcaagtcatccagttattttattctacaccatatagagaacctggactaaaggaagatgactacatacccgccgtctgattctagaatctatgtaggcataaagtttttcaaaaataaccagcatagtcaattccagttcaaaaaatagatatcgataatttggaccacagaataaaataagcacacattaaccatcaaacttttgggttacgagaatcgacaatgtattagctagttcaaaatatgtctactagaaaatattttcttggagaatgattaacgagttcaccatttaatggaaaatgttttgtaaagacacaacatacttcctttgatgatttctttagtttgagctagttataatttttggcaccctccctcttggccactttggtctcatagtttgatttgttttatgcaatgcagcttgttcactttctagcctttcctcgttttgggggcctccctctagggcgcttgacagtggttgaggccattacttctttgccttttagagtagtcttcacatgattgaccttgttttgtcctggctcatgcagtttatctgaacaatcagagtcgctatcttcacctatgaaaagaaataaaagtatattaggaatcgcaaaagatgctagaggcagcagttttctgaaaacataagaaatttattaaagatggtcaagggaataaatcctcggtacatcgcatgaagcaaagcatcatatatagcataccatccttttgacatggaagggttaatgaatttcgcagaacaaccttgcaactgaaaacatatagcagcagaaaggatgagatcgacagggggcagtggcattgctgcgatgactacatccacattcatatgcctctactgtaagccagcagactgcatgcttgataatctggcatcgcatccgtcggcctccattggagcagcacaatttgatttatttttccttaagtcatagattttgagtaggtttcaccagataaaacaacggattactgtagagtttcctgataaatctgaatagcactaactgcgaacctaacgacaaaagctgcaagggcagtctgcactcaacccgaatggaggacctagcatggatattgttgcaatcaacagaagcaagagacttctctgaagtccagccaaccttaactttcaaagccttaggttggtggttagtaaacttctgccttactagaccaactacatgtattgctagcctgaacatagcagtgtatgacctaggagtgcttcacagctgcttcacacatgctgcacctatggccggcaaccagccagcaaagcaaagagaagagccagctttccttgaatggtcacatcagacaaccgacgcaatgaggaacaacatttgcttctccaaactcgctgtcctcgtgaatgatggtcactaccgccgagcaagccactaaacaagggggttggccagcaatcaaaacacaaccttgctgaaactgccgcattggacaagtcctgccacggggattgaaggggagaagaaggtagactggagactgaagaagaaaactgagccaagactacaaatccaggcctctagcagcatgggctagcatatctagcctctaccagcaactgctacagttagtgtggcctccagcaccgtgtagccaaatccaccacaaatgccgtcactagcactgccaccaaagccacaactgcccagacgaccaccagcaatcgccacctccagcaccaccaccacccctccacaccatggagatgacaccagcagatccaaaataggactaggcgcccgacacagtacaacactaaacctgaagctaaagtacacaacattactagatagaggaggacacccaaaccccttctagccatcattagcaatgatatgccagaataaaggggggaagaggggtcgagagggagggtttactgtagtgctaccttatagcctatcgagctctccagatgtttgagtctcgttttcttttacaaaatataatatcaattattgccaaagatgctgatagtaaaactctaaataaacccatgcctcaaaaaaaagaggtgtcaccgagccaccagtatcagtcataggaaacataacccatgtgaccatgtctacagacaactagtcattgtctcctttttcttccggtcatagcttctaataactgtcactttgcacaacgattaaggtcgtaaaatatatatcgtatttttattttgcgcaatgtttaaggaagtcaaaagattgagaaactaatgttacatgacaatttttaaattatttcagtacgatgatatagacaaccataacacccccaagactctcctttttgcaaatatttggaatgctagatctaattgtaaataaattggacctagttttaatagtactactttataataaaaaaatgaaaatattagccaaaatgtagagtttagttgcgtggaagttaggatgtgaaaattaattaaactaatggtgtatgattggggtcatacggatttgcttcttaggtgcactatttaatcagttatcagagcttatagcaaaattgtcacctaaaatgatattggccttctagctaggatcaatatgtcttattttttgggctatattaattattatcattttttataacatagaatttgaagcatattattgtagtaaaattatactggatagcacaacctgaagagagcattataagaagcaaatatgtctaaaaattgatttaacacaagaaacctgatgaacttttgttcctcaggaacaaatttaccgctagatgaaccttgctcatcactaagaatctcttctttcagtgaaagcttttggagtttcgacaatcttgtgcgcagctggtttgtcccacctaactctagtcttttccataagctttcatgctgccatgtgaaacatattgtaaagcatattgtaatagcacgtggatgcagcatattgtagaaggattttattgggagtattggtagtaacatcattatagagagcaactatagttaggtttgtgtcctagatatacctttttaaagtagatgggttagaactaatacatttttcagaatatctacagatatgaacatgattgttcgatataactacactcaattgtgtgatttgttttatcgaaagtaaaacaagcatgaagtgccagaaattttgaggaacaattaccaaatgtgtgaacttttcaaaagagtacatctcatggacacttgtcttttgaacaaaggcacgtattgttactttccctgtttccacgtagagagcggctgacctcttggtatggaatacataatttttaatgggatcggtgtagtgctgcaaaagacaatgtgaaaaacccatgtacattcaaagtgaataataatgattaactgcaatcacatacgcggtctcttctaattctgccggtatttgtttttctaaagaccacttctttcacccatccttgtggcagcccttcagggttaaattccagaattgcaagaatctacaaatcaatcaactataatttcatttaggaaactatccaaacattagtactgcaaagtgagaaatcatctagtcgacactccttctatcctaatatatagcaacctagtacttaattagacatattctagtaatataaatctggacagactctatgactagatttatagtaatacaatatatctaatctggtactttgttgatacattttaagacggagggaataattattactattcaaataagagaaatagttccaacaagaaacatatacttgtgttgcattgtccatctgtatcaaattcagaaatcttcatttctttaatgtagagtagtacatcatcttttgagaacagtcgaactctatctggtgggtacacatagaactgtgaaatagcaaaatgaatgatcaaattcactcacatggaggagcagcctcaagctctcttccaacaatgtttggaaatgagcagccaacatggcaacaatggtgagcaaatccttcatatgcaaatgttttgcggtatattttcgctgaacattcccaatggtaatgattcataagattagagtaatcagttgattgtgacacactcatattatgtcacggttcgccgctataagtgacttaatgaataaattgttaaccaatagttaaagatggctgcagtgactataaaattaatcttttgctttgttacaatatgttggaataaacaaattaataacatgtaagcggtaggtgctagttcaaatgtcattggcaaaatttgctacatgacactcaatatttatgacctttgctgtgagacagccaaagaacgtgaattttctcgtagatactgcaaaaatgtggtaattaactgctggacactggcgggattattttattatatccgaaggaattggagagagaaacagctgtgtaagtacggttctacccttcgaatatttttttctttattcttccttattcttttctctctcttgttcttttttctcttcctctctctgctatttgttcaatgcgaggcagacggagtgtggcgcctccgatggggcgtcactacgcattcgtcgcccacgtcatcctcctcctctccattgcccacgctgctccgaggccaccactgccgcgcatcgttgccgtgggggcggtgctgtgcacgccagcgcggccgttcgcgtcgtcggtggggaacatcggaggaggcacgtggggctcgacgtacgcgacagcgagggcggtgaaggccgggcatggggcgctcgagtgcgcggtctgcctcgccgagtttgtggacgacggcgagaagctctgcctcctccccgggtgctgccatgtgttccacaccgcctgcatcgacgtgtggctcgccgcgcatgtcacctgccccgtctgtcgtgctgacctcgcggaccgggccgttgctgcagccggccatgtccttgccgctgaccaagctgctccgcaggtcggtgagcatggtcaccacgcccgcgaccgcatcaagcgggcggtgggcttcggcggcatcgcggacaatgtcggtggcgcgtccgagccggtgatggtcgccgctgctccgtgtattgtccaggccacgttggagtgacatggacggtggtggcggccggagatggcgccgctgcaaacccacaccaccggcacgagccacagtgacagcggcaggagaaggagaacaacatgccaacgccgaggcaggcagagcaggagacgctagagcggtgcgcacgcacaccccgtgcgtcgactccatcttcgctgtgggagctcaccgacgatgccttcagcggcaacgaaagaaagaggaagaagaggatgggagaaagaacaagagagtatgggagtgggcccatgggcaaacttgtctttaaccaatatttctctctccgttttcatggaaaataataaaataattccgcgagtgtccaatagctaattaccatatttttacagtatccacgagaagattcacgttctttggatgtctcacagcaaatgccacaaattttgagtgtcctgtagtaaattttgccaatgtcattttagcattgagcttatcagtgcggaggcggttcgtgaactaggcccttctggcgtactgcatagggcggtttaccttatacaccacttgtgcagtacaagggggccatttgcaaaaacaattttatgtcccagtgtttatgatttcctagtaccgttgcattcaacagtcgaagctttcataataaattagcatagagttaatatggaatacaatcaaaagctaccttgtacatcttgtccatgttgtctccaccagctctaatctcaaccagctagccctttggaagccattcatgtgtcctctacataaatcatggtagaactcacatgtactatttctaaacacaactaaaatcttaaataatatggtcatatatatatatatatatatatatatatatatatatatatatatataactcaccgtaaggttgttgcctacaacacagttctttgattccaagaagcgctgatccatctctgagaaaagataatacaacacctctggcttcattgtgaaagtgattccggaaaagggacatatgtaatactgtaaaaacacatagaaaattaacattgcaacaaaaatcttttagaacaaacaataaaatttaagttcaacaaaagaaatagatggccatctacatatttttatacccggcagatggtgccatcatcaccacgatagacctccattatccatccatctggaagccaacctggtcgctcatccacattctcatcatcactttgcaaattctttcttggtttctcaaagaatttgacttcatcacaatcatcttcatgtaagacaccaacagatggtgacttgcccataattaagccaagatcgaagaactctctcccctctcccgccctccctccctcgctgcctccttgccctctatctctgtatccctcctccactccccctttctctctcaccctccttcgcttcctccctctctttatctatctctttgaacttcgcacttgcttagatatatgtagcaaaggatgttcagctggtattttaataactgcggtttttagtaattaaatagtgtgtgtttatgcctttgagggacagcccatattgcgtattggacagctaatgtttaatgcaatgcatttaatgtggtgagttatatatgtttggttaagatatgttctagatagaataatatctgatgccaactgtcatatattttccaaattaatttatactactactaggcctgacctggtagtaatttaaataaaaaattaatttatacaatttatcataacattgtaaccatgcatcgtactatgaacaatcaaattaattaaatccaatgtcacctccaaaatttaacaaatctaagagtaatattattgatactgggatgcccaaccttctcgatgtaggatccggatacaccatgaaatcccataaactcgatgacaaacacagtgcccgtgcagcaccatgaattcgtgaaaccacacgcgatccactcaaccacacaaaagagtagatctattgccccctcaattccttgcaaacaaataaaagaatgcaagaaattcccaaactatggcataaacaaggaaatgcaagaacaatctacgacagaaattcccaatccctctctctcatttggcaatggctgtacaaaatctaggagaagaacaagagcaatttccgttgtgtaatttcaatataataaatgtggtctaccctcttgtgaacaatacatgtattagatagtcaaacagcctacatatctgactagaaatacaaggtgggctagatccatacgtaaccctgcaaattaaaaagattaatttggatga

SEQ ID NO: 58545 - DNA, 3780 bp, Oryza sativa
  unsure (1)..(3780): unsure at all n locations
cgaaggataacctggctaaaaaaattgggggtagacaaaaactattgtttctttcagctatgcacaacaaagaatccaacatcttttctttagctgtcttgttacgcgttctatttagagatatgtgttgtttgcttttattgtcccccacctcgtaatgccataaatatttttggtaattggtttagaaaagtacctaggccatgaaaaatatgattttaaaatgagctagagctttatgttagtcaatttgacggtgccgcaatgatagttttcaattgtaaacaattgtctaaccctatgcaagttatctttatgtcttcctagtatctctccttttggtttacgatgctaccatagaaagagcaaagtactatgtacaatggtgctatacttttgaaattggtaaccaaggttctcttaatgcagtatgggtggcatagtttcattaacattgttggctgaattatgtggtttaacactagttaataataacatggagttgggggggggtctgtaccatcacattatgttttttctatgtgttgaacatgtgaaatcaaagtgtgttttgattattattttgtgataaacaattggcttatgcgatgattggtttgatatttggagataattggtgaagtgttggttttgtctttggaccggccgatctgaccgggatgcgtgtaatggtcaaacttggtggttgtggtgaatagtgtttctgatgatgaacaagttttgacttgatggagccggtcagaccgagtcgtatgcacctattagaccgaagtagtggtgacggtcagattggccaacctaatggtctgaccagcttgctcctgtttggagttggtttctggttgtttatttggatacttgtgattacttcatgtgttatggattaccaagccaacacaaatgctacagaaacaaatcatcaaatgatgaggttaggcataattcagaaatgattacactgacccaagagtttgctaaggaggaccaaggactagttacaccattccaatgaccaattacacgtaccagagccaagaaatgacaactagaggtgaacttgctcctaggtgaacaatatctcgatattgacgagcattacatactacctaagtcttgcactttacttttgcttaggttgacacacaaatgatcaagataaagatgaattacggattacaccatgctaattttggagtccactgttgtattgatcagccaaggccgttgacacataatctgattgttgcacatctatgcatggctaaggctatgcttaacgccgaatgtcagagatatgggcccaggggtatgcaaagtaaggggaagttcccttcacttcctcatacgtggctgtacagcctggcccagcccccgctcctcgcaccgcgcaaagcgcggacacgttcggggggcctcggggtgccgtgtaaggcccctcggggtgctatgtcagcccctcggggtgccacgtcaggcccctcgggccctcgccctgcctggacccgaggcccttgcccagctgccatgtagcgagaggaaaccaagctgggcggtcattaatgggcggcgctccaaccgtccctcgaagcatttagtgcgatcggggcagacgtgtggagccccaccactggcccacgtcaaatcgggcgtaaccggtctgtgaccggcctgtcaccggtcacatccgattgacacgcggccatgccccacgtctcctttgtccccggtgaagtgaaggtaggtatgtattgtcacatcaggggcatcatctggactcctctccatgagaggagggtagccaccggtcttcgctcatttaagagcgaatgacagggctgccccccgtgtcaggtgaaggacggcgctgggcctcactaaagggccaaccgcggcttaacttccgggcgaagcattcgctcatttaagagcgaatgatagggctgtcccccgtgtcaggcgggggacggcgctggccccaccaaagggccaaccgtggcttaacctccgggcaaaggcacgggccgcggattggccacgagagggtgcccccctccatttttcatggaagagtaggtagaggccgtgcatgtggtatccccttcaactataaaaggaggaccttgcccagtgagaaaggaggagacaacactaacaagaaaaaagctctctgaagtttgagggactcttgtaatactgatcgatattcccacacacaggagtagggtattacgcttgatagcggcccgaacctgtataatccttgtgctcgtgtaagattcaggagcttgaaccgcggataatcgacgacctcggatctcacccgttgcccccggccgaactcacgaaaggggaatcccacgatctcccgatagagaggatcactcctcgataaaccttatcaagtttttgcagtgccaaattttggtaaggttaccnaaaattttggcaagatttcatatgtacttactaaaatttggcaacaaactaaatgtagttatttttttggtaactttgccaaaaaaaaggtaaggttgaaaatagtaacaaagtgaaaaagcccaacacctgctaggtctcgacctattgccgctgcaggtgtccatcgctcctcctgacctagcgccgccggccgccaccatgacgacctcccccttcgcagcgctgcaccggctcctcggctgccgcctcgatctgcagtgcgcgatacctcctcatcaccaagaacggaaggtatccatctattcatcccacacctaaattcccctcgttttgagtcacaccctaaatttctagcataactggaagataatttttgtgctagtacaactttgtttctaacaaaagaaaagattcgcctatgtactggatgcttcgtctatgtgcttgatgttgcttgcatgtagcgatgctagtaggttagaattatcacagtccatgccttttggattcagtttcaaagagtaaatgctgattactttcaggattttccttttggatttagtttaacatttacatttctcatgtgttttctttccttgcttatatgatagtgtcgtagttggctcaattacctttgtcgatagagatcagattatggtgtaaaaggaatgaagttctgatagttgttctcaattgatctgaacaggaaatacctgcattttttagttacagttgtttggttcttctttcctttggttccaagagtgtacaggtttgaaaatgtggcctaggaagaccttccatctccttcaatttcttgtttttgtcattcagggagaaacctgaaaagctgaaacatagtgtatggattcaatctttgttttcgtgttgagttctactgcttcttgctgacacaaatggtacatcatgactatatgatgttaaagtgcagaatataatccattttattagtgcagatgccagaagctgctgagtggaatgatgagaacactagattttatatatctgtgaaccctcgccgtggcacgacactccttgacatttcccttgtaggtgcagcagcgccgcccagtgccccactgggtacaatggtcacatgcttgttaactcgtccctctggtggttcacaagtagtttctcttttcttttcaaaaatctatatagatatgctatagattttactgacagtgaccagctcagcaagcacgcaaaggggagttagcaaagcttttgtaggatctagaagaaatggatggggttcaatcctgataattgagatggtggcaaagcattccacat

SEQ ID NO: 58546 - DNA, 1720 bp, Oryza sativa
gttttgtgattgtatcaaactttttactacctcaagtaaaatagtcaaggtagtcaaactaaattaattagaaacctaattggcaaaatgaagcaacttctaaatgtgcctaagttgaacagaaggatataggttttataatttattcaaatgctacagtatttatcaggagttaatataatttttcaagaattgttacccttagttttgacctcctaaaaattcaatttagttctcagcataccccttttcatctttttgtcagaattaaaatgtttcaaatttttgagtgaaactttgagaaatggaatctaggtagcataggttataaccacaaaaatcaccaaattgttaacatcattctaacttggttaatttgaacttcaaagaaagagaaacagaaaaatctctgaaaatcctgtaaactgaataaaacatgtgtttacctgtgttcctagccattctcgtcacccttacgtagcctaccacgacctggacccacatggcagtgcctttggcttgctcacacttgtgttccaccattttatcgcgtgggacccaccttgaatatagagagaaataccgacacgttggaacatcgtgacagcttatccttcttcgcccccttgctctcgggtaagtctatcgcgcgaacgtgcgccagacgcgaacggattggtaggtctagtatacgagccaggaatctcgcgaattttgcgataccttttcatcttttattcctcatagctaattacatgcctaattacgtgcttaaatcatgattagtttaatggccaatgtcctggtagtttgtttcttcggttaaaataagtccacacatgctttatgttttcttgttacgacttacgaggtttgtttggattggactgtagctattttatttttaaaaaatatcctgtgatgatcaacatttatatttctattaaaattaatacactaaacttttaattccagagatataaattctatataaagtttatataaataaagtctacacatagaaagtttatatacataaaatctacatatacaatctttacatatataaaatctacacatagaaactttacatgtataaaggaaataattcatataaaaaagtttccgtcaaaagaaacaatgaaaaaggactaatgaaaaaaagaaatctgaaaaattacggcgtggaaaaatatcgcctatatttgttgcgttgtccaatgctaattactatataataatatctgacaggtactaattacacgttaattaggtggcgggatgcatgctaattctgtaattcagttgggttgccaccggctgagatccgttggaggtgttcgtgacggacgaatgctcgcgaactagactcgtcccttgctctctagctttcccagccatccctcctcactctgtagtccaccctagatccaagaaaccagagtgggagagctccttcttgctctcctcgccatcatcttcttgccggccgccgggatgatgccatcacgccgcccaacgggtcatcgtcgtcgccatctttctttcgtttccgattcacccttgcacgccatagcctctgatctgatcttgccccgtttcttgcagccgatctctgggaacgccgacctcgccacgggagctctggagcgcggccacaccgtcgtcaacgcgcagccgcgggttcgcgcagctggttccgtcgcctcgaggcgaatcc

SEQ ID NO: 58547 - DNA, 1461 bp, Oryza sativa
cagagtataatctattcgaatagtcgcgtcctcggttatagacaatgcttgatgtgttagttatgttagcatcaaatgtggattattatggatgggattatgtttgatggtggtgttggcatgttgtgccatgttgttatggactttggtagtccatggttgatgatgagagcgccgtttgggctcatttgcttatatatttcagaattatatacttgctgtccataaattaaaatgatgctagatttacttgtccttgcttattttactcattaattgctcaataaaatttgcttgatgcaaatgttgaacctagagacccactataggctagaaagcttgcatacttctctctcccttttgtatatataattttgggtaagacttgcgagtacaatcttgtacttaatccggtgtctgcaatttcaggagaggattccggttatgagttatgcttcttgtgtggtcattggtctgccgaggacggcgagggcaatgagtgatctcttgcagcttggctcttgcccggttggtttgccctagtggggttgtggcaccaccggttttatcttttgcttatgaactctatttgagacttccgctgctatatttaggtgttgtatgttgggacctcggaccctattatgtgtcatgtacctcgctgcactttaaccctattatggtacttgctatgtttattaattgcttgcgatgaaagtgtgaggctagtcacattcctggggactagctaagcatgagtaacgggttttgatcgcttgagataatcggggatagcgctttggatcgagtcactggggtatacttttggtcgccaccttcgagtggttgacgggcatatgacggagtgtactggcaagctgtcttacggttatctcttgcgctcactactcgacattccggttattataatagaaggttgtcaaccgcgatcatggacacattgaggacgagtggctatttatgcgtgtatagatcccattccttcaatagtatgtggtggtcgtgttggacactggatgatataatactcggggtgtccacaaaaaatgccgtcgttaataaaatagtgaccaaaaaaagttgcgtggtcgttagtactattacgacggagcttttaacgaccactgacgaccacacttttgtggttgttaatgatctttaacgaccacatttaagcttttaacgaccacatttcgggtcgttaataatcaattctccagtagtgtcatggtagaagcagaggtcgtgttcaaagaaacaatcactcagttgaattttcagttgaatttgataaaagggaggactggtacacgcaccctagtgaaaccggcctgtccaaagacaaaatcactagcagccaattatcaccaaacataaaaaccaatcatcacaaaataataatccaaacacactttgattacacatattcaacaaattaaa

SEQ ID NO: 58548 - DNA, 1055 bp, Oryza sativa
agaggagggtgagagagagagagagagagagagagagagagagagagagagagggcgagggagggaggtagaggggagagagttctttgatcttggtttaaccatgggcaagtcaccatctgtcgggatcttagacgacgatgatcgtgatgaagtcaaatcttctgaggaagcaacaaagaatttgcaaagtgacgacgatgatgtggatggccgaccaggttggcttccagatggctggataatggaggtctattgtgatgatgatggcaccatctaccgggtattaaaatatgtagatggcaatctatttctttcgtggaacttaaattttattgtttgttctaaaagatttttgttgcaatgctaattttgtttgcttttgtacagtattacatatgtcccttgtccggaaccactttcacaacgaagtcagaggttttggattatctattctcagagatggatcagtgtttcttggaatcaaagaaccatgctgtaggcagtaaccttacggtgagttatatatatgaccatatcattcaagattttagttggtgtttagaattagtacgtctgagttctaccatgatttatgcagaggacacatgaatggcttccaaagggctggctggttgagattagagctggtggagacaacatggacaagatgtacaaggtagcttttgattgtattctatattaactctatactaattcgtctatgtccactagtagtactctaatgagacaatttatcatgaaagcttcaactgttgaatgcaacggtgctaggaaattaaaaacaaaatgacaaaactatttttgcaaatgtcccccttgtattgctcaagtggtccataagttaaatcatatgtgcaatacgccagtagggtgtagttcacagaccgcctctgtacagacaagctcgatggtaaaatgacattcaaactaggacctacctttttacaaattataaaattgtttattttagtatgttgtaacaaagcaaaagattaatttcatagtcactacaatacagggtgccccattcg

SEQ ID NO: 58549 - DNA, 4918 bp, Oryza sativa
ttcctgcagcccggctcactgctgataacagctagaatgggtttgggtgcccttagcttcaggtttagcgttgtcaggtttcctttgttgggcaacttgtattatttttgatctgctggtgtcatctccatggtgtggaggcgtggaactgctgctggtggtggtctggcagctgtggcttggagggggggggggtctctttggtggcagtgctggtggtggcgcggacggcagccgttactggtaaaaaagctagatctgctagctcgtgctgctataggcctagatttgcggtctttgctcagtcgactactttggtctccccgtcccattctttggtctccactccaccttgttctcccctttctccactcctcaacgtggtgcttgcccggtgcggcttgtttagtaagattgtggtttggttgctggacaacccccttgtctggtggcttgctcagtggcagtggccattgttcacgaggtagcgagtctagagaagtgagtgttgttcctcgttgtgtcggttgtctactgtgaccattcaagcaaagttggctcttgtctttgctttgctggctggtttggcaacaacgatctacggtcatggggtagcatgtgtgaagcagatgtgtagcactcccaggtcacccgttcgtctaactactctgctatattcaggctagcaatccatgttgtcggtgtagtaaggcagacgtttactaaccaccatcctaagctttgttcattaaggttggctggacttcaaagatttctcttacttccgttgattgcagcagtatctgtgttcggtcctccattcaggctgaacgtagtctgcccatgcggcatttgtcgttagcttcgcagttagtgctgctcagatttatcggggaactccgcagtaatctgttgtcgagtctggtgaagcctactcaaaatctaagacttaagagaaaaacctcaagttgtgccgctccagtggaggccgccaaagggaatgccgttgccccttatcgatctcatccttttctgctgctatatgttttcagttgcagtgttgttatcggtagttcattcaccctttcatgtcaaaaggatggttgtgctctatatgatgctttgcttcaggcgatgtaccagggatttattcccttcactctttctttaataaatttcctatgtttccagaaaaaaattatgatatgttgcctctcccacctttggctattcctgatattgttttatttctttccatagccgaagattgcaactctgacaattcagacacagcacatggggcaggacaaaacaaggtcagtcacttggcctcaaccactgtcaagcgtcctagagggaggcccccaaaacaaggaaatgcaagaaagtgaacaagttgcattgcaaaaagcaagtaccactatgagaccaaagtggccaaatgggagggtgccaaaaatcataactagctcaaaccgaagaaatcatcaaaggaactattttgtgtctttacaaaacatttccattaaatggtgaactgattaatcattctccatgaaaaaaattgtggcagacgtattttgatctagctaatactatgatgattctcgtgacccaaaaagtttgatggttaatgtatgcttgttttattctgctgtcaaaattatcaatatctatttttttgtactggaattgacaatgttggttaatttatacttgtggcataaagattatttttgaaaatcagacatcatgatggcttcgtagatcctagaatcagacaacgggtatgtagtcatcttcctttagtctaggacctctgcatggtttagaataaaataattggatggcttgcaagaattcggagaagacggtggtagtgaccttaattggacattttttactattgacgcgtgggattggaaaaatggtaccaacctattaggtttcactcaaaattcacaaatgtcttaaaaaacagctgggaatggggatagattcggagaaaggaagacagccaccagctagattaattgtcatttcacccgtgcatttatgggtgtgattggttgctcgtatccctttagcctggcacatctccctcatctaggctaaacctagcctaaattggagagacacatgcaagtgttggtttcttgtatcaggctagcctgactagcatgaggtcatgtttggttgctgtcacatcctgattttcgtttcaggatttataaattatttaataaattattcttagaatttatattaaatgttcattaatataaagtaaaatgtggtaaataaaatttcataaatataaagtatggctggatttaagtcttattaaattttccatgattaattacactctctggaattttctcagatttttcatagcttaattcctaattttaataatacgaagaacatttcagtaattattaacataataaattaatcattaaaggatctggatatagttttgctaaacacttagagtgtccaagtatttttcaggattcttcttgaaattatttgagcattggaaatatttttaacaattcaaagatcatttcaatgattaatttaaattggaaaagtaattaaaatccccttttccttttcgggttgaaactggaaaaagtcatttttccctcattagcccatccttcctctgtgccctcttctccattctcggagaaagcttatttcttgtcccttcttttcttttagccccgacagaagtctactttgctcccctgttgctacagtgttgtcttcaaccttcagccgtttctctcacgtgcccgctcacagtagcgctgcatcctccaccaaatccggccatgccgttgctcccaatctaaaattgatcgcggaaatagaaccctctcaatctcctctaccttttccccaagaaagaccccatcaaattcgtgcttaatcccatgaatttcggtcccgttcttatcctaacaaatcgggataaaccctaattttcggccaccaaatcccaccacatccgtatcgatctctacctcctccgcctatataaaggatgcactgggtctccccttcgctttcccctcctttccccgagctcccatgcccaagccactcttccccgcgagctccatctctctccgccgctgccgccaaccccagccgcaacgtgctgtcatgtcacgctagtcgctagatactctgacggacacattggcggtgacaacagaagagcaacaggggaaggcgtaaagtgtaaaggcgtgatacgaaagagaaagcgtactttgtaaaaggagtaggtgtgagtgccatgttgtgtgtggggccagtgttagctggcgtgtgaggggataaattctccatgagttgtactgagaagattatgaaaatagaaatggaaaaactaatcccacctactctgtatccttctccttcctctgttcttcctctgctattcccccaactccggcgagctccgtcgccgtgattagggccatgccaagttggtatcagtcgcttttcgatccccggctatctctcgcactctctcgactcttgatcagtaaatccggtgtttcgttcgtggtcttccttcaggttgatttgcggtaaatcaaggctaggttgatcgggtttggagaagacgacgacacggcgccagccaaaccaagtttgcaggttcggcagacgatcgcagcgatgaaatccatggaggagcgcttgttggatgccatgaatgcaatggctgccaaggacgacatcgccacgcacttgatgtagattgacctcaaactcgagcagcagggcgagcggttgggtcgggtaaaaaccaaggtggatctctccttgacctcccttgaccaggtgcagcaagagcaaacttgggtctaacgggctctgaaggcggtcattgtggcaccatcaccaccgccaccgttgccgccggaaacaccacatcaagcgccgttgttgtcgactccttattcgggttccgtggcttcaacctcgtctgaaccacaaccaccaccacctcctccattgggtaccttcacctcattactctccgggtgattgtgagcattgtgacatgggtcatcgtcagtggactcctaaaatggattttccgaagtttgatggaaatggggttaaggtgtggattgataattgtgagacttattttgctttctatcaaatcacggaagcatttctagtttcagcaacatctatgaatctcatgggtgatgccgcaaattggtatcagacatggaagttagaagtgggttggcatgattgggagatgttgaaaactgctatttctagggaatttgatgtgcacctttggtctgtgaaaatggatgagttactgttactcaaacaaactagcacagtgatagaatattgttcaaaattcagtgaacttgtttatcagattcgtctctatgacccgctcttgtgtggttctgttttggtttctcactttatgttgggactgaaggatgacttgaggtctttcgttcaggcagctcagcctactactgttacccaggattgtcttgttgctttggctcaggagggtgctcatattggacaaccaaggaagaggtttaatcaatgccgagataatgctgttggtagaggcaatgagaaacctaagttggctcgtggtgagttgtggaaagcacagcagctgaaggaatatagaagggctcagggtctgtgtttcaaatgtggtgataagtatgtttctggtcaagtctgtgtcaaacaagaggctgagttaaagttgctgtgcaggaagagccagtgatcttgtttgatgatattttggatgctgtcactgctcctgaattggtagaagaggattttaatctctccttgcatgctctagctggtacctgttcttcggctactg

SEQ ID NO: 58550 - DNA, 3891 bp, Oryza sativa
tgcactgtctagttcttcttctgaatatcctgctatacagcagctactgcagcagtatagtaccctgccccctgatagggtgctgaatcattcaattaccttgttacctaattctgtgccagttaattcatgaccttacagatattctcctgctcagaaaggtgagattgagaaacaagttttcgaaatgttgaccgctggactcattactcccagttgtagcccttttgcatctcctgtgtcgctggttaaaaagaaggacaacagctggagattttgtgtggaataccgcaggttgagttctttaacaattaagaacaaattcctttgcccatagcggaggaacttttggatgagctagctagtactaagtttttctccaaacttgatcttaaaagtggatatcaccagattagaaagttggaggctgatgagtataaaactgctttcaaaacccatcatggtcatgtccaattcagggtgatgccatttgggttaactaatgcccctgcaacctttcagtgtctcatgaattctatctttgctcccttcttgagaaaatttgttttagtgttcatggatgacatattgatatgcaacaaatctttggaggagcatggtcaccacttagagctggtgttgtagttgttaccagggatgaaaacagtagcggtaattaccggccgaccgggctacctttttcgaatttgaccaatcggacgttccggaaacggtaaatatcgtaatcgaaaacggaaacggtaaaaaatacggaaacaatatcggaaatagtttggtaatttaccaaccgttttgtgtggttaccgtattataccagtaattaccgtttatatattccggtaaattatcctttttataaacatctggccggctggccccagttatttttctttggcccattttctcagcccaataataaccctaaatccctaaccctagagttggtcggctactcctggctccccaatccccgcgtcgacgcggctaggagagtccaaagtagatgggagatcgatagcaaggagcagcggaaggggttttgaaacagctgaccagggacagcgctgtcgtcatcattgtcatccccggccaccggcattcgtaggctgtcagcgtccccgaatccacccagcagcaacggcaggcgtgcatgggaagaggtggagcagccggagcaggggaagaggcggatctggagcgccggcggtggagactctggatcggcggtggagacgcgctggatcgactggagagtggagatagcgatgggaacgagatagggtcaatggggatcctcttccatcaatgggatgggtggataaatatctcctatcatcttctattttagcccctggactttgtaaatattacgagaacttcttcatttagttgatttcttccatataaaccctaagtttcatatttattttcatactagccctcaatgatccttctacttgatcaaatcaattttcctattttgtaattaataaatttcatatattagacgagtctctgaatcctaattttttatagttttccaagttggacacccaagttcgagttctagattgctagctaaatgtgcgatgttattgtttgatgtttccgacaggaattatcggcttccgatcgataccgacacatttccgattgaataattccattttcgatttagatatttccgatatcgtttccgctaccggcttaccgttatcgattatgtttccgaaaaataatatggttgcggtaatggtttagggtgttccccgattgtttccgactgttttcacccctagttgttacagcagcatcagttatgtgctaagttgtccacgtgttcatttgccacttctcaattggaatacatgggccacattatctttgctgaaggtgtagccacagatcctgagaaaactcaagctatggcttcttggcctattcctactaatgtcactcaactaagatggttttttgtctcactgggtattatagaaagtttgtgcaacactatggcattttggctaaacctctcaccatgttgcttcagaagaacactaagtttgtatggactcctcaagctcaggaagcttttgcagctctaaaaactgctatgtgtactacacctgtccttactctccctgacttttccaaaccttttgttctggaaatcgatgcttgtgctactggcattggagctgtgctatctcaagaagggcatcctgtggcttttacaggaaagcattgggcattgctaatcagaaattatcaatttatgagaaggaatttttggctattataatggttgtggataagtaaagatcttatttactcactagtccttttgttattaaaactgatcataaagccctttatcatttggatgatcagagtttagatactgacagcacgccgaactagtaatgggggcgactcgcagtacagatttgcagaagaaggccatgactaaactgattggtctgcagtacaaatttcagtataagaagggggtggataataagtctgctgatgctttctctagagtggggcatctttttcctatttcagttgttcaacctgcttgggttcaggaggtccctaattcatatgtggtagatctttttgctaaataattattgcaataattggccattacctctcctaattctcaaggttttaccttgtcgcatgggttgataaggaaagctgataaaatctggattggagttaattctgctttgcagaccaaactaattgcagccttccactcttttgcaataggacgtcactgtgggattcaagctacataccagcgagtgaagaaattgtttgtgtggaagggtttaaagaaatccatggaagaatttgtctagcaatgtgcagtgtgtcagcaagctaaacatgagcactgttcttatcctgggttgctgcaaccattaacaattccatatggtgcatggctagatatctcaatggactttgtggagggtttgcccacttctaaggggagcagtgttatcttggtggtggttgacagatacactaaatttgctcattttctgcctcttaaacatcccttttcagctttgtaggtggctgagttatttctgaacaatatggcttctctctatggtatgcccaagtccattgtttcagatcgcgataaggtgtttacaagtaatttctgggcagactttgtttaagaggtttgaagtgccattacatctctctactgcataccatccatagtctgatggccataccgaacgtgttaaacaatgcctgtagatgtctttgaggtgtgcggtctcctcttccccacattagtggtgtgcttggctccctttagcacagttttggtataatacaaattaccactttgccttacaatgctctccttaaaaatcactgttggcactgatccttcgtatggtcttcttcctgccatgtaggggcggatctacagtactaaggccagtgtcacgtgacaccgacgactttcggcaaaatctatagcaaaactacttatctatatgttataacactatgatctaagcataattagcatactatgacattgatagacatgttacgataccaactaatcgattttctggatccgccactgctgccatgtcagttaatgcctttgcatctactgactctgattctcctgtagctgatgctttgctcagagaacgtgctatgttttcttctttgctgaagcatcatctcacctgtgctcaaaataggatgaaaaaaacagctgatctgaagcgtactcgtcgctcatttcagattggtgatctggttctcctgaaacttcaaccgtctgcccagaagtctgttgtttctcaaccttttcctaag

SEQ ID NO: 58551 - DNA, 3647 bp, Oryza sativa
  unsure (1)..(3647): unsure at all n locations
ccatagaagagaaatccaagccgtccatgtgaagccagatagcgggaggtgccaggattggttcgcccaaactgncggttcgccgaaccaaaaatccgtcctcctggcctcttctttggtcggtaggttgcttattgggcccccaacatcttgcacaatgttttggcccagttctaagtagttttggctgacatatggtcctccaatccgtgtaaacgcatcctgaatgcgcggaggtccattttgtcgcatgacggatgtgttttctcctcaaaatacctgcatacacatattttaccaacactagtgaagatgattagtaatactacttaccactaagttggataccatgttttatttcattatatgcaggtattgacggttagatattatgatttaaggatcgtcaacaccatgctgaacacgtctccatttctgtagttgtgacaagacccctcgcataactcaactcagagaggcgcaactttcctggatcataatcaccccattttagccaaggtatggactccccagcgacccccatgggtttatctctggcacttcatagtttggcacaccacaatgagccttgctatacaaagtgtcaagttgttgcccatgctagcttgtggttggcacggttaatgtttcacaacagtagctcacgaaccggtccttaattgccatgagcacaactatccaaacttcaaaccatctactcacaacccaccattaatcaagttttagttggcaactaattatccaatcaagattgaccaccgtgatcgaccattaaatatctatcattaggttatagtgaagctttagttatcccaatagtttgctaatatttctaagcatagctaagaaattatatctaatatctagctgaaccaatatataaggcccagactagtcaaattataacccattggaaaataaagttgtcgatttctaggatcggtatttgttggcagtatgtcatgagacccttcgaccagacctgccgaaaccatgcgaccagtcaggattcaggtttaaggtgttaagttcaacggggcgaagccccacagcgaagacgccgaagccacatggcaaagacaatggagtgaggacggcaagagatggacccccatggcaaagactgtacattctagacgaagggtgcctgccgaaggagggtggcttcgccatcccggtcgctctggccggcccttgggtcggcattcgccaaccaggcccattagaggcccatgaatgcaaatgacactgtgtacctatgtaaatgtccccttcataagggcaaccatgtaaattcccctgtaaaacctaaaccctaaaaggagaacctgtaacagggttataaatggacccttaaggccatgtaatggggggatcccgaagaaaaattctcaatttaatacactaccattttccaaccactgttgagtgaccacgtctttcgatgtatgcatttgtcgcttcgacaatagtaatatattttatagggtacgctagatcaaagaaagtgatggtgacacaaacgtttatcctggttcaggccctcagagtgaggtaataccctacattcagtgtggtggaatatctgtatccggtggaaaaaggagatgatgtatgctcggttgtggagatgatcatacctctgtcctctcgggacccccgccccctcttatataggatgaggggtgttgatggtccttaaatcataatatctgaccatcaatacctgcatataatgaaataaaacatggtatccaaattagtggtaggtattattactaatcatttccactagtgttggtaaaatatgattatgcaggtaatttgagtagaaaacacatccgtcatgtgacaaaatgcacctccgcgtattcaggacgcgtttagacggattagaggcccaataagtcaataaaaacaatttagaattgggcgaaaacatagcctaggttgttgggcacccaataagcaacctcccggccgaaggagaggccgggaggagagtttttgggttcggccgaacccaccagttcggccgaaccaatcccggcacttcccgccatctgctttcacctagacggctcggatttctccactaaggcgattgcagggtgttttggtcatttcccatacacctaaccgtcatttggagcctatataaggaggctaccttcttatttccaagacacacaactttgtgctgaattacaagaggctctattgtattttttgtacattagaataaggtagagagtgaggggaagctctggaggagtgcccggaagtttggcactcatccaacttctacctcgacgagtgtagctttcataggaggaattcgggaggagtaccggagctgtcattacactctacttcgggatcggagaacttcttctataaagtaagcattcgtgtttctttcttaagttatttaattactttgtttaagtaagatagatttccatctttgcgggttcattgtttagttttttatactaagtgctctagtactaggattctggatagagaaggaagttcctgcgcgagtattagagtagtaattaataacttagacgtggtgtctaggttagggattacctttgtttcttgtgtatcccacggatttgttagaggtaggcagcaggtggtgacagccctgaatcccgtcgtagtaatcctccacgttgggataaatcatagagctatagccagaaccacgctggcagaccagcaggggacggtacccgaagcaacagatagagaattaccttgcttagcgtagatagttaaaacacatagaaagtcctctctagcctagcctacctttcatcagttgttgtacttggatagtcttagccttaggtagtctacacacgttccctgagttcgatattcttttggagtcacccgaaggtgaagtgctatagctgtattccgtgcgcttgcggatttatctgtggtcgtaagaaataccaacaagcatttctagcgccgttgctaatttatccgagtcgaggtcattctcgtgtctttattttttatttctcttcttttattcctttccttgatggagcaacccaaaattcaaaacctttctgctcctcgggttgatctttctgagccatcctgttcttcaaaatcaatcctatccgatggctacgaaatcggtcctggctttatagccatgattcgagagcaaaccttctctggtggtattggtgaaaatccatacctccatctttgggactttgagctagtgtgttcatgtttatccatcgtaggcatgacacatgaaactctaaagtggaagttgtttcctttttctcttagagatgaagcgaagcaatggtacactctgtctgtcaagaaatttcacggtgaatgggaggagcttaagtgcaaattctgccttgctttctttccattaacccgtgtaattaatcttcgattagacatcctttctttccgacagaatgagaaggaatctctcgatgcagcctgggccaggttctcgctgttaactcagtctggcccagacttgtctttacccgaccatgtgttgttacaacattttcggtacggttagacaaggagtctactgcaaatctcgatatttccgccggagg

SEQ ID NO: 58552 - DNA, 2864 bp, Oryza sativa
catcaactgtacactttggtgatccttgttattggaacacactctataggagaatccgacatcacacacttggttttggatgtcttgcgacaaaaagtccaagtgtggggggaaggtcgacgagcaaaatgacgagttccatcaaccaaggccatcttggtttgaagttggtgttagtcctagcttgctaaaaaaaaagaaaaaaaagaagataaaaaaagaggagaaagtgagacataagaaaagaagaaaaaaaatgggagaagaaaagagcaagagagctgacgagctacatttggatcaaacaccgcattatgtgcatgtctttgaaatatggctatgcaccttgcttgtagcaatcatgctgcctggctacacctagcccctctctcgagctcatgtgccgccttggtttagcctttgtcaactcctagccgtgcacagcttcttgctcccgcaacacctacacgcatacaagcaagaggagatgccctcttcttttctaggtgtttgctgctccgctccaattggcacttgcatatttgctcggaaatagatgcaccctacatctctgtgccaacggaacgggcctttaaggaataaagttcgtgcaccagaggtgtgtgcataaccaacccactcgcctgagttggcatggttaaagtgccttcctctgctacaatccacatcaagacggaggagagatcaccaatcatatgtgaccatgacactgttccagagattccaatatatctatcatgctggcaggtaagtacactcaggtatgtggaagataaaacaaggttcaccaaacctttactcatacttatctctatgtgaatatggcttgatcatataggttatgcttcttatatccattttttttgtatgacatggtttgggtgtattatcgatgtacatccataggctttttaaattaagcatggtacttaggttaaaataagtctgtttaatcaagttagacatggtgtcaaatttgattaatgaaccatttgagctagtacttccatggatattagatgtatatcttgtatggactaacccctacaggggaaagttttcaaattgacgggtgagtcctcgtgtttaattcacactggagataagtcagggtccgacaaacaaatcaataaattgcaaacatgcaaaggagtaaaacatcgcatgtcaaggtgcacggtgcatatattactaatcgctccttcagcatgttcatgcaaatttacctcagctctgtatgagttgtgctaaaacgaaaatttggtgaataataaaaatttgaaaaaaaatgtttcagaataaaatgttggcaaccttatgggatccacgcttcttaagtttttgcaggaaataaaatgttggcaaccttgtgggatccacgcttcttaagttttgaatgcaatttcattttagcgtggatttgaacaactaatttcgaggctatgataaaatcttttcaaatctttatagtccctcgggtatttgttatccactaaccttttgcctgaaataaaaaggcaatcaaggagcagtgtacaataacttcaaacacttatatcatgctccttatccacgagaaaagatatgcacattgaaccaagtagaacaaatgcaaaacttgttgcattcttgcattcggctcaaatcttggtaagacctatctggtaagaatctcatacaccatgtgcatcctcatctcatgtgtccatcctgccaggatacccaccatatccattgttgccataaagagataaaataaaaaaagagaataaaaaaataaaataaagttggctccttggtcttccaaccaagtgagtcatttttgcttcactcgtgtctttgtttttctttttgtgtccaataaagagccaatgtacaaagacaagtgtgggggtgatcttgcacatcaacgccataaccaaagcaagattaccccagaagtgatgagccatgacgagccaaacaagggaaattgatgcagtcagacccaatgaatcatcctctgttttatacagagccaagtttgcacaatttttcctttggacatccattctatcttgagtttaatttgattatcaattctaaaatatcgaagataattaaactcaagctagggatggtgcaattagagttcatggtctccttaaaaatggcatgcatgcctattattctttgctcatcacttgttgcttgtggtgatatatccaatagggaccccatgctatctgggtaattgatgaatgagatatagtctgatgatagaaatcctactcttcatgttgcacacatgggaattttataaaaagaaaaaaatataacgatgctaaactcctcattgatattttgaattccgactagagccataggttgatcattcataattagcttgctacatatgctgctcgtcatttcattgagcgttgtcaagttttgtaaccctagtgaaatgcttttcatactttcatggtcaagatcacatacactccgcatacacccaccaatgcttaacttctacactggaaattagcatttctcatttaccattcacttcatgcatagtccatcaaataaatattccatgtcatttatgcctcttcctccaatgttctttcaaaaaaaaagtgagagaggcatggctatgcaaaaagaaagaaaaaaagtgctcatacgagtatggagcatgatgatgagaaaaaaaaggagaaaataaaaagatagccatgcactctccaaaatatcaaaagaaacaaaaattataaatggaggaggagatatacaaaaggagttattcttattttcctttttccacccacaaattcaccatacacatacacatgcacatt

SEQ ID NO: 58553 - DNA, 2763 bp, Oryza sativa
tcgtgttcctttcttatgttatttaattaatttgtttaagtaagatagatttccatctttgcggtttcattgtttagtattcgtacaatgtgctctagtactaggactctggataaagtaggaagttcccgtacaagtattagagtagtaattaataacttatacgtggtgtctaggttagagattacctttgtttgttgtgtatcccacggatttatcagaggtaggcggcaggtggtgacagccctgaattccgtcccagtaatccttcacgttcgaatacatcatagagctatagacggaagcacgctgtcagaccagtaggggtcggtgcccgaatcaccagatagggaattaccttgcttagctgtcacgcccgaaaattcactagtaatttccgaacttatttgtgcatcaaatcctcgtccaggaatcagccgaggtacacaaactgacaatttaatgtacagattcatcaaattaactaaaacgataaatacttacttaagaggcactaagtcctcaccatgaagaaaactgcagcggaaaataaaatctagcgaagctccggctccactcccacaggcagctcaactggggtataaaccagacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagcaaagagttaagagtagtaaaacagtagagtaattaatcaaaaattttaatcaacactggacagcacacctatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaataattttactctggccagaggtgtaccactgtacccacaagacacagccccacaacatgtcaccatgtgcctcaatacaaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctagcttgtggttggcacggttaatgtttcacaacagtagctcgcgaaccggtccttaattgtcatgagcataactctcaaaaccatgtgctcacaacccaccattatgaagttttagttggcaagtaattaatttaccaatcacgattgaccatcgtgaactatcattaaaccatcattaaataatagtgaatcataagttatcccaataatgtgctaatgtttctaagcatggctaagcaatcatatctaatatctagctgaaccaatatatatagctcaactagtcaagttataataacccaaggtatcaaggaataaagtaatcaatgcaaacaggccataacaaaagaatagatttacaccacccagtgacatttgaaaataaatgcacagttgaaataaatagagaatttaaatataggatcaacatgctcaaaggattgtgtttaggatctgtgtgacttgccttgtaataatcggtcttcaattaatcttcttgaatacttccggcgcactcacgaaccttcgcaacaacggaaacgacaagctaacacgcaaaacgaagaaaaagactaacaaaaacaaaataaacaatacataaaaagtaaacaaacatgtagatcataattttagatgaattatgagacttgaacggcctcattctgacttcaaatgaatttattatgaattttactagattaaatctaattaaagcccatttaaaaataattaaataaatttaattcaatttatggataattttaatatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaaggaggattattccgtcatcaaaggcggtccgggtgcacgggacggtctaaggaaacgaatggccgagatcgattctatccaaaacgggcggccgagatcaacttgatctaccgcggttcacgggacaaggcgacgatgacgtcaacggtgacgtcagcgatgacgtcagcaccggcggcggctcggcaacgcatgctcgccggtgaacgacggcgcgacgacgcaaacggaggacaccaacgggtagagggcgacgcggcgaactcaccggtgaccaaaacaacggcggaagagcaacggacggcgccggcgacgaggaagaagcggcgacggtcttcgggtcgacggtgacggcggtgctccggtggtcttcggctgcggcgaagcggtggacggggacggcgacgacctcgcgatcccaatggtggggatggcgaccaacgacggcggctgcaacggcggcgcggcgcggctgaaccgacggcaacgacagcgacggctagggctacgcggaggcggcggggctgcaggaat

SEQ ID NO: 58554 - DNA, 2025 bp, Oryza sativa
ggatttaaaaacatttttctatttaaattattcatgaaatgcaattccattgattaaaaatacttccttggctcaaataaatctcagaaaaatctaggaactatagaatcaagtaaagtatttaacaaaattttatctagcccaattttatattgagatttaacaaattaaaattagatcttctcttttaagatcatttctaattattccttttaaacaacaatttataatttaaggatttttaaacaagaaaagctcttaacaattataattagatcattattgatcaaataattactgaactattctttgtatcatttaggaattgagctctgaaaaatccgagaaaatttcagagagttgacttaatcatggagaatttaataaaaattaaatccatccatgctttatatttgggaaattttatttcccacatttaacttcacttgtaaattaaagatcatttaatataaattctaataataatttattaaataatttataaatcctgaaacaaaaatcaggatgtgacattagcgtagataattaaaacacataaaaagtcctctctagcctagcctacctatcatcagctattgtccttggatagtcttagccttaggtagtctacacacgttccctgagttcgatatccttttggggtcacccgaaggtgaagtgctatagcggtattccgtgcgcttgcagatttatctgtggtcataagaaataccaacaagggggagggttacaaggaaagtatctactagatctctattcaatctataaaagatatgcatgatcgccgaagtttatatcttatctcggaaatgtctttttctttatttacaagatagacacgtgagcctaggctgctggcccaccctatgccccatggcccaaaggcctctccttgatacctgggtaccatgtaacccacaaaagtcatcttcggccataatatagggaaaaggctcaccacccgatgtcatttgaaaataaatgcatatttgaaataaatagagaattcaaatatcggatcaaaatgatcaaaagaattgtgtttgggatctgtgtgacttgccttgcaataatcggacttcaattaatcttctggaacacttccgacactctcacgaacctccgaaacgatggaaatgacagctaacacgcaaaacgaggaaaaagactaagaaactccaaacaaacagtacatacaaagtaaacaaacatgtagatcatgattttagattaatttagagcgttgaacggcctcattcggactttaattcaatatgaattagttacaaattttacaagatttaattcaattgaacctattaaagaaaagactattcaaattaattaaaaaatttacaaataatttataattgagataaaagattaaaagcaacctccggaaaagattatatcatatttggtagatgacatatagtaaaaaggactaatatgccattgaaaagagagaaaaggatttatattgattttggacggctgcgattaatcttgaccaagagttgacgagatctaacatattagctcgatctgatataggtgggattagtttttccgtttctattttcataatcttcttagtacagctcttggagaatttatcccctcatatgccagctaacactggccccacacatcacatggcactcacacctactccttttacaaagtacgctttctcttccgtatcgcgcctttacactttacgccttcccctgttcctcttctgttgtcgccgccgttgtgtccatcagagtgtctggcgtgacatttgcccccccccccccccttccccctccgagcaggagcttgtccccaagcgattggctcaggaaacctggcacggaccacttcataatcttcccatgtagcccactctggtgccagagagccccaacgaacaagctcttgaaccaccaaggcattacctttttttgaacatacggtgatccaaaattgcagagggaacaattcagtaatgtccagctg

SEQ ID NO: 58555 - DNA, 1115 bp, Oryza sativa
ctcgccgtcgaccgccggcgccggctcctccaccccgtcgcccggttcgacagctccgtcttctgcgtggaggaggcctcctgcgacggcatccttgtcctctggaggaagagggccatcggtgcccattccagtgtccgcttctcgatctgtaacccgaccacgcgtcagtccggtgacatcccgctgccgctgctcaccgggttcatgctcatgggcttgtactggcaccgccccaccggcgagtatcggcttctgctctacaggatagagctacctgcttcggagcggctcgttgatgttctgatccccggcgatagaaacgcctgctacgtctacacattgggctctggcgatttgccgaggtgcattgggtggccagaggcggaggcaaacggcgcatctgtgctgctgcatgggagcctgcattggtataagagaatcgaagatatgattttggcgtttgacattacagccgagtcgttccggtggatgcggtctccattcggcaaggcggtgtggagagcgtttcatggcctgtttgagattaattgtatgctcggcatgtactgctgtgacgatggtgcgacatttgtagatatctgggtgctggaggattatgagagagaggtctggtctctcaagtaccgggttgaattgccagttctagagatcaggagagagcttgatgtgaagcgtgatctttacagtgtgatggtttcttccgaggatggggatgtgcttgtgctggttaactgcaaacgagccatgctctacattggtactgatggcaagctgttggcgagtttgccacatgataatgacggcctcagtattactccagtgaagcttagagcaagccttgttccgcatgcattctttccatctctgctggactatgtcgtgaatgcttcgcctttcgtgtgatgcctgctgaatgaggtggttcctctttttaagacttctttctattgcccttgcctgcttctgaattatatatggtgcaatctctatgtattggatgaggtttaagcttacaaacttcttaattgcagtatgcattatgtatgcaattaaacttcttgcctgaaaactgatggtacatgaatttgtat

SEQ ID NO: 58556 - DNA, 1573 bp, Oryza sativa
acgcccaagtggaggccctgcgtgcggaacgagcggagctcgaggccgcatgggcgcgcgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttatcgccaccaccgcgatgatcgaggcgcaagacaccctccgccttcaacacgcaatctgggaggcggagctgaagaaaaagctcgacgccgcccaaggggtccttgactccgccgctgcccgagagcggcgggtaacggagactgaagcgacgtctcggcggcgcgaggaggcccttgagtcccgtgccatggcgctggaagaacacgccggcaccgtggtgaggggcttgatggaccgcgaggccgccgctgctctccgggaggcgacgctggcggcgcacgaggccgcctgcgccgaggaggagtgcgcgctccgcctccgcgaggacgcactcgctgagcgggagcgggctctcgaggaggctgaggccacgaccaaacggctggcggacagcctgtcccttcgcgaggcggcgcaggaggagcaggcgcgccgcaatcttgaatgcgtccgcgccgagagagccgcactggaacagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcgggcctctggagaggccagacgtcggtgccccccaccaatctggaaggcctcgctccgcacctcaacaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggtttcgagggctcggcccctcggctcgcgttcgcccctagctccgacgaggagggcgatgccagtggtgaggacgacggtggcgacgaggccggcgacccgggcgcgtcggaatgagcccccgagcccccgtcaatctttgattttttctttttctttcttctaaggccttcatgcctcttttgtatagatcaacttaatcttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttctgggg

SEQ ID NO: 58557 - DNA, 1243 bp, Oryza sativa
tccttcctcccacttcctcgttcgctcagccaagtttttgactgcgcgacagtccgcgagatcgtggagggaggtgttgtggacggagcaccacctgccggcggggcgctccctgctgggagtaccagcctctttctttttgtcgcacgcaggcctcccctttcgagtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatacaaggtatagtattgcggacttggcagaaacgctgaatgtacgagcgaagggattcatcatccccccgctgtactgcgtgcaagtccgcttcttcacctgggcgtggataagtgccttgaaagttcatggtgaactgctggcacagatcctcccaggagtggaccgacgcgggtggcaggttcattagccaaccccgtgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaggaggcgccctccgttgcacggggagtacgccggctattacgccggcgctcgatgttgaggcgggcatccggctcctcatgctgatcctcccgagtcgaaggtgtcgacgagggagtggcagccgaatgacgtgcagccgccgccgctcgccgcgccctccgccttgatgacacggaaccggtggtggcggcgccggaagtcttggtggtggcggaccgtccaccagcacccaggcgctgctgggccgtcacgaccaagttggccacgtcgtccagccatcgctgagctggagactcagggtcatggacgacgggtgggtga

SEQ ID NO: 58558 - DNA, 954 bp, Oryza sativa
tttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattaggtttttcgacattatatgggctgtacacgggccaaatgcagaagcacatggacagtgggctcattccacccagcgattatggacggcccacggtccatagcatcgttgagaagtactacagatttacagctccaaagtacagcaactcgttgtccatcaattcctttgcttcaatttggaagatcattctgttgcttcgttcgttcaatcgataatattatttcatgaatgccatcttattcagatacaggtttctactttgtattttgacaagctacacgcatataaatgacatcgttcatctacttgccaagttttacagaatcgaagttgcacacttacacaaaagatgaaacagaacacagattcagaccacatgagaacaccaaccatgcatctctactgatccaacttaatttacttggatttagaagttattagaaccttcatctttgtggataaatcgcttcatgactcggattaactcgttggctggctcgctccatggctgcagcgacaagaacaggtgcttctcctcctcgaaggtgacgagctccaccggcttctccatctccttcagcctcgccgcgtagtgcacggtgcggtcatggaggatgtcgcgcccggccaccacgacgagcaccggcggg

SEQ ID NO: 58559 - DNA, 2420 bp, Oryza sativa
atggttacttcttcagtgtgccaacgcttagtgcctaattaaacacggttgtttcgtttaagtaagcagatgggctaattaattaattagataattaatcggttgacacgaagcttcctaatcctagtcgttgccttgatcgccaaaccatgactttggctgtcaagacttagtagatatttttctcttttttttttgagaaaaagatggaaggagtgttacttttcagaacgggacataataaaaaaaaagttttataagaaccacttggtacttttctgagtattatagaagaacaacttcactgaacaaaaactatgtagccatgcacctcttggctcttgcaacgaaatttacatgaccgtacttattactagtatagactatagagctatgattttatccggaaatttgagatacagtttgaatgttcgtgtgatgagatcagactcttgagtgatccaaagaagttattgagtccagcatcagtgatgctctgtctcagctttcgacttacgttatgcgtaagcgggtgatacagagtgcaattctgacattcttacgcgcatgaagctctttttctacaattttgctgccatttttacaaacaaaaccatttttacggcatatgaagggtgaggtctggagtcaatacttttgtttgtaagaatttctggagaactaacgagtctggcgttcggatgcacatgcgatacgacacaaccatacaatattttgatttcaatacgtttaaatcatgttattttgcgtttcaaaaggattgagaaatttacctcaaaattgcaaaagtgatggacgaagcctattatgagtactgttcgccgtctagtcctttttcgctgctagctttcctttacatttttggatttgtcccatttccgacgaatgtcagatgtactccttttcctactagtatgacatgataaatttttgtgtgttcgaaaaaagatggccgaagcccatatttccccaatcaatgggccgtgcagccgagagcctgagatggcagttattcctattgggccagaaatatggtccaatacccaattgaaaagcacttagcccaggcccaagcgcatgtactagtactcccgaaaggaataagtctgcattgagtcccttaaatatacatcggatctatccctcaacggcaaaatcaaatataatgactccaactgttaaaaccatattaagagaggaggaaacattgacatgtgggccccacatggtgactcgactattttgaccaagttaactagccacgccaatcgaccaatgaaaaccactgtcaaaacagtccagaaagccaaactacaccagtttttaagtagttggggatcaacatatctagtattgcagtcgaggatacaaattaaatcggacctatattgagggagttagagtcgacttattccttcccgaaaggccaatctgcttccgtccacgtgactatccaacggctgagattccgtgcagccggttttgcttgcaccaaaaggcgttttctgtgatttttcacaatacctttacaagttgtaaaaatgttacctataccttttctaagttgcaatcttttcatatccttgtaaaatactccgtatttcatatgagcaaatggataagtcaaaccataggctaaatagtaaatacatgggcgatagatattaattcggtccaccagtttcaccagactggtaccctcaactctccatcagttgctggccaaatggcaaaatatcattggacacttatagttgcatcatgcctaatccagattccagttaataataaaccttactttctgagttgacttagtctctatccccacaacaaaaagagcactaggtaagtagatataatggggtagtataaactagatacaagtcgctgcaatgatgcatgcaaaatatcaacgccatatcatgttgacctagcataaacaaaactcaaatccggcgaagtacgcttgtttgctatcaataatgcgagcaaacaaatgaatcttaatagcatcacactaaggaagaatggataatacatctcatccacgtctgttaaataatttatattcagccaggaggagaaatcacagccaagacctcgtctcattcactgatcatcaatcaggtccctgaccagtaatttttttttagaaaatagattttcattaatccggtctctatatccacgaaggatatacacatccaaatcatgaccagtaattgatctattcaaatattgatcgcggcaaattaaccattctaatcaattctaagcaaatttcgattggtttggacgttcatattgcaagatctctcaggtaaatcagccactggccggcctgaaccaatttcctttcactatgaacataagatgcccatttttccaggaaaaaaaaa

SEQ ID NO: 58560 - DNA, 735 bp, Oryza sativa
aatcttgtgtttttcctattcctccgttttttcaatcctgcgattcaaaaggccataaaaaagagaagaaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgataggttgatgtgatagaaaaggactgaagtttggatccaaaatttggatctaaacacagcctgagtcactggatctggacttggatatcatatcaccgatatgatctcgctgctgcgtgccagcgcggtcgatcgcgtgaggaaaacggcaggaaaagctgcgttccccttgaccggctagacagataaacgttcttcgcctgagcagaagatcgcgtcaactcgttcaccggcgatggagatggaggacgacggagaggagaagtgttcg

SEQ ID NO: 58561 - DNA, 1262 bp, Oryza sativa
tattgcgctggttatcacgcttaccgcggggtacggtgggggaaattggcgattgatttggatggattttgaccaaattcaaacttttggagaaaaaatgaaaaaaaaacatggatgtagttcttgatttataattgccaatgggaagattttttaaaaaatagagtaaactaaattcaaatttgagggtaaaataaaaaatagtttacaaattgaaaaaaggaagacaatattgggccttaagtatcctacatattctttcaattattctcaatttctagttttctacacatattcaaccgtattttttattttttccctatttatttttcatttacatgatttcaactatacagaccgcaataaccgtgcaaatatcgcggttatcacggtaaaccgtgcggtaaccgcggtgaaaccgcgaaactgccgagttttgaattcgaatttttgaatgtgatttctgtacgattttagacaattatcgcggttatcgtgctaccgcgaggtggcggtaacctcggcccaaactctgttgaagatctttatttatcggcagaaataccttcttaagtgacagcttctaagcataaaccactacaatgacgtgcatctaagctttatttaagataaaataatgaatagtatcaactaagcaaccttgtattcctcaatattcctggtacaatcatgaacactacatatgtatcttgcgcaacgcttagctcacagtgctatgttcttcatggccaagcatccaagacctgagatattcatctctgatacagcttctgataacactattcgttctctggttgttgctttgagcacgatgtgccgagcctaaaaacagacaccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttg

SEQ ID NO: 58562 - DNA, 1050 bp, Oryza sativa
tttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggctgttaccaagttcacttccgcttagattccatctattggtagtatttagttctgtctactatctggtagtggtagaaatggatgtcttattagtgtgtagttggcggttgtggcgctgcttttggtaaactgttgcttatttatctgagatattaacgatgctcttctagacttctatgtgcttcctgttttgtgattgctcgatttcttgtttgtggtgttcattctgtttgagattactacgatactgtgaaattttctggaacaaaattgatgttctggtatgcatacgtagcaactgaggacatggcaactcacttcaggaataatgctgctcctggcttgtttggtgttctacacttttactca

SEQ ID NO: 58563 - DNA, 948 bp, Oryza sativa
catgcagccagattgttgagtctgctatctccgaagtgatgtctggaagagcatccttggtaaacttattcagatctaatgaatctctgaacacgtcatccgttggactctttcctgtaaacatctcaagcagtaatattccgagactatagaagtatagatatcaccaagagttgatatccagtacagctgtacaggcccaacatccagccgcgtttcggcctgcagcggcgaccttcacagcttgttttgcaactcgagggaagaggattgggagtttacacgagagaattgatggtgagattaagatgagaattttgatttttaatcaccagatttcaccctcctatacaatgcaatacatctactagatgcaatcgcggaggcctttgcacgtacgtacgtgcacacacccatggcggacaacgacatcatggcggcattgccggaggacgtcctcctccaggtcctctcccgcgtgggcaacgtcaagagcctcttcatgctggccgcaacatgccgccgcttcaccgatcgcgccttcctccgcgacctctggggcggccagcgcgccggcgacctcctcggcttcttcttccaccggcaacgcaactcggcctcgacattcggcttcctgccggcgccgccgcttcgcccccatcccctccagctacgacggcgagcccctgacggcgcgccgcggcatcctcctgatgcggctttccccctccaacgactggtcagaggcgaccagccacctcctcggcctcttcaaccctatcaccagcgagcaccacgttctcccgcatctgaagggcccctccaaccttggttccttcgccgtcaccagctgcgccatcatcttctccgacgacctcgccgggaagcagcagccgccatcttcaggccgcttcatgttctcgcagctgctcgtcaccaccaagcaca

SEQ ID NO: 58564 - DNA, 908 bp, Oryza sativa
tagatcttgtaggtctcgacgctcttcttcgccttcttccgccccgccttcttcccctcgccgctgcccttctcgcccttgccggcggggaggcgcttctccgccttgggcttcttccccgccggggccttctcggccttctccgccgcgggctcctcctccgcgggcttcttcgccgccggcttcttctccgccttgggcgccatggatgccgccctcttcttctcggggagaggagaggaaagggaagcggtgggatttgcgagattgcggcgtggggaaaggaggagacggggggagatgattttgtagaggaggggatgtgcaacctgattggtggaaagcacgcggcgcggatcgatgacgtggagggatgtacgacgttggatgccggggtcgacgggttggtgggatgccgaaaaatgtgagcgggaacgggaggagttaaggcggtttccggcgcgcgtcggtgggcgaatttttagagtttgagctttccttcggcgtacgcctacagcccagtccagcccaatttagttgtcaggcttcttggcgggctgtctttgtttatgggctaattgggcctatttctttgctctgaaagccactccacgacttgttaggctacgtattcggtaatctgcccacgtcaacatcccagtgagacgacaacgacgtcgtcgtcttcaagcaggcagctagcctaaacccatctccatctgcaagtaggcttatgtaacagtgcgttgatcatgcaagccttccgtcgatcgcctagccgcctaaatcgccgtgttctgaaagtcaattctctccgactcaacgaaaatactaacaacatgcacctggccgcgttgaccgttcgaaatgtatatattccctcgttcacgaaatacttttcattgtgg

SEQ ID NO: 58565 - DNA, 1294 bp, Oryza sativa
aaaaaggaattaaaagaatgcaatcaacaaactgtcatcatctccaaatttgcttcaaagaccatctatactctccatataatacggacagccattggtactaagatatagcactaccactctcacaaaccaatcaagaaacacaatacgtcccatgacgatcatgatgagcctgaggcttgaattatccctcgtcctcatcctgacgccgatcgttgcagccgtcgctggtggtggcagcagcagcagcagcgatgaggccacgttgcttgccttcaaggcagcgttcagggggagcagctcaagtgcgctcgcctcctggaacagcagcaccagtttctgcagctgggagggcgtcacgtgcgaccgtcggacgccggcgcgggtggcggcgctgacgctgccctccggcaatctcgccggcgggctccctccggtcatcgggaacctcagcttcttgcagagcctaaacttgagctcaaacgagctgtatggagaaattcccccgagccttggccgcctccggcgtctagagatcctggacattggaggcaactcgttttccggtgagctccctgccaatctgagttcctgcatcagcatgaagaatctgggcctcgcctttaaccagcttggcggccgcatcccggtggagctgggcaacacattgacacaactccagaagctgcagctgcaaaacaacagcttcactgggccaattccggcatcgctagcgaacctgtcattgcttcagtatctgtacatggacaacaacaacctggagggcctgatcccgctggacctcggcaaagctgcagctctacgtgaatttagttttcagcagaacagtctctccggcatatttccgtcctctctgtggaacctgtcaacactgacggtgcttgcagcaaatgacaacatgctacaaggaagcattcctgccaacatcggtgacaagttccctggcatacaatactttggattggcggataaccaattcagtggagtaataccttcttctctcttcaatctttcatcactcacaattgtgctcctttatggtaatagattcagtggatttgtgcctcctactgtgggaaggttgaaatctcttcggcgattatacttgtatggcaaccgacttgaggcaaataacaggaagggttgggaatttatcacttcactaaccaactgcagtcagctgcaacagcttgttatctcagacaactctttcagcgggcaacttccaaactctgttgtcaacttgtcgaccacactccataagctctactta

SEQ ID NO: 58566 - DNA, 930 bp, Oryza sativa
attttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaatggcagcctccaccaccgcgctgagcatgaagctgctcgtcgacaccaatgcccagcgagtgctgttcgcggaggcgagcaaggatgtcgtcgacttcctcttctccctcctggcgctgccggtcggcacggccgtcaagctgctcgggaaggactccatggtcggctgcgtcggcaacctctacgccagcgtcgagaagctcgacggcacctacgtccagcccggcgcctccaagaacgcgctgctcagccccgtcgtgctctcgccggcggccagctccaacacctccgtcctccgcttgccggccccgtcttcttcgcagcccaagagcttcttcagctgccgctcctacgactgtttctactacgtgacggacgtga

SEQ ID NO: 58567 - DNA, 914 bp, Oryza sativa
ttttttgacggagggagtaacttccaactttccgtcacatcattctaatttcaatcaaacttttaactttgacgtgaactaaacacaccctaagtagtaaattagtatggagaattcgatgaagaatttatctggttaatttatcacctcttggtagccgatcttgaccgtcttttcctcgagcgcggagaggtcctcgacgccgatcttgctgagcagcgcgatgctggagatgctcgacatgggcatgaaggtgaggtcgtccatgacggtgtacgtcaccacgtcccgcacgaaccctttgccagtctgggcggcggcgaggcaggtcgaacagcggcagcccgtgtccgacgacatccccgcgccgaagggcgggaacgccgccttcagagacggcagagacggggtcgtcggccggatggtcgaacactggtaggccgggtggcccggcggcggcggtggaggaggaggaggagcaacgtacggcgcctggacgcgcgggggctggacgagggacgggaagccaccggcggtggcggcgaggcaggggtgcgccggcgccgggttcagcagcgcgtcgcgcgcctccgcgctctgcatgtacgcggcgtccatcctcctcacgctggcgtacacgttcgcgacgccgccgagcgcgttctcgcccgcgagcagcttcaccacggcgccgaccggcatggcgaggagcccgacgaggaagtcgacgacgtccttgccggcctcggcgaagagcacgacctgggcctccttggcgatgagcagcttgatggtcggcgtcgtcgacggcgccgcgtccgccgaagcgcacgacgacggcacggcggcggcgttgcccatgttgttgcctgcttcaaccagcgccgcgtacgtaaaaccctcgcaggatcaga

SEQ ID NO: 58568 - DNA, 734 bp, Oryza sativa
cgaaagtcgaggcggaccaggtatctgaggacgtctccgctcggcgaggtcaacgtgacccccgccccggcgccctgaagagacagggagccgtcgaactacatcacccagtaggcggtgtgaggcagctgcgaggggcccgagtggcctcgggggcggagacgggctcgggagctggggtccattccgccacaaagtcggcgagggcctggctcttgatcgcgtggcgtggttcaaagcgcaaatcgaattcagagagttcgattgcccatttcaccacccgtccagtaccctctcggttatgcaagatttggcggggttgacgcttccgtcgtatttttcggtgatggtgggccggaaccttgggggccaacggacgttccgaaggctcgccacaaaggctcgatagccggcaccgccaaccggggacacggggggccggcccccgtgcccggaccgaagtggcgctccggacgaggaagcgccctccgttgcatgggcggcgcgacgaacgtcgcgccggcgctcgatatcgaggcgggcatccggccccccacgcacatcttcttgggtcggaggcgttaacgagggaatggcggacgaacggcgggcaacggccgccgctcgccgcgccctccgcctcgacgacatggagccggcggcggcagtgccagaggcctcggtggcggaggtccgcccgccggcgcctaggcgctgctgcgccgtcatgacca

SEQ ID NO: 58569 - DNA, 12548 bp, Oryza sativa
  unsure (1)..(12548): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagtttctttggcacaacaattagctatctgtttttgtatttcgggagcagtcaacttacaattctttggagcattattcaaaaccaccttaccaacttcttcaaagttttctgctagcatactcaacatctcaaggaaatttcctttattaagtgacttttcactttcataatgtccacgggcagccaaaccttgccttaaaagaaacttcaagcacttcattgaataggttaaacgagccatatatctagccttgtcttgttcattggtggcagcaaagctctcaacaatatttgttttaggtgcaaggaagtgattgtatttatcttgtgccacattgtgaaagctagtcataccaccaacatgttttgcaatcctttttctcatgtgccaattcctaaatcccctatttacaaatgcatctccaccagaattattaattttatgcttgaataagtaacaaataaaacagaatgcagcatcttgttccacactatattcaagccatttaaattcgtcataccaactaggaaggaagcgccgaggcttacctccaattttccttataggaaaattgtggctgcgtggttggcatggccctaatgcaatatatccccttatcacagaattccgttcattgacatcataatttttgattgcaattcgccttccaggatcatgacaaagtaaatcaatgtcataaatagcttcatcacttgagtcatactctgtctcttcatcatcaccatctctgatgggagaccaatctctgataggagaccaagtggaaggttgctcctgctgtgtcactgctgttgctatgtctggatcattgctagctacctctgtttcaggttctgtcacatctcttgctgcatcactggctgctacctcaggcacaacctcaactgcagtaatctgaatctgaactggactctcatttgcatctgtaatcggctgaacagaaggaacagcaacttcactgtcaattctaactggttgtgttgttgatccagaaccagaacctaaccctaccttcctagactttgaatgtctatcccacaaagtcttcaaatcaatcgatttcttcttcattttgagagttcttcaatctacagaactacaaaagtacaggaaaaagaaactactcagagactaaggtaaaaaaacatcagacatggacacatagtgagtggatttaggactgattgaatcttgaactcttgatttgtcacctgaaattgcgcctgccgcagtgccgctgggcgctgtcccgctgagctgcagctgttggccggccgccgccgcgcccctgcccctcggcctcgtggcctcgctcccgccgtcaccggtcgcccgtcggttgccgtctcgcggcttcgccgcgccgccgccgaatgcctcgccacggcgtcgcgccgctgccgaatgcctcgccgcgccaccgctggtctagctccctgctcccgtcgccggtcgccggacgccttgccgcttccgccggtcgccgcgccgccgcgccgccgccgaacgccgccacctagggtttggaatcaaatggggaattggggagcgggcgagcagcgcatttgcgcgtgagggtgaggcgtgagccgagcgagggactctggaggagtggggacaactaatatgtgtatatgtgttatgtgtatatactgaagtatagttgttttttgataaaaaaagttgggtattcctgggaatacataggcatcactgtagctccgcccctgttattcctctaatggttgctactagtatttctctatttggaaactgaaaaactattttctatttctattgagcactccttgtacgcggttacctcgcccaagtttgaagaaactcctaaaataaatcccaacaagaagaagaacaagagcgatgatcccaacagctctgtcttgctggctcaggacggctgccagcgagccagagcaagaacaaactaggctggacatttcagacgcacataccatctaggttaccatgcgccagaactcgatccttggaaacagctcctaagctggacatttcagacgcacataccgtctttctcgtccatttcactcgcaaaactccaaacttcattagagcggaagcagaaaaccacaccaactaaacatcgagaaaacgagggcaatttgcaaaaccgagagccgtttaaaagttttaaaccattgtcacgagattaagcaccagaaaggaagggttacacgagaggagactaaagatggtgaggagcagtggaggcacctctgatttggagctgaatttcttgagcgtacgccatattgatagagggtgtctgctacagcttctacttcacgtcttcattagccttcctaacgcagaatggactcatggctccctattggcatatataacgactcgacctaattgtttaatgtagcaaagcgacatctactaccagaacggttggatgattctcgttctatgccaaaatattgcaacttatatcatttaaaatttatcacaaaatatattaacttcttctctttaaacaatcataatattctcatttaatttttttatctatttttccaatcaataataacattccctatttaaatttacctattatttttttaaatagttattaaaaattttaaaaactcttatattttgaaatgaaaggaggggcacgttttctcttccgtgggtcatggcccatggaccctgtccccgaaagaggacaaaatccgggactatatggtaatttagtggtgatttaggatatacatgtttgaataatcatggctcacgttttactcggtcgcagtcactcagacccatcatgcatcatttgatcctttttcgctgtctactacctctgtctaaaaaaagacgaatcctggtttccgtaccgaacgttttcatcttatttgaacaaattataaaaaaaaattaaaaagacaagtcgcgcataaaatattaatcatgttttatcatctagcaacaatgaaaatacgaattataaaaaaaatttcatataagacagacaatcaaaattagacatgaaaacccagggttttcttttttttttttagggagggagtatgattgaggcgaattcttgcataggacccgggaaggccgggatgcaagaaaaactaggcacttggtgatgcagcagtgcagcacagagtatgctactcgtagtattcttctgtgctgcatcactcgattaattatcagttctggtaacatgtttttctactcacataaccagccatgtgcagtgcagcagtgctgacggtccatgccgggacatggaggaccgtctgagatagatatataatatcccggcatttgctcaaaaagagctacagccaattattacaaagttccactccagaagagagtgtagttcaagacaagttgaacacatcaaacagaaaaatagaggacccaaactaagaaaagcaaaacaaaaagtggagctagaaggcctcgtcaaagcctaggactgaagttcgaagccaatgcatagacccttgacaatccttgcacgaagaggtttctccaaagcggtgcccccaaggaggacgcgacgtggatcgccgccaccgctcgttcggaaggaagcaaggttttcacccggagaatatggttaggaaaggagatgggtaatctaacacaacgcctccaaggaggagaacggcgacgggcgtcgccgtcgtcagctggccaaacggctcggcaaggctttcgctcgcgattccctgtccaaacccacaccaccaatccgcacaagaaggatcttcgttggtcaacaacattgtcccttcagaaattcggccaaggccaccgcccacagttctcgatggtgcgcccgcacccggactcctccttccttgcctccacatgccgctgccgacgacgacacaccgtcagccccggatgatggccttgcaccaccgtcgacagccaccactgccagccaccatcgccaccgccaccgccacccccgtccagccgccaccgtcagccaccaccgtccaactgccaccgtcagccaccaccgtccagccgccaccgtcgccagccgccagccgtccagaccggccggggtggcatagacctgaaggtgcaacgcgcagtgcgggtcgccggcgccatggaggaaggcgtcacgggcacggcgtacaattgatgggcgccgcgccctcctcgtggtggcgaggttcttgacgagggccggcgtcgcggcacacgccgtagtccgccgccttcgtcgccgccacatccgccaccatcgctgtcgccagccacccccctgccaggtccgtggagcggcgccgtcatcgaccgagcccgtcgccggtcaccccggccaagcggggcgaccggatctggcgcctgcccgtcgtcggagccgccgacctttgccccccccccaccttcgcacgggcgcctcccgcgccgctgccgcggccgccgcctccgtgcactccgccgccgacccgcgcgtcccagcccagatccggccaaggggccagatccaaacccaacggcgccggatttggccgtcatcgccggggccgcgctctcgctctctggtgtcgtcggtgccccaaccggctgaccgggagtgagggagaagggagccccgccgtcgccgtcttcgcagccgcccggctttgccggcggctgttcgggtggcggcgaggtgggggagaggaggagagtgaggaggcgacggcgaggttttgccgcccgcgtcgccctggagcggggcgaccaggcgtccttggaaatattcgtgaccggagcagtatcatattgggacattgaacgaaggctgtttttggatccaaactccagtcctttccatcacattaacctgatacacacacaacttttcagtcacatcatctctaatttcaaccaaaatccaaattttgcgctgaaataaacacagccgaactcaacaagtaagaaatcgacaacgagtacgagagcagacgacggatcgcccgcataactttgagccgtgccccggggctgcagatagatatttcccccaaccatgaaacagacgttcttccaatttgcatcatgatgtcgataaagactactgtaccagtgtgacatttctacgtcaggttcatgatacctgtagcgatcagatacgaaaaagaggcagtttgacaagttcatctcccccctgttgcagctagtaggacggaccaagttaccatacacgccatcttacatgagattcagtgaagatccaaaagtaaagctagtagcagtacagtttttgcctgtcagtatcgtttgcacgccgagcacgagcagtgctgctgctggcaccaatcgtaatcggtcgcattcgcgttaggcggaatattacactgaggccgtgttttggctgtgtgtttagttcacactgaagtttagaagtttagttgaaattagtacgatgtgataaaaaagttgtgtatgaaatattcgatgtgatggaaagttgaaagtttggaaaaaaaaaactttagaactaaacagggccaatttgttgcgacatttttcttcaaacttcaaacttttccatcacatcgaaactttcctacacacaaactttcaacttttccgtcacatcgttctaatttcaaccaaacttttaattttaacgtgaactaaacacaccctgagatctgggtttatctcttggcttaaggaagcaaaattctgggtatattcgaccaatcctatggaccatggacgttttgattgctaatgtcaagtcggcaacatcagtcgttcaaatctagacagatttcccgctgtaatcccttaagatttcatctgtcgtcacacggtgaaactaatgaaaaacagtctttacctgagatgaccctctactgtcagaaagtattgacaactacagtgtcgtttcagaaactgatgaagacggggatcttcctcgatgctgtaatgtttttgagcaaaaagcgattatcgagttcctgttattctgcagttactctgattgaccccgttattccagggaagataagaccagtattccaaatttccaattgattccgtgaaaaaaaagagatcaagtacagtaaaattcactctgggtatcactatcaggcgtatcaggcttcagagttttgcttctgaagtttgtgtgacgtcagctgacccagctgtgttcttgctcttggcgtcatcgaggtagtgctggtaaacgtaggacaagaatccccagatgccaatgagcatggctatcactttggcaccgtccatccggtcgccgaggaagatcaccgccatgatcggcgacagcggcatccccaccgtgctgatcacgttcgtgaacagcgacgacaccgtcgcgacgagccccaccatgcccatcgtggcgagctgccacgagatggccgtccacgccagcgtcatcccgtaggccacctcgcccttcttgtacccgtccatctccgccgtcagggagctccactcgccggagatgaacagcccggccaccgacacgcacgacgcggcggcgttgctccagagctgcagctccagcacggcgtgtgccgcgttgctcctgagcaccgtgtcgaacgtgagctgcatcagggacaggatcagggcgaacgccgccgacgccgacagcgccaggacgaaccccagcgcgaacttgccctccgggacgctgctgttggtctcctccgaggagtggctcacgccgacgagcgcggcggagaaggtgagcagcacgacggagttgagcacgagcgcggtgaacctctccttgttgaggaagtaggagaagacggcgttgaagcagagctgggtggcgcagacgagggagtacgtcgacagcggcaggtagaggagcgcgtaggagtacatcaggttgtcgccggcgaggaggacgccaaggccggcgtagatggcagcgatcttgagcagcggcggacgtgccaccggggaggcctctggccgccggaagtagagcagcagtgggacggcgagcggcgcgccgcaggactgcaccaccgtcgccagccacaagctgccgccgccctggtcgtagtaaatccggccgaggagcgtggccacgctctgcccgccgaggacgaacacgatgttggcaaggaccaccgcccaccaccgcagccgctggctggacacaggcggcagcggcgccgccgccgccgccgccgccgcagttccatctgctcgagacgtgctcttgtcagactctgctaccacgtcttcttggcctcggacacctgcacatacgaatcatccgtctcatcagtataaaaactggactagtttcgatcgatctcacatcacatctcaattcgaaactgtgatcgatttggcagttcatgaccgagagagacctgtaatctgcagctgaatttcagtagcatcgctcattgtgaggttcagaaaaaggataaacaacaagatgggcctagtgctcgtcatccactcgtccagcagcagcggaaggctgaaacttgccaacttggagtcgtcatcaatcaatgaaacgataaaaagataaaagggttgatagggcatgcgcaaggggctaattttgccgtcaaacgtttcaaaactactccggcgagtcaatgtttatgtcctgcctcttggaaaattcaatgcgtgcgatgccaaaatttccaagtgaggacaacgtcgatcgctgcatccagacggaatcaatcttatctccaatttgacaaaagagtacaaagattgccaattattgttcttcacccaagattctgcggaagtgtcagattcagatgtagtttaatcagatactaattgttttccacaactgaaatagaagtagtaccaaattattcgtgtccatcagccaccaggatcaacctgacataagacaggacgaagcaaataaagagttctttactagtctagtactactatttctattctttcgtgatatacaattatgcgtcatacccttacacaaacgcacatgaagaaaagaacaagaaaactactagtaatccagcaaaattgtacatctgaacacgttggcaacacaaaaaaacaaagtacgtactagtttttatctgacgaacaacctgcaacataacataagtaacgaacatctagtacctcgcagccaacaaaactagctaagattattggcggagagcaatcaatctctaccacgataatatcactgtggccacctaatctgatcacccctgcgcactatcacccgatgaagccttcttcgctttcttgccatctagatagtgctgaaacagatacgaaataaatccccaaattgcaatcagcatggccacgatcttcaccccgttcatcctgtcgtggaacaccaccaccgcgaagaacgggatgaccggcagtgacaccgtgctgatcacgttggagaagagcgccgacacctcgaagatgaggccgagcaccccgatgttggccacctgccacgacacggccgcccacagcagcgtcatcaggtaggagaactgccccgacctgaacgcgttcatctcccccctcagcgacctccactcgccgctcgcgaacagcccgaccaccgacgcggccgtcgccacgagcgccgtgtagatctgcatgttgaggacggctgagaaggtgtgcttcttgatgatggtctcgaaggtgagctgcatcagcgcgaggatcagcgagtaggtgcacgacgcccccagcgtcagcacgaaaccgagcagatacttccctcccgagacgccggtgaccccctgagactccttgctgactccgatgagcgaagcggacatggtgagcagcacgacggagttgaatatcagaggagtgaccttctgggagttgagcacgtatgagaagacgacattgaacgcgagctggctggcacagatgagcgagtaggtcgaagcggggaggtacttgaggccaccagtgtacatcatgtcgtcggcggcgatgatgaggcccaggacgatgtatatcacggcgagcttggccatgggagtgttggtgcaggaggacggtgacttcgaggggaagaagaagagggtgaagaacagtatcgggaagccggccgtccgcacgaacgccgatatccacttgctgcggccgccttgggtgtagtagtatctgcccagcagtgtcgccgatgtctgaccggcgatgaggaagaagacgtccactgccaccatcgcccaccatcgaaatggcttgcctgctggtgtttccggagctgctgcagcttcagccttggatggagctgtgatttgtaatgaagatggtagaaagttagtaccaaacgtaacaggtaaaatttttttaatgatgctttacatttcatcagtgggtgaaagtttctgaacacgatgcaatagaggtccatgtaagagcaacagagtttaagtgtaacaaatcgtactcacaaaggctaaaaacagatcatccctaaaaatttccccaatgtaccaacggaatgatcaattcgcacgagtgttcacggataatccagcacaggtgcttcccaggtgcacagcacgattggaacgcaaaagcatagcccgcttctcatgtttttttttcaccctaacccttcatgcaataagatgaaatggaaacataacagcgaccagagcggaccagactgagactgacctgggatcggtatctggacctcggcgttgttcgcggcaccgctactgttgttgccgccggcgttactgtccgccatttttttattcgaggaactgccaccctgtgagatccaggacaggaggaggaagaagacgaggaggaggaggaggcgagaggagcgcagggtgtggtggcaaaggagaattgcgggggctcatgtttcgcggtggagagaacaagagggcatgcatgggggctgggcatgcagaggtgttggagagggaggggccggagaccagcgggagaagaagaaccggtccgcccgttcgtttcaccgccgcggccgcgctcgtgtcgtcgtcgcgcgcttcggggagtttttccttttccgctttgcagcggtatgcagatgcagagttttgcgggtttccacggtttccgggttaaagcgcgatacacgacgaacgtttacgtgccgcagcggggccttccgcgcgcaccgcgatagcggaaagttgtacttcaagcggccgatacagaagagaaggttttgtgcacgttgacgtcgtccacatttgtctcgtcttactgtgcatgggccgaatctttagctttccacgacgggtgggccaaaatccacttttcagtatgacctgggccataggctgacaatacttggtaggaaaaaaaagtctattttactattccattaaccaatgaaatagttcggaaaataaaatggttttttttttcctttggtggtttggtgcatagttttggtcacactaagatgcctaaatttcggtcgtttctaatggccaataccacttcatgattcgtgctgtcatactagagataccatctctcctcgcaaagcttggataaaacccttgcgccactgcccacccatcctcacccacttgcccccctttgcatggcttgcgctatctagatgctaaccagcccagctcaatcgtcctcctccctttcaccccctttctctcccttcgcttctcctctctaagcctaagcggcggccaggcgcccttgccgcccttgccttgccctttttttttttttgtcttcagcggcccctagcattggagatgctaccattgcctctatctcctaactactctagatcccatgtccataccatcaatctcatggctatgatgccaacaccgcctcgtcgcacgtcatatatgtcaccacaggtttaccatctccctgctccttagtcatttctctaagctcgaaaaactgcatctttccctcaccttaattcttctcccacccgtatcctaatccaaatatctatcatcgtcaacaccgaaaaagtggaagagcttgctgttgttgtcgctaagtactacaggcatctaactacaaacccaaagatatcgcattggactaatggtgaggtagatagagtagagaagagtgaagagagaaagtaccacctctcatggaagaaacaactcctacataaacttcaataaaaatgtggaaatacatattacctcttactattatatggtatgcatgaaattagctataaaacttgctccaagtattcaacaaatcttcatcccttatccctctcccccgggaacgaaaaggatttggattcctttttttttgaagggagatttggattccttttgggaatttagcccaattcgtgcatacaggtcggcccaggtaaggcaagcagaaagcccaacaaattgcatcaccaaagctcgcgccgccgctggctcggagcctcggacgccgtcacgtcgtgatccgtggagacgtgcatgacgtttacagggcgaggtagctgccaatctccgttggaacggcccagcagattgttgttttttaagcaaagatgccggccgattatatcttagctgaaatgcaataatttcttcacaagatatgccgtaaattaagtgtgcgttccactgggaaaaaaacaacaatcgtacgtgcatctcatggctaatggccggatcggtctcagaataggtgcacaaggaatccaaccagtttcttccaaaaatggaaaattatatgacaacggaattagtgagaaaatgtaattttgtcctgtgattttccagagtaattaatttattacgcaaaggatttataggattacagacgctgtaactcttgtgacgtcatcctagctcggcggcgataaggccgatgtgacaccgagagcgatggccgactctttgctgaactcctcgtcctcggcgaccagcggcgaggccaggccgagctcgcggaacccgtcctcgcacgtgtcgggggtgtccagcgcggcgctgagcacggtcaccgcgtcccgcaggccgtcggcgctgcgcgacgcgatgcccttggccgcctcgtcgaggctgtccacggcggagtcgtacacctccccgcacgcgctcaggcaatctttcctcctcttgtcgcgctccaggtcctgcaggtccgcgatgcgcttggcggtgcccctggccgtcgccgcgctgatcttcacggcgatggcggcgaggccgtac

SEQ ID NO: 58570 - DNA, 7872 bp, Oryza sativa
cgcacaagcttcatggtcgtcatggcttttcttgtcctggggccgcttggttacttgtttggtgtgttttttcgtggtagaaccaacaactttatactagcaggtatcgtcatcttaatctctgaacaataaaagaggatccagctgttgattgcactggaatcattacgagatattacaccattcattcattcattcaagaggatttcctggatgacgcctgctgaaacgttggcgggtgtctcgcagtctcttcacgcctgccgcgagtctcgggatccaggaaccaggatcgctcttcttcagaaattaggatcagccacctgctgacagggtccctgttcctttcgagccaaatctaatctatatagtttcatgtcatgacgaaatgtttagacaccacatgtcgaactgccagagtcttaatcgggggaagttccaaaaggtccctttacaaattcatggtcgaaattcgaaaatctcttattacgaaacagagtctgcttaataatcgtgaaataagagaataactgatagttgccacctgggccttaaattccgttgtccggatgtttgcagtttggagaggtgaatttggcgtgggcagtgggctggaaggcccgtaacagatatgatgtagatacacaaatcttgcaaacgccaacagtggtgatagatactatctcaagagaaggatacgtttatttttagttccttccgtttctagtaaaataagttaattttggagtaatcattgcattgaagtttgtgaaagtatttgtttgatatatgcattggaagtggataaaataagaaataattgcattgatatttaataaattagagttattttagtctatctcaagtgcaaagtattttagtcttcttagtttgataaaatagtttgtattttagtccactttttagtttgtatttgtattaatctatctcaaaaatagacttattttggtgtagaggtagcatatcactatatttcaagtgcttgttggctgttatactttgcatcgaaagtactactaacattgttgacgcttttttttttttttgccaaacacactcaactgatgatttacggtataattaacggagtagttaaaatcaatagatcaaattagctagcggagcatattttaagattaatccacttttatcaaatcacacaatttattaatttataagtaaattagcaaagataactattctacttatgcgacgatgaatgactattttctaaacaaagtagcaaagggtgacttcatcttttttttttcaaaagcataaccggttttcaacgcaaaactcggccataaaaatgaaatagaaaataaacaaagataatagtaacaggaaaacaatagattgataattgccatgtttattcatctacattgtttggcttacaaaatctgagagtaaaaacacacattcactgatcactcggtggtgatatcgcctctatcaatgcgagagcaatggacgcactctgtctaaactcggcgtactccgcaaccagcggcagggtctccttgttcccacggaacctgccctcgcaaccatccgcgacataccgcgcgacgtcgggcgttggcggcgacgccgccgcatgctgcgcgccgccgtccaccagggcggcggctttcgcctcgttgccgagaacggccagcatgtaggcgtacaggtcggagcttatgcggaggcactcctgcatcttctcctccttgtgcgaggatcgcagggcggcgatgcgcttggcggtgccctcggcggccgcctcggtgatcctcacggcgatggcggcgaggccgtgcgtgtcggcggtggcgctctccttgctggcctggaagaacctgacgcagtaggggtagtcgatggccgtgtggttaccggcgagcgacttgcaggtttcctccaagatggaggcgtcggatgtggaggcggcgagtaggaggagcagggtgaagacgagaggagagagtgccctcagaaaagccatggtgttcttgcttcagtcctcacctttgtttgctgtgctcgattgtttggtgtgtgttttgtgatctagccaaggagtgcatgaatatatagatggtgtgggtaggagtgtgtgtgcacactattggcttcaccacaataaatgaagtacgtgtatatatgttttgcttaatttaatgcttctaaatctctttacagaaaaaaagacaataaatacataaacatggatatgtcattatcggattcccaaacattaatgggagtggaagctacaaaatttgggattagactgatgcataaatccctatgcctgtatttttcaccttttcctcttataggtctttgatttatttttgtaccctcgaaaagagaaattaggcatgtacaattaaaaatacaacgatacatagggtgctttataaaactccttttgaaaaatataattgaaaatacaacgatacatgatatgcttgaaatacattaaatgaagaaaattatggatccaaccattttttattccaaaaatggtaactaacaaatggaagctcaaatatttattttttattttaatatatattttaaattacaggaatatatttttcgcttctgtaaatttttttaaaaaatactccttcaccgtgggagtgtttttttagggatttgctttaaaaacagcccttctagagggcagatctgatgacgtggcattaggcatgggacatttgcgtatagccccttatcacactcctagagaataattttaaatatcccgcccacctagagaacaaaagtagtctatgcaaatttctcatgaccgttatttttctcgcaagcatatataggccttaatttcactgtctttgggttgggtggcatataaaagtcgcctctaaggagcatgggaaaggcatgtacgcaatattcaaccaccataatctccatcagaaccgccttttgagaggcaatttatgaaaaaaaaactctcccatagggtgaaaggagtatgatgtttgtaaatttgtaaaagaaaattatatttatgtattttttgtttaaaaaataataacaaaaagctcagatcaccatatgggctaccgccagcacctgagcgatttagcccactcagatgggccgttttctatgggcttagactaccgtgatccccatgagcgtttagcggataaggcccacgagtattatcgggctctcggcctcggccgcgaccgctgcaatctggccacgctgatgggccgttgcccatgtagagggcgtatggttgggtactcgggctctgtttggaataagtccactttgactcccttaaaaagtaacctgaatctaatccgtgaccctcaaccgcaaaaccggatagaacgactccctaaactattgaaaccggtgcaatttgacttccttaatggttttggatggtggtttcgctgacgtggtgcttacgtggcggtgttgatctactctggtcttgatgtggcgcttaggtggcatttaattaaaaacatatatgtgggacccatttgtcataaaaaaagtggggcccactgacatgtcatcctctctctttcttcttcctcccccactttctcccttctctctttctctccctttccaccgtccgcggggagcacggctggagcggcggtggggcaggggccgaagtgctggcggccagcgggagctgaagcggcggcgggttggagctaatgcgggtggaggcggaggagaaggaggcggcgacaggaggggcttgagtggctgcggcggtggaaaccaccccacgccacagacctccaacgaggcggctgcggctgcggctgcctctgactagcgcgctggattattcctagcctccgtcagctccagcccacttccaccgccgctccagctagctcccgtgtcagctcctgccggccgtcaccactccggctcccgacggcggggaggagcctcgacgacgggaacaggtcagcgacgccgaacctagtcgccttcttctgtgcctcgcccagcgtctccaggaactcctcatgccaccggaagccgcactcccccatgatggcgtgcaacgtcaagtcggtcagcgtcccggtgatctgccagctcacgttcagtgccgacagcggcggcgatggcgccaacgagcacacccgccaaagagtatccccaccgtggtgccgatggagtccctcactgtacgcccagccatagaggtcgaagcccctgggccaagcgccaggaggaggccgagctccatcctcgcctttggccatgatggtatgcatgtagcgatgcctgccttgggacgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgattctgccgaggctgacccgtggagcattgtgggggttggccggattgccaggctgggtttatggactgcatccgcggagactgtcacaccccgaagttttcctcccaagccaaaattgtaatttataaatgaccctaagaaaataccggtgcaaatcaggagaaaaccctaagaaagtaatgcaaataataatcggatttaacatgtggaattttttttcttgagttctacatgtcgaaattcattaactggatttttagtggaattttcagagctctagaaataattttaaccagttaaaattgagccagcaatattgtaattccagggaaaatactttttcctttttctttttcttttccctccctttttcctcctttttttttccgaatgggccgccggcccattctcccctttccttccccctcccccttgctgggccgaccgcaggccgaggcccagccaggccgcccgcctccctcctctcccggggtcgccgacaggtggggcccacctgtcaggtctttccccttcctccggccgacgccgcgcccgcaaccgccgcacccgaaaccgccgccgcgtccacgtctccgcctcctccgggccacgtcggccacgcccgcgcgtgcgccgcgtctcccgcgcccactctcctctctctcccgctcgcgtccgcgcccgagatggccgggattcgattttcgaatcccgcctctctctcttcccccactcccccacgtcggccggcgattcccgcctctcccggccacgtccggtcctctctccccctatttaagcatcgccgtcgtcccctctcactttttccccattccgccgtactctctcgagcctcccatcgctctcacgccgtgcgcccatccgcagccgctgtttccgctactccggccgccgctagccgccgttagggtcgccgccaggccgcgccatcgccgccgtcgggttcgcgtggccgggatccaccccgtccacctctcctccgtcgaggttcgtcgccggagccctcgttccctcgcactcgagtgagcatcacctctaccgccgccttcggccatggcttccggtcgccgtggctcatctccctctcaataatccctctctcctccttccttagggcaccccgaagctcgtccgctcgccgacgtcgtcctcccgtggcttgccgtcgccgttcgccatcgtcttcctccgcgccggccaccctcggtgaggcatcccctcccctcttttccccttcctctcctcttagtgccgcgccgccgcttcaagtcgcgcgctgtcgccttcgaccgccgccgcctcgcgtgccgccggtcgctgccgtcgtcggtcgcatgcgtcgctggcaacgcgttcgcgcgcgcgtcgtcgccgtcgccgcggtcggttggccggccttgagccaatccgagccgcgtgccgccgccctttctttccctctcccgggtcgctgaccagtgggccccgcatgtcggcgccgctcctccccggtccgtggacccgatccgccgtggaccgccctctcccgggtcgctgaccggtgggccccgcatgtcggcgccgcactccctccgtgctgacgtcagccctggaatatattgcgcaataaatagtttaaggtttttcttgtatagttttaaacacagtaaatcttctaaaaatcataactaattcatccgagttccgtttaagcccattcaagtctcagtaaatcaagaaaactgtgcagaatccattaaaaatggttttgttccctgtttcagtagtcttatagcctgtttgcaatgtttgctttgtatgtcgctagattccgtttcctccgacgctccggtgtacttcgagatagtcgccaaggttcctccagcagcagagcaaggcaagtcatgcttgtcacttgaacatgttgatcctatattgcaaatgctctattgttttctttcaaatattgcattgttttataatattactatgggatggttacctattgttacagccatgcttttcggataccatgctcctttgttagcttggggttataacatgattagagtttggactaggaattgcttagccatgcttagttcaactagttcacaacggggaaaatcatattaatgtttagactgttggttccaatggtgttgttggattagtgacaccgtttgggtgttggttaattaaaataaaccacatggtgggctgtgggtgcatggttttgctggtcgcacccatggcagttaaggaccggttcgcgggatgccctggaagaacatatcgtacttaccacaagccagcgtaggcaacggctggacttgtagtatatctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacgaaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcttttaatttggatagtttaggtggatggttgggcctgtcgcaacatgggttagcgttggacagtggatagttgatgttaattaattattacaactgtttaaatctttcaatttctgtttttaaatgctcgctttatgcaaatgaaccacttcagctcttctttgatgaatccctgcatcatacccctattccggtatgacttgctgagtacagtgggtagtactcagtcttgctctacttttcccaaccccagagttcgagttcgggtcagatgaaggtttctccgaggagtaggctttgtccgtgccgtcgaggatgcctgtggagtggtgttcccgctgcagttcaagtcaaggcttagctcctgttgtctttctttctttccgctgcatttatgtaagacttttatgatgtttgtaagacgtggatctgaatgtcaacattgtcgtttgtgtaccctggctggtcctggacggggattttaatgcacattctgcttggaattctattcgggaatttctgggcgtgacagagaccgccgccatcacgcatgcggatacgccgaggtcgaggtcgatggcgatggggaagctggcgcccgcctgctgctgccgcgtcagccatcgccgtcgccgccactccggctcccgcttgccgtcgccgcccttgcctgcagattacgctacgagaga

SEQ ID NO: 58571 - DNA, 38225 bp, Oryza sativa
aagggggtagattgtaaagcccagaaattcccgaatagaattccaaccagaatgtgcattaaaatcccggtccaggaccggccggagtacacaaacgacaatgttgacattcagatccacgtcttacaaacatcataaacgtattacataaatgcagcggaaaaatgaaagacaacaggagctaagccttgactagaactgcagcgggaacaccactccacaggcatcctcgacggcacggacgaagcctactcctcggagaaacctccatctgacatatactcgtactctggggttgggaaaaatagagcaagactgagtactacccactgtactcagcaagtcataccggaataggggtatgatgcagggaattatcaaaggagagctagagtggttcatttgcataaagcgagcatttataaacagaagtttaaagaagaaaacagttgtaataattaatcaatattaatcatccactgtccaacgctataccacgttgcgacaggcccaaccatccacctatactatccaattttaatagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacaacataccgtaaagaggctgtgacaagacctttcgcataaccccctctaaccaagcacaccacacctcaggtttcacccccactcctcgcaaggcagcgggcagtcccctctcatgcctaggtgaatccggaagcgacagaggccgtcgcagggcccgtcccgctccatcacgcccacccttgcctggatgcgtcagctagaggaaagctacactacaagcccagccgttgcccatgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgtactagttgaactaagcatggctaagcaactcctagtccaatgtctattcatgttataacccaagctaacaaaggagcaaggtaccaaaatagcatggctgtaacaataggtaaacatcccataataacattataaaacgatgcagtatttgaagaaaaacaatagagcatttgcaatataggatcaacatgttcaagtgacaagcataacttgccttgctctgctgctggaggaacctcggcgactatttcgaagtacaccggagcgtcggaagaaccggaatctaagcgacatacaaagcaaacaatgcaaacaggctataagactactgaaacagagaacaaaactatttttaatggattctacacatttttcttgatttactgagacttgaatgggcttaaacggagctcggatgaattagttatgaattttagaagattcactgtgtttattactataaaaaaagtccttaaataatttattgcgcaataactcccagggctgacgtcatcaagggggggtggcgccgacgggcgggtcccactggtcagtggctcgggagagaggggaaggggcggcggcacgtgggccccactcggcagcggctcaaggggagggcacggctggcaagcgggccccacggccccggctccacgggccgatgtaccggccaggcccggcatcaagccgaccggccggccatggcaaagcggcggcgcgcgcatgtgaccaccggcgacggcaaacggcggcgtggacggcgggcggcggcgcgagcggcgacggccgaacgcgatggcgagcgcgcgaagagggcggcggcgcacgggaaaaaaaaggaaggaaaggaaggggagggagacctcaccggggggggcggcaacggccggcggcggaaaacgagggaggcggcgaagaccggcgatgccgaggtgcggaagagcgacggcgacacctagggaaaagagaggaggaattaggacgaagggaaaccctcacggcgaccatccacgccggccggagtcggaggggagagagaactcaccggcgacacgagggagatggggtttcggtgggattccggcgacgcaaagcggcggccgggaaaggtcttgcggcggcgaagctaggggtggcggtggcttagcgcggcgacggctctagcagcggcggcacacggccggagtgcggcggcgcaagcagcggcggcgcgagctcggtagggggcacgggatggagcggtgagagcggaaaacgagagaggagggcatggggagcattttataggcggagggggaggcggacgtggccgggaggcaccccgatttcgccggcgacgtgggggaggagagagagaaggtggggacgattcaaaatcgaatcctgcccttctcgtgcgcgggcgcggccggaagacgcggggagaggggggagtgggtgcgggaggtgcggcgcatgcgcgggcgtggccgacgtggcccggaggaggcggaggcgtgggcgcggcggtggttgcgggcgcggcggcgcggcgcgaggtgggagacgggtccgataggtgggccccacctgtcagcgacccgggtgagaggaggcgggcggccggcccgcgcggcctagctgggccttggccttcggccggcccagcgggaggagggggagaaaaaggaggaatgggccggcggcctattcaaaggaaaaggggaaaagaaaagaaagaaaaaggaaaaagaaggaaaaaggatttttcataggattaaaattgcatgtgctcaattttaattggttaaaattatttcgagagctctgaaaattccactaaaaatcttgttagcgtatttcgacatgtagaactcaaaaaaaaaattccacatgccaatttcgattattatttgcattaatttattaaggttttctcttgatttgcaccggcattttcttagggtgatttataaattcaattttagacttaggaggagaacttcagggtgtgacagagataaagagagagaacggggagagagggaaggggaaggagagagtgaatgacatgtagggccacatgtcagtggggcccacaatattttttatgtgtgaatcacatgtgggtccatagattttttttttaattctaatgccacgtaagcgccacgtgggacgaaaactaggtcaacatcgccacgtcagcgccacataagcaaaaccaccctccaaaaccaccaagggagtcaaattgcactggtttcaatagtttagggagtcgttctatccggttttgtggttgagggtcacatattagattcgggttacttttaagggagtcaaatttaagggagtcaaagtggacttattcccctctgtttctagaccaaaaaaggccggtaggcattgtttaccttcaaagcccagaggacattccatgtggtcagcaaagcgggatatagtaggttgttcaacaattccaacactgcctttttatgttgagaccatctccaaaaataattatctccacgagccatatctataactaatataaatattcggatttttctggtcgtcacctcatccatacggtgatttttcatcccccctcaaaaaacccagttggaattccatcatcacacaaatagaatcccacattgagcacaccttctctccaatctcaaatcatcacaatccaaatccaaatcaaacacaaaatcccagtccaaatctaaatcggaatcattagaaaacatcatattaacacgagatgactaggagagggaggggcgagccggaccggaggctgcagcgcgctgctcctcgccacctcgtcgtcggccacggacccacccgccgacaccgccatcgccgccggatcaggggcaggagggaggcgagaggggaggagggagccgccaccggcccgcgaccgccgccacctccggatctgccgagagagtggtgcggtggccaccgcccgacgaggagagaaggagccggcagtggggagagggagcggcgccaccatcgccgtgctgccacagccgcccgctgcgagggagtgtgccgtcgccaccgctgccgccgtcgtcgccgctgctcggtggggaaggctgccggcagtggggaggggggcaaaaggcgtcgccggttggggaggagcgtggagaggtgcgccggtgggggtgtggcgtggccgccagcagggagagaggcggcctgcgtggaggggaggaaggggaagaatgaaattagggttagggtttatttgggttgggggttttgatagattaggagccgatctgagccgtcccgtgttgggctggcctccatcatcgggccgcatcagtgatgggccgcacgtaggtcggccggcccaacaaaaaattaaattagatttccaattaaataattgttaaatgatatttgtattattaaaattagcaattaagctctgaaaattccaataaaatttcaaagagcgaaactaatcatggagaatttaataaaattaaatttaaccatatcattttatttctcacacttactttacttgtaaatttatttaattgtatacatacctacttaaagataccaaatatttcagtgaatttatattttaattaattgcatattcttctcatctgtacgctttccgttgcaacgcagaggcacttttgctaaaccaaacaatacttttggtcaatatacacgctccgtaatcaccaggtgcaacgcatgaacacttttgttagtaaatgtatataacaataaagtcatggacctctccacgagccgtactgatcgagccatgcagtatgtagtatgtacgggaacaccggcgaatataaatgtgacttcgcactgtacgtacggctgtacctgtaccgaaacgttgtctgcacttctcgtttcgacagcaccggtagtccggtactcacaccgtacgtcagtaaattgcatccgtaccaaagttgcgcatgcgcatttcgctacgtaacgtacctagctaatacggcaccgctaagcaaaaagcatcagcaattcagcatgcaggatgcagctaatgacgacaagatctgatggtaaaactattcggtcgctcgagatgcaatcgttgcaccaaaaccaaatcgtatctacggatcgaagggcaggcaggtcgtcggatctgtgcgtcgttgcgtgaaggcagcaacgcttgtgccgtggttttgaccaccaggagacctgtgctctcgtcatgcatgggcgatagagttggtgacccgaatcacatcagcgagctagatagagtagctagctgctgctgcaggcgatttgacacattgactgccgtcaacacagcgactcggcgtgtgcacgagaaacgggtgaaaccgatcaaatttgggccttttctgccgcttaatttatactcggccgctcgcactcgggctgcccgtgcagtgcactggcattgccaccaaagcaacaagcagctcacatgtaaataagcagcatcagcgaactagctggattatacatggatgcaccggaactctgaaattggatttcacgtttcatagctaccgccacgcatggcatgccaaggcactctttcccatttcaccaggcgcctccatggtggtgctctgactgacacgttgtgacacacatgatgaagtcacacaaagtacacaacaacaactactactacatctctgggaaaataaacaagatgcatcaaactcgtccacggaaaagaacaatattttgcatgcatgattccttcctaccctggctgctaattatgctctcctcggtttccaaaatccgaactccgaggataactatgtgcaaagagaggcctgcaaactgcttacgcctaccagtttgtacccgatcgagtcaacacagaagcatccaaaacattggattcaccattcacctgagtacctgatgaaggctatctatctgaagatgacaatttgacacgaaagccttcctgtgcctttttatggtaattacgtttatacccctgcgatccaccggtacagcaccatgaacgccgtctcctcctcctccgtccccggcggcgacatcctcaccgcctccgcgtcccacagccatggctcctcctggctgtggctatggtggctctggtagctctggctccaccgggagctccaccgcccggagaaggacgatagggatgacgcggaggtggccagccgttccacgtactcccgcagccagccgcgcgtcgcgcccgccgcttcggccaccgcctcgccgggaggcggtggagactgctcggctgctggcttgtcttccttgactgcggcggcgctcctggttgtcatgggcgcggcgcgggagacgacggcctcgacctcctcgtcgatgtggtagtcgaacgtgccgagcgagtaggtggggcgggcgttgccgccggtggccgtcgacgcgctgcggttgctgacgctgcccatctcgacgcggaagctcctggaacggtccctgctcctcggctccggcggcggcggctgctcggcggcgaggatggcggagatcgaggggtgcgggagcgtgacggtggcgcggcagagcgggcaggacggggtggtgcggagccacgcgtcgacgcaggcggcgtggaacgcgtggcggcacgccgggagcagccgcagctcggcgtccagcgtgaacggcgacaggcagacggcgcagtccggtgagctcttggggagcgccgccagcgacgacgccatcgtgaacagcggcagcgactcgatcagccgctgcttctcgtcgcccaccacctccttcttcccctcacaaaccccattacgccgcaccggagaagcgtccgccgcctcgacgttgtgcacctcacggcgcgtccgtgggagcggcggcggcggcggcggcggcggcgacgacctggacagaagtctgagaagtaggtggatcgagaccgacgctagtagaacgaaggcaagaagagcagcgatgatgaggagagacgggaggaaggacgaggcggcgtcggaggatccggtgacgggatcggcagacggcggcgacggagacgagagagtggacgccatggcgaggcttagccttagcttgagaatggtttaacttaacccgcccgggaatgagacctctcgcgccttttatccccgggtttctttggagtgcgcggtggtggtggtgcggatgcagaggccggaagtaaatagtggcgggtttgcactctcctgatggagagatcccagaaatggtggaggtcagccttggaaaccaatccacgtctcggtttctacttttctacctctgcctgccctttgcaacctgaaattctgctactactgctacgtggaaaatttcgcatagcagttgagcagacagcagctcaactgtttgcaattcgatagtttgttgcacaatagtacaatgttgtacactggttagtgaacttaagtacgtgcaaagaatcaaatccgcagtaaaaatactgcattacagcagcaacagtgattctgtttgcagagcagattagcatgaaacctgaacatgctagtaaactctgcatcccagcacgtacccctgtaccgcagtgttcatgctgtacctttcaccaaactgtaaaaccaattaaaagccgttggatcaaggggtgaagtactagggtaacgtaaagcagcgcaaacccgttgttgtacaaaaatgctgtaatgcaatgcggcaccaaatattaatttgcgtgtccggtgtttatcaactctatgatgagacacgtatcggaccgtgggtcccttgcttcgctagatgcacctatgacgtgcaatcagcatgggaatttgagaaactaatccaagagggaaacaaacatacttcgatgtcctaactcagcaagtgttaacatcatgataaatcaacgtgtatgttgctgataatgatctgtagaaacatggctacatctccgattattcaggtcaatctcttaatcccaccaggcgtcagtgctgagagtatgagtacagagtactgatgtttgtactgctaactagtaaataaatatcagtactagttgtcacttgttgagcatcacaggtaatgacaggctattagcaggagtattttagaaggaaactaattaaacagtttcagagctacttgtgactgctactaccctgttttttctgtcagtgagagcaggatcaatggatcatccaggcatgcatggagtattggagtacgcagccgactagagtgaagtgttggcaccgatcctggcaagtggcgaggccccttttgttagtgcaaaagatcaatcaagcccgtgccttttaacccaaagcaaaggaagcaagcagtgttgcttgccttgcacacttagcatgcggattttctcaatgggttatatttctatcgccatggccacccacacagtctgggtgccatgtctggagaagggatcgaagactttggtttgttttggcgccgtggcgatgaattctccatttctcctgcctctgtgtcgtgctgcctcatggcattcagtgcccctcccccaaattatgatgagcatgagctgcctgcatttttctttcccttcgttcactttactctttctgatcttactagagttgtcctgacatgatgatgttgagccttacactttccaatggagtagctctcctactctgaggatggcactaccaaaatccaaaaaggcataacttgaacggtcctcctttcatacagtattcaagactactgccatagagtttcagttacaccaaaattacatcgagaccataccgaaaccattgcttgaggttgcctaattttcactgaaacgggattgtttcgtacggtaaaagagcgtcacatggaacttgattgcttgacgggccatggaaataaaaaagacttctctgccatggagtaccgatgattagtcaattcagaaacactactgaacagagctagagctagtactaagcactatgccctattcaggaaaatccagccaatgtacgtgtactaatattgattacccaggatgatcacaatgcgatctcggtgatggtgccgtaagtgacctaattcgcctgtgacatcacaggcaaatgctgtcaccatgcaggaggtttcttgcttggatacacacggaaaattttgccccgggcttttgcatttcggttggtccaccaggaattgtggcaagtgccaactttgtgaggcatgctgaaccgaaaccagccaaatttgttagcatcctgttggttggtcgcccatacaagcgaaaggcaaaccacaacctaatccaaacatctggctcacaccttattgacgtgccgttgagacagaaggaaagttacgctacacagaaatggagatgaaattgcaagagcatgttacatttttgggctcattaatatacttctttcaggacggcccaattttagttatacagacctcggagggaaaaaaaacagagggataaaaattaggacaggagtggatcattcatcattgacaactgagacccattttttcctctttctttctaattgtaatgtcatgccagcgtttcgtacccaaaaaaaaaaagtaatatcatgccagcgtcatgtcaaataaaattattccccgcaaaaaaaataaaataaaataatcattaaaatcgcttggggagacaaattaaataaagataatccaagaaataccattaccaagcattcaagtaccagaaatgatatcgataaatgatatcgataagtgtgagtttcaagaagtgccatcgtacaaacgattttgtcccaaaaataccatcgccgttaaggtttcgtccattttgcgccattaaatacactgttcatcctatagaacttaacggcgcggaatggacagaatcctaagatcgatggcatttttggtatagagttgtttgtacaatggcattcttggaactcacacttgtcgatggcatttctagtatttgcacgcttgtcaatggtatttcttggattatctcaattaaataagttttggtagttgagagatgtgcgataactgatattgcggttgagggaaatatttgagctcatgctatagttaagggaggtaatatatagttctctccttgaaaaattgccaaagcatgtgatgtttttgggcccatttataattctttcatgttaacccaattatagctatacataccctataatattatcaaaacaaaaggcttaaaaaattggcctgtttatttttggaccgggtcataaagggcggagccttttgttgggccaagaagcccatcagccggtttctccgccgcggccttcctctgcctcctgcgaacagcccacgcgacggcgaaggcaaccaacaccgcaaggaagcaaccggcggccacaccgccgacggcggcgcagacgacgctcttcttcctggactccgatctgcttccgtccaccgtgctgaatacctgcttcagcgggatcggcgggtttggcccggcaaggctgtgggttccgtacttgtggagcttgaacacctcgaggccgttgagtatggcgtcgaagtactccggcctggagctgaggtccgggtgcagcgccaccagcagatccatctggccggagcccgccgtgacgacgaggtaatccgtgtacaccgccctcccgatccctccgctccacactatcacgtccatctgagactgcgccgtctggttgttgatgtagatgaagaatgatctctggttcaccttcgttatcgggtactggatctcgcagaagtggaacctgaggaggtagtagaagccggcgtcgacggggaggatccaggtgaggttgtagttgaggttgatctgcgcgttcgggcccatcgacctcgccgtcgcgtacacgtcctccggtgcggcgtacttcggcaccgacggcgggttgtaccggacgctgacgttgctgtccttcgcgaaggtcacaccgaaggccgcgccgaagatgtagggcgcgtcgttgtcccacgtgcggtagaaaccgccggcgtcgtcccgtggggtgatggcctcgccgccgacgttgaggcggtacatcgtctggaacgccgtgtcggcgcggaggggcatcgggttcgggcgcccgccgttggcgaaggcgggcaccggcgtcgtgaacatgtccggcgtgggcacgacctcgatgccgttgacgaacgcgtagtggtgggacccgtggccgggggcgccacgcggcgagggggcgaaggtgacgttgaggctcgtggcgccggagctgacgttcagcgagaactcgcggacgatgtacgcgtagccgaccgcgagcgcggtctgcgacgcgttgaagtcgcggaggagcgtgatgccgcccgcggtgacgccgaacagcgcgtccgcggcggcggcggcggcgccgaggttgccgtaggcggacgggtagaagtagagacggaggaacacgcggccgggcttgacggggaaggagtaggtgtagctggagctgaacacgcgcgccgtcatgtacggcacgggggaaggcagcgaggggtcctggtacgacgcgtcggccgcgacgccggtcaccgacggcgcgaacgtggacacggcgtcaccgtcccacgcccggccgtccccgtcggtggcggaggcagacgcgccgcagctcaggcgaatttgtccggggacggtggtctctgcttcgccgctgccgctatccgccgcggcaagcgacacgatggccagcagtaagaagagccatcggaacagagtcgatcctgccatgggcgggacgagtatatgctgttcttgctggattgggtaattgggtaggccggcgtaaagctcaaatcggcgcgcgcagcggaagatcgagcgtggtagttccttcgttcttgctggttgggtgagtgcgtgaaaactttttgtagtggtgagctgatgggatcgcgcggggggaacaagaacggctgtggtgcaccgagtttcccaccctggcgcccatgcggctatgccgtgtgcttcgggttactcattcggcggagacgcggattcggccctgcagtacacgcagaacgatttggcacgtgccgttcggcccaggatagatttttggcctttggggcgtttgctaggagtactactgatttaaggacaaaataaacaggtgaaacgaaccacttcggttctctttaatagtatttgattgattgaatcttttctaaacctagtgggatgttcactcttgtcccctgaagaacaagtaaatttaattatgaaaggaaaatcaaggtaagtgaagtgcatgcactatatatatctgaacttgtttttttttatatttttcgctatttaaatctaatttaaaatatatttagcttgaagagaaggaacactgcccttcagtttcaattggactttgggatctctcatggtcagtagttgtaatagtacgaatggtcgcagtttattgggaggttccacgcgagataagtttacgtgacagtccctcgccgcttctgtcccaaaagaaaattttcactgatactaaatgtgtccactcctattttgacattccagcaagaaacttactgtactactccctccgtttcataatgtaacactttctagcattgttcatattcatttagatgttaatgaatctagttacaaacaacagcataagaaaaaactggcggcttattgtactttgtgctccctccgtcctaaaataagtgcagttttagcactatttatattcaacgtttgaccgttcgtcttatttgaaaaaagattatgattaatatttttattgttattagatgataaaacatgaatagtaccttatatgtgactatttttttaatatttttttataaatttttcaaataagacggatgatcaaagcgctaaacacggatatatatggctgcacttattttggaatggaggtagtacatgatttgtcttactgggtccaagctgccaagctgatgctaatttttttccacggcgtgtgtgcacctgtacctgtgcaggcagtaatcctgcgcccatttccacagaccaataggatcgccaactcgcagcagccgaaaaaaaatatatgctaaaatagtcgccgaatcctccgcggaacacaccaacgatcatactcaccgtgtcaattaggagtagttgtgaaaataacttatggataacaagtagcctccagtagctaagaggtatacagttcatcaccagcggaacatcattgaccgagtctccgatgctgactgctcaatttctttcttggtagttcgatgctgacttatcttagtcttctgtagctggttcaaagaatgtgctttcttagctactaatggttctgtatttaggtggtgtttgaaggtcgtgaagatgaacatgaagataaaaattaagttttcatgtaaaacgaggtgataataacgtataattaattgagttttaattattacaaacttgaaaaatggattaattgagttttaacgtatgatcttgtgttctatatagaaagttttcgcacgaaacacatcgtttatcagtttgaaaagcgtaccacaaatatccaaaagtttatccaacttttgttggagaaaataacagcgccttaaacaaattttcaagcgaaactattttagcgatagcgacgagtttttgtttcaaggaatattttgttttgtgttacctaggctgctgtttggcttgtaaattttaggtttttaggtatttcatccgtttcatattataacacattttaacttttctcctaatcaacttttattttaaatttgactatagtttataaaaaaagcgagtacaatatcaaattagttgcattaaatcaaaagatgaatatattttaatactatatttgtttgttgaaaatgttgctatatattcattaaagcttggtcaagttaaaaaacaaccaaagcatctgataataccaagctgagatagaacttactgtgatcattctttatttatctatgtcaaagtcaggcaatacttttatttgcttgggttgtgggaacctaagataatggagggcaaacaaaatattgagtttatctcttaaaaaagaggattggatctattaactcaatctattagaagccagaaaggaaaggcggatgcacgtgagaggatagggcagtgccatcggctagagaaggagagggtgtatgtcatcttgacccaattagaatgtggattgtgtggcttgtgaaagttgtgtgcacatgtttagtaccacatttctcctgagttaagccttttacgtgaagagaggacggaagtgtacatgtaatggtacatgtaagtgggcccgtccatcaaatgggctgggttgtgcggttttggagggtgggctattacaaatggtattacagcccatgagagttgtgaggacatgtttaataccacattactggttttgtattagtgtaaccaacttataaggtgttctggatggtgggtcattacatatggtatcatagcccatgagagttgtgtgtgcatgtttagtaccgcattggtagtttagcaataatgtaaacaacttataaaatcttatccatccaatcatatcatattaacccttttaatgaaagaagaatgaaagtgcaagtaaagtgatatgtgtaaataagcccgcttgttggatgggtttgggttgcgtggttctggagggcgagcggttacgggcaagcaacttataagggcttctacctccaactgcatcaacacttcaaccatatcaagttaaccatattacacgaaacgaggacgaaagtgtaagtgtggtggtatgtgctaatgggcctgcctgttggatagcgaaagtgtaagtgtggtggtctgtgctaatgggcctgcccgttggatgggctagattgtgcggttctggagggtgggaaattacagggtggcgggcggatgacgctgaggaattgggcgtcggtgcaccgtcacttcgctgattttactgtggggaaaaaagatgaagcagcaatgatgcgagctagtattggatacgaatcagattcggttactatttaagggagtcaaagtgaacttatttctttcattaactagttgggtgcccgtgctttgcaacgggaaaaaaatatgcattaatttcaaatcaccgggtaaaatgatgttatataagcattaagtataatttgattgcaacagaaaaccttgatataacaaaaacaataactatgtccatcttttatatttttttcatacattaccaactagaacaacaaaagtttcagcaagacaactttatatcaacaaaagtttcagcaagacaactttatatcgacattgtaagttgctgcaaagaagtttctgaaaaaaaaaatctgccttactttgtttcttgtacagcttgatctggtttgacagaagaaaaatacaaaatgtaaaaagcaatggatttcgtgagaaactgaacatcatttgattacattgaatattggaccatcaccgatattcaggattcataatcatgcgtcatccattcttccatagctcgcatccctgcagctcacagcgccagcccattcgagcaaactgtgtggctcgccgtgcagaccgcatcatgcacataccttgccgcctgttcctcgtgagcttgttgcgcctagcagtggaccgcctcacgtgccgccggccctcccttactgagccagttgttgataactgtagcaaatgctgtgagctgatgctaagcacaagtataataggatgaaatccactctctttcgttagcccctaccatagtaaaagagaacaacgatatcacatctcatataaattgattataaactttattaaaatatgctaaactttggtgacaatctccagataatccataccctagtcttcagaaatataaagaactaacactcactccttagacgcaatacaacaaataagttgaatgcaaaacatgaagctattcaacttacactcaatgctactgctgaacgcctagctgagcacttaatctcttacactgttcagtgccaccaggatatgctcgaaacagatctatattattgtttaggataataaagttggatagtcatgccatctatgaagttcaaggcagcctatggatcaagaaaaccttgaccttctaagttctaaaccttcacaagttaatggcgcaaaaaaaaggaactataaccatatgtgaaagaagataaatgtcagaagaataatatatcctctttccttgggattaaaagatatattacatccaaataaagtcaccaaaatactattgtgcgtgcatttgtttatccacatctcatatgctttcttgctctggcatgaaaagaatgagaaaaggtttgacaaactgaaacttgcacccaaaaaaaaatggattcaacaattggcataacatggtaattcctgatcagtatgcttcatgaaatcaaattgaatacaaaagtattttatgcaatagaagatctgtatcaaatctggagctgagttctttattaggtacagaggacatcacctcaagccacagtccgcttggctgctccttgatcaatactgtggctatggcttaagaagtgccaaaggcatgtagtgccctaaatccatctaatgctcagcttctcggtctctcaactgatttgcctagctttccctgcacttctacaactccaaaatgtggacacaatcagaaaaatcatgtatttgttttagacaacctgacactgtaaataaccaatatttgatagaaatttaactcaaaacttgataaatctggaaattgcgaagtatcagcttgataatatcatgcataagcatgcaaaatcataataaacgtggcattgtcaaatagaatgtacacttgcagggaccatggaattgactgctaaaaaaggactttcatgtatagacattgctcgaaatgaacggtaccgtatatgtgcagattgtgtactgctgacttttgctcgactaagatttgacgactttgcaagtagtaacttgaaataaatttatctgacatttcataatgcaagaaaaaggcacgtgcatctatgtctgacaatcatttcattaaggcaatcttggaaattatgcttagaatattttgtaaaaaagttggctgcattaaagcattaccattctaatgttaaggacaaaaaatgatatacatattgtcaaactgaatgaagtgattggctagaaaaagaagagcattaatacaaaccacccaaatgtttggccctggtattatatcctatacaatgttagtacagcaaaacctcttttctacagcaccataatcaataaaagaaaaataatctaacagggtcaccaatcaatgatgtcgtaagtcacctgtttttacatttcgtgaggattcatttgaaccttgaacagtgaaggacgcacacctttctgtgggacacttcttgaatcggccatagtacccccggaaggaaaattagaattcatatgaatttgaaaattctatgcaggtttacccagctatctttctgaattattagaccaggcactgaaaaatgaatagacaaaaaggaaatgaaatcaaacaagatggctgcagtctcttataaataaaagaggaaacattttgagcagaaatcgagtaaacattaagatacacagccatagggcctcttgattccgcagctgtctgtaggaggctaggagccaacacacaagaaaataaaaagaaagggaaaatagtgatgctaccttggagatggaggttgggagagattggctgagaggaagccagacctgtgttgtctgcgagcgggagaagacttaatcagcatcttcagtccacggtaagtgctgctagcttaatggatcaccaaaaaacagctttattaaccatcagaaaggtttaaaacaaaatctttttactccatctaccaaaagcagaggatggtggaaacaacaaaatctttttactccatctagctttgatggctaaatctcgcacttgagagcaacaagtgatttgttgtaataaccaggacaatacagactatattggttaataaaatccaaaatggagtctgtttggcaatggaaaacaagcagtcatgtttacaacactttcattttctcataatatttttttgggagaattgtgtttataccccagctttcaatctcaattgtgattttactcagttttttagcgtttgcaattttacccccgctttctctgaacgaagttgccgtttgcccctactatggatggcagttaggtgggtcccacaatattcagttaaggaaagagaaattagaagagaaaaataattttggaaatatgggattaccattgtacccttaagtaatatatgtgggtgtgcatcagtacatgttcgatatcctccttcccccagatccattcccatcccgaagtccttggcgcggcggcgccagaagcaggcggtggagcagctcttcagcgcggccgggagcaggtggcggcgcagctcctcggcgtggccaggagcaagctgcggctccaactcctcggcgaggccggaaggcggcggtgatggctcctcaacacggcgtcgcgagcagcaggaggcggcaggagtacctggcagcgacggcgatcctcagcgctatggcaggagcagcaggcgatggcagcgactcctcggagcggcaaaccattggtgatgaatcctgctcttgacgggttcatcagatcgaaaggacttgaccaacatgaagatacctgatgtggctgatactatgcacttatgcagtaagacacaggatgttaatgaacttaccattcatagacatcattcatgttcatgcaatgtggcgccattagattttcatacggattttgaatcatttcacgaaagctcagtacaaaataagggtaaaaagacaagtgttgtttaaaaagtaggggcaaatatgcaatagctagcaagggcataaaagtcttttcgtgctcgacttaaccccgttaaattgaccatccaaaccagggacaaatctctacttcgtttcaaaaaagtaggagtaaaaacgcaaaccctaaaaagcgagggcaaaatcacaattgaacttcaaaataggggtaagaatgcaatagcccctattttttttgaaggaaattttctgataatttagaaacatacaagacttcatgacattttctgataatctagaaacatttttctgataatcccaaattggtcaatctaaaagattaacacagacagtatatagtgaagaagaattgcagatcatcaaccatatcatgtatttgtatttgtagttctagatacaacatactgaaacactgaataagtacaaacttcttccttagcttgaagggaatcaaagcaaaaaaaaaaaaatccaaaacatgaatccctaaccatcacaagataaatcagttattccatacccaaaatcataggtggtgtagcagaggcggacatcgacaggaccaagatcataggtgacaggaccaattggagagtccctccagactcccggcgtcgacgccgggtgggacggctgatcgcgaaggagacgggcaagacacgatgacggaggtggccagggcgcttcgatgaccggcagcgtggccgtggaggcatccatccatccgttccgggggcgatcgggcaaaaggtggggagacgtgcatcaaggtgcgtcaatgggagggagtggtgtgtgggaaggggagggggttccagggaggggatctgctatggaggtggagcgacgacgagggatcgacagtgggcggcagaagatgggcacctggggatgtggcggcgtcgcgggacggaggtcgtggcgcttggcgaggcggcgctagtgtggcgtgcgttggtcgtgatggaggtgcaagagggcgaggggattggggatggaggcgaggagggactggccgacgtccgatcccgatcgatggtgaggagacgcgacgatgacggcggcagcgacggcaatgcaagagggaaagggaggagaggagatagggcgacgagagggatgatgggttgcgggggcgcggtgctgcgtgatgcggagcaacgggggctaacggaggagcagcgtcggcgggttcgcgagcgcgagctgccttgtggggagaaaagcgagtcgagggggaggaccgtgaggggatccctcagggaggggatgcatcgcaggcggaggggaggagcgcgtgcgatgggatccctcagcaccgtctgatctcccgatcccatgatccatattccgcgtgtatggagttaccgtcaccactatagattttttaagtagtagagaagagatgttgctaggccttcttccattggaagttaacgggatctgtctgttgggacttgttatatcctcacacaaagatatccttccacccggagatagataagtgttatcctcacacatacgacccacttcttgtcaaaacgtccaatgtggagatagacaagtgttattacattggaataagttcaccggaagtccctcaacttaacagcgagattttttgaggtctcttaaccacaaaaacagaaatgtctacccctaaacttactcaaactgttcaccggaggtccctcggcagtatttttgtccggttttgctgacgtggcatcctagtcagcaaaaaaaataaaaaggtacgtggggcccacatgtcagctgcacatattttttcttctcttttcttctccttctcttctcttttctcttctcacctctctcttctccttcaggctggcggcgggcgcagccgcgatggccgagcgcaacagcagagcggtggcgggctgtgggcggagcagacggcgggcgagcccgacagtggagcggaggcagcggagcgcggcggcggagcggaggctacgggcggagcagccgcgcgccgtggccgccgtcgtcgttggctctccaccatcgtcgtcgccgtgggcgaggctacacggcgcggccgttcggcgacatcggccaggcgtcgcagtggccgtgcataggtggttcaaagtgccggctgatgatgcaccccagtcgctcacgctcctcctatgccgcggcagcggcagtggtggcggcggcagcgtcgccagcctgatcccatggtcctcccggacgcccagctcgcgcagctgcagcaggagcgtgtccacgctcggcgtgccatcggcgtcgtggacggtggtcggcgcgggcgcggtgaccctcgtcgtcttcgccgacctcgcggtagcacttgacgtcgtagctcatacgcatatacgccgggtacagacggccgcatgtacatgcgtcttcgtatgagcatatatatgcatgcatggagacgaccagctatagcctagctagcttcttgttggtttgccgcccgataacatgcagacgtatatattagccaagcatgtgtatatggctgagcacactcacatgtatatatgccattacgtgcagcggaggagcgtggatgcagggggtgcagcggaaggcgagcgcggcgaggagcggcggcgggcgagcgcagcggtgggcaaagcagcggagggcgagctaggcgaagcggaagacagtggaagggacgaggagctcccccgtgctcggtcgccaccaccgccgtgcccccgcgggtggctgacgatgctaggagaggcaccactggcgggaaaaggggaagaggcagaggaagcgattgtttcttggtcgccggccgcctccccctccctcccaaactcgctggtcgccgcgctcactcgccgccgctccgccgccgcgctcgcgctccgctactctgtccgcggcctgctcgcgctccactgctcggcccgccgccacgctcgcgccttccgctgctccgttgaggcgctcgccctccgctgccccgcccgcatccgtgctcgccgctccgcccgctgcctccgctccgccgccggacggccgcgccgcgtagcctcgcccacggcgacgacgacggtggagagccgacgacgacggcggccacggcgcgcggctgctcagagagaaaagaaaagagaagaggagagaaggagaagaaaagaggagaaaaaagatgtgaagctgacatgtgggccccacgtgttttttttgctgactaggatgccacgtcagcaaaaccgggtaaaaatactgccgagggacctccggtgaacggttttagtgagtctagaggtatacatttctgttttgtggttgagggaactcaaaaaaatctcactgttaagttgagggacctccggtgaacttattcctattacaggtgttacgcaaacagcccaacccacccgaaagaagcagcccacatcaacctatttttgatgggtctatgtgggttggtcgtgttagcctcaggcccggctgttttgtgttacaaagcggaagctaagcttcgctcgttgaaccaggcgactccagctagcaacaacagatttgctggtagtaggactgtaggagtacagtgttcccatgtctgctcgtgaagccatccagctgtgtgccacgtcaagatgagtccatggcacgatggatccaacgcgctgtttcgtcgtttccgcgcggtggagcccacctgcccaacggctgcaccactgggccattgccacggaaaagccactactcgtacaaaaaaaaaaaaaaagaggtcccgtctccgccacgctggtggctctggactctggtattccccagccggtgggccgtctcgcgtaccggttttccagaaccacccacggtttcccccccttcccccactctcctccactttccgcctccgcaccacgtcacccccgccgctgctttgtcgcctacctctcccccgcatggttatataccccgcccctgtccccttcacggttacctcctcacttcactctcttctccgaagcacaagcaaaaaaaggttgcaaagccaagaaaagcttgggagattctcgatggcacggtccctcgcatgcgccttcttcttcgacgccgagccggtcggcgagaccgggcggcacgcgctggacgcctgcgcgctctgcaccaagccgctgcgccgcgatagcgacatcttcatgtacagaggggacacccccttctgcagcgaggagtgccgctacgagcagatgcacctcgacgccgcctgcgcgaggcaggccgcgagcgccaggcggaagcagcagcagcaggggcagcggagcaggcacgagaccgcgccggcggcgcccgtgtcccggaaggcgggggtgtccgtggcgagctgttgatgagctgcataccttaggtagacgagcgtgagcttgcaagatgtgatgaaggagttgttcttgctcatgtctggccggccgctgtgccgatggatggatctggtcggagtcgaagcagagaaaggacggatctgaggaagggactccgagattcaccaggcaccatggtttaatttaggccatgtgtgcttctcttttttttccccttttggttggctccttttgtatgaggagctgatctgagttggtgtgaagagcaattccgctgtaaatattcgaggcattccgagaagttctattgagccataattttttgagcagaatcatatttgtgtctactcttttaggagtatgaaacacccgtgacttttcataatttgagccctcataaaaaatctgtcaaacgctgcaagctctcaaagcaagtctgttattcgagcaagtctgtttattcgtctgctgctttgaagctgtacactttaaactgttcttttagtgaacgagcggtaaaactgttttctccttcagtctggcgttgtttccatgaactggtagtaaacgagaacactactgaagtagtagtactgatcatgtgtgccaagaaagtgggaaatcagctgatttgatgctaattgttgtttttttaagtagaaaacgccacgtaaactgctgcttaagaaaattggattatcagtgggcgaggtaacaaccacttagacaactaaagaaaagaccaaagtggaggaaatgataggggctccaacgtcagatccattgaacgtttcaactcctctgctcacaccctactcatcaccgagtcacgctgctgagtccaaataaagcgatgcgtcacggctttggctggacctactgtagtaggaccgaacatgtgtccgattgctaccaggcagagcgtgactcggtgcggatgcagcagcacgtaacgacgccgcccacgcccatcagatgcagcaccactttttattatgtgatccccactcatcgcccaacatctgtgacccagaggcgaatacttccaatcgacaaactggagggacctgtcctgctaccgcgacgtagaaacatttctcaccacgcatgctgcttaatctgtgtgaggatagcacaaattatgctggttgtacctcactaatgaggattttagtagtacgggcgtatctccatcacgagatttacctcgcaaaccccgatgattacgtgcaatgcttcagtgctaagcctagtgcacttaaactaaacagcgcgcggatctcgagaaaagctgcctcccaggacgaagcctgcctgcctgaccggccggcaacgccatggatgccacccatctctcccgttttcccgggccgagggcagcagccgtaaactaccaatggaatctcgtggcgtgccaaccgcgagtctgcgaggtgcttcccccactgaccacttctaccgctgaaaaaaacgtgctcggttgccgaggcgaaacctggcgagatctaacggctaatgaaacagcaaatataatcatctgcctaaggggctctttggttttcagggacttggaataagtccctctcacatcgaatgtttagacactaatttagagtattaaacattcactaattacaaaactcattccataagcttggactaattcgcgagacgaattttttagtctaataacgacatgattttgacaatgtgatgctacagtaaacttttgataattatagattaattaagcttaaaaaattcatctcgcggattagctcttatttatgaaattagtttttttattaatctatgtttaatactctaattagcgtccaaacatccgatgtgacatgggctaaaaagttttaaccccatctaaacacccctaagtatatgcttctctccaaagggttcactattaaaaatcaccgatgctgcacggttcgcttgcaaagaaggggaattagtacgtagaatacgtgccaacttgcggagcatccaacttgctgttcacacggtgctacctggcgtgcatgcacgcgccacactcgcccaagattcccatggagcacacaattaaaaaaggagaaaaagaaaagagaaggccctgaatttcctttttttttcttgaaagctcacgtcgatgctcactactactatggtgctaggtggggcaaaccaggcagtgggggaagggaagcaattgccctcaattattagagcaggtacaatagtaggctataagtcagctgcaaatatattttaagcagataaatgaggagatagaagggcagcgggctacagatttgtagctagctatagcacggactccaagacgcagcgtgtgtatgacaagtgagaccggatattaatagtgtactatgtaactattgtataaatgagctattagattgactatagatgaattgaagacagtagtgggctatagtattaaacttgctcttagcgtgccaaaccatgtgcgggtgcctgcccgatatgttggcaaaaaggctggcgcgctaattatcaaccctaaggcacatgattagtttataagccgctgtttagagggccgtgtaatgatgtagatttgatgctgatgcacacgattccgactaagagagccgcgccaagtgctttccgattgattattgccgcgaatatattgttgcacctcgcttttgctgcagaaagcgtagcaagccgcaagcattatcaccacttgctgatagagcagtgagtaatggcctagcccacggtttttgggcggtactgagtactgactccacgtccctgtaacaacaacagggacgtctttggtgcggttccccccccccccccccccctctagattcctgtcgttctcgtccgccacgtacttgacgctgcccatcaaggcagccaagccgaacccaacccaaccactacacggcaccgtggtccaggcccgaattgaaaaaaaagtgagacaagacgaaccgccaccatcccgcctccggttggcgcgcgaacccgcctccccgacccgtgtgccgtctcgcccgcagctcggcgcggaaccacggttttctcccctcccacccgcccgtgcgcgacgcgacgccccaccgagctgcgcatataatccccgcactcccactcgttcgagctccaccaacaactcatcgcctcgcttcttcttcccactagccaaaagcacaaaccaccgagaaaacgcttctcagataaacatcatcaccatggcggcgtctcttgcctgcgctttcttcttcgacgccgagccggtgggcgagcagggcaggcacgcgctggacgcctgcgcgctctgcaccaagcagctcacgagggacagcgacatcttcatgtacaagggggacacgcccttctgcagcgaggagtgccgctacgagcagatgcagctcgacgcggtgtacgcgaggtcggccggacggaggcagcagcagcagtactccgggagggcggattcgcggcgcgggcaccgggagaccaggaaggtgtccgtggcgagctaatcaagctgcgtcgataatataatgatcagctgagaagaattggcgttgaatccagacgagatttcaagagctaagccacgcatcaacatgcggcgacgaaggagattgatttctccaaggccgcgatgcccgacggcgccggagaagagtctgaggaagttcatcggcaagatgagatctttgccatgtgggtcgctcgggtcgaccttgtcttggctctcagattggcgcccttttgcgggtcgtgtcgcgtttgtgcgccagcgtgcgcgttagagcctgagtgtatcatcactttgtaaatccaaagcagttgggaaggctttaaagtttccaagttcctacaatgcaatttttttagcagaatcacgagttcaagtaacatatgatcgcgatttcaccgtactctaatgcaattagggtatgtcccttatgaatcaatttgctgtggaaaatccccaatagatcagatggccatgggaatcatcagagttgtgatgagaaaacatagctaccccaacggagccgttcctaagatttttttttcatccccagttacagtttcaactatttacgagaacaatcaatctcgcctgtgcgtgtacaggtcgagactaatttacgagaaaattaggttcacctcgcaaggaattactgcagcaaaaatatccgttctccagtttctgttgcctagctttcaccgaaagcaagagaaaactccagggacacagcgattcaggcagcgcgacacgtcgcggacggatgcatgaacccaacatgtgtcagaccgctgaagcgggggccgtgacagcgcatgcacgggcaccgtccatgcccgcccctgcccgtggcagcgacaattcaaaccatctcctttatgcagccattcgatgcattccactcatacaatacaatttcctgccaatgtgccatcctgttaaagcatgtacaatagcagtctataagccagctataaacatattttagagagataaagaaaaagagaagagcagcggactacagatctatagctatagccagctgcatcacggactctaagacgtaatgtgtgtatgatatatgggatcaggtattaatagtatagtaaacaactattgtattaattggctatagatgatttggagctagcagtgggttatgctattaaagttgctcttaggcctctcgaggtgaataacgccagaatccgctttgcgcttctccgtgaagttgcaggttaaaaaaaaagccgtgcaccaatctcgacaatggccgctgcctgcttcccggaaagaggcctcgccggcaacgcgagaccccattggctcccgtacgtttctctgtgcaacaaattaaaagcaggcgtgcaattgcgcaaagaggcgtactactagtatttgtcgagccactcgagtgtggggagctagctagccggtgtttctcccacaagccaaaacaaaagctccacccgcggttttcccaaggcgcaacctggcacgctctcgactaaacaaaacccgcccagcttcgagcgcaaggctgtgtgtgtgagttgtgtgacccatcgtgcgttgatgcatacgtgtacggttgttttgcttgcgtctcgcccggaatctgcagatgcgtcaagcgtctccgcatcactaggtgtgtgcttctgtacatggcgtgcagcaccaacatctgccatgattcccgtcgtttggaggaggagcttagctccacgattggcctattctggaatctggacacaccgttgcagtgtgcgtgcctaaccatgtggtgctgccgtctgattcgtgggcaaaaggctggccatctaggtgccctactcaatttttagtttctggtgttcaacgtttaaccgtctgtcttatatgatttttttataattaatatttttattattattagatgataaaacattaataatactttatacatgacttatctttttaaattttttcgtaactttttcaaataaaacgaacggtcaaatgttagtcacgaaaacctaggaattaagatttttttaaggacggagggaataagcattatgatttgggagtgtatgacggttgcctacttagtttaaggcttttaagcaaaagtttagaggctgcctaatcgtacgtgtagattcgagcacatgactccatcaccaaacgcatggatagttaattcgtggtcttctatactcctctcctttgctgggaaaacagcagcaagggctcctgtttgtccaagtaaattaagcagaggggattagttgatgtgcaagtaaagaaaggaattggtagaagcttgattactcatgttggctaagcagctggtacacgtgtgccggcttagatctagcatgcatgtgcacgagtctgagtcagcaatgagtatgatgtacgacgagtcatgagtaggactagccagtgagagcctcccgcctaagtagctggagacaatgtgcttatgaaacgatgagctgttgttgtttggttcatgctggttaatcatacagcgaaaagtcaatgccaccagacatgtgggccctgttagtggttttagtggcaacggcccgcatgtcagtctaaagtgtgagtatgaagatgagcgttggctgaactgattagcctcacgaaaaaaattgattaccatataattaattaagtcgtactccctccatcccataatatatggcatagtcaaacttggcacagtcttcaaaattaatctctgacatataatttttcatatactataaggattattgcaacaaaattataactatcttaaagtaaatttaaatgtcaatccaatgatattaattttagcaaataaaatttaatttatattattataattattggtcaaatgtttttaaagttgaatattggaatgtgtgcacaccttatattatgggatagagggagtactatcttttaaaatattaaaatagattaatatgatttttatatatctaattttaaaaaattgtaccaattagcaagtcggaaaacatgcttacgaaaagtgaggacacatctaattcaaatcacccttgccaaatgtgccctagcattagctaataattttctcaaatgttgattcattcatagtcatcatttagaggcgagtagttatttttctttcaaaagaacaatatcgggttcttctacaggtatagattaatgaaatccacgtttgtgcctactcaactttctagcctcttcttcccccatgctcttcatcgcgtcctctccgcttccctacctcctcttcctctttcgttccctccgggccaatagccaccgtgtgcatctggttttcagtgagctcacccatcgctgtacgtggccttccaccaccgccgatcacacctcgccaccctaaggcaatcgaggggccacctcgatagtggacagcaccgggtggagctgaggggcgggaggcaaagtctgcttgacggagatcctaggcgaggagatgggaggtagccatcacggcagcacacctctttgtgcagtggggcggtgtaacggtgcaccacattaacctatactatttgatatctataggtaacgactgatacctagagatatcaggtttggtacgaggtactatgctaggtctggtaccttggcggcggtgatcgtaccatccatccggtaacctcgagcacgaggcaaggggacgaacttagtgcatcggcatttgtggctgtagagaggggacatcaatcatatactagcggtggtgggacaacgctcgtgtccaactcgaatgaatggaaggggtgcacaccgccgagggcgacgacgcaagtgcctggatccttggtcttgcctacaggcagggttggagcaccgctggtttgttccttttgtgcatttgagctcgggcttgtggaaatggttatcatgcgagtgtatgggtattatatttattaactatgtcattcggattgcattaagtggtctagcaatcctcgttttctttttaagtacatcaaggcacaaacatttagctcggatttttacccacactaccacatatctacatacaattggaaaagtttgaggcaccaatagtctacccatcatacacgtacttctacatttgtgtactaaaatttttggacaccgctgcaatgtgtctgtttttattttgagaaacgctgcagtgtgttagtttatcttctatctacaagacatcctcgacatattaaaacattagtagttattatttgggatttcttcttcacataaataaatgtgtagttaaaattaaatattgtacgggagttgaattagtttgtccagagaacaaaatattgacctgttttctccgtttggttgatgctaacttgagtagctaacaccgcatcaagtttatgttgggtagttgagaaactgaatccattgtttgcggtagattttttttttaagataaaagaaaatcttgtcggttgtcataagaaattagctagagatgctacgttttcttcccttcttcttgactatcagaaaactgttcccgcagtgtccgatcgacttttttttttacaggaatctttattggcgacaattggatgatacccttgagtattttacttgattttttaaagagaagatatagttaagtaaggccacagtttccgtaggcacatacatctagcatagattgagtcactaatatactgtggaaattttctgtaactgatgttcgtacgaaaggttcttctaaatattcttttttgggagggagaatatagaggttcttttgtgcggaatttaagaatctttattggtcactggtgactcagccagaactgtttgttattgtttttctttgagaagaagaatctagcatatataagccatcgcaataattttgctgttgaataatcaaggcagtacttcaccattcagtcatctagtaggcttggtcaagtgtgactgcatgtacaaagaattgttttcatcatatcatagtccaatcttttgacaaaaggacgcagcttcgttcaacatcctgaacattgttctatgaattctttcactgaaaatgaaaccacgaatattgctctctgcatgcattctagcctcctctgccacttgcgactaggtgactagaaggtttcaaagaagtccagtaattaagtgactaaaaatcaactgtgccaggttaagttatgggatcagttcgtccccaaatcatccatataaaacttaacctggcagttcatctcggacagcacggggtcggcatgttgaaaattcagagccgtccatgcttgagaggggaggggcccagatacacaactgcatgtcgacatgctgcatttctgcgcgttcaggagcgcccttttccctgtttgtgaatctagcgattttcaggcttccgtcgcgcgcgacagcatcacacgtcgtaaaagcaccagcaatcggcagaaaacaaactgtggaaaaaaaggaaaaaaaaaaggcaagatctgaaggcgacgtacgcccacgatacagctagcgttatactgcgtgcggtggccactggcttccgccggtgacactgacgtgcaagtcgaaacaaaacacgtatccatcaagctcgtcgatgaaaccagcagcgactaattaatattcagatgtcgcttttgattaaaaaagggagaaaattctgggagcagaaaaaaatcctacaatttttagtgtaggaataaattaaaggctctcgttttatatatttcgtgtgtgaggagtgaagtaagcacaaaaaactggccaatcaatagcactaaaaaatccatcaattattgacatcattaacatggagacctactccaacttaataaaggtggttgatgacttggagttgcctctgatttctgtataaaaattatcagtggtgagaccggttcgtactgtttgtaagagcttgatggagagagattcttttttattatgaaaggtgtcatccaatgtattgggtgtcaaagaaagcgaccttgacaaggccataccgtatgtatgatgtataagcaatcaataagttttttttaaaaaaaaggaactttacatggaagtccatgtaatatatatatatatatatatatatatatatatatatgtattccaatctgtcttcaactttcttgtatttatatttaagcccttgattttaagctttacactaacaaagtttcatcttgtttatcaaagatatagccttttaacaatcctaatagtttcatgtggtatgaggtatggtatagtaaattaacaataaattaagagcctgactagaatgtatttctatagctatggcttatgtagccaaacatgcgtgatcgatcaactaaaaataatttcgagggcaatactttcatacttctactcttagactcctagattgattctaaaattaagttctaaaaggagttggaatagcttcaaccattggagggaagaagaatgagcacatgactgatgggggttgaaattggaaacatttttttaacatattcatagcaaaacttttgtagaaatagtcccctcaaaacagcaaaaataacaatacaacttttatatcgtgactccatttttactttgtgtcacataagctaccacgcaagatgcttcacacatacgctagttttccacatattcgtcgtaagttgcatatatgtcataaattatgtgacacaatgctataagcgttgttcttattatcgtttacttgttagtttattaaccatagtcaaaattaatttaaatttttaaacttaattttagagttagttttgaggtttatcattgtagcttatttttcaataccataaattatttatggtttcgttgtatatttttccacaacctgtcagacctagagcaaacgacgacaatttggagagatagaaattgtaaaaacagcactcaccaggatccatatgcaaaataaaacttttagtagtgggggactagtggaaacactgcaatatacatgtcattttttcggtttctatacttgaacaaatgtgtcacgttactccaagtagctcgtagaacctcttttaaaaaaaagtacggagtagttcgtagatttcaggttatataagcaaccaaaaacaattgatccttttggctactactcctacttgcatagttgcccttcagtgcctatcccccgccacactcatcagtctcacattctctcatgcgaatcatgcaccaatacctttatcgccctagttgcatggcacgcttaaaaaagaggccatcaacacagcacacggtacatcaaaaacgacaagatagaaaagcaaaaaaagaaaagaaaaggcgacgcaaagtaggggccaggccctccaattggccggtttctttcgagtaaattaacctccgagatcgcaatttgccgggtcccccaccttcctcccttcaggttgagcagaattgtcgtcaaatcaagcagctgcaccaccggctgcgctgctgtttggtttttggttttgggtggtgagatgagatcccaagcctgatagcgatcaaatgcgtaaggcgaatgcggccaccaaaaaaccaggagccaaccaccggccagccactagggcgatctacttgcaggcagctcagctcagctcagaagaacctgaattgttcagtccgtccaatcggacgtgacatgttgtgaacaagaaactgcgtgatttggtgagaaaaaaaatacgtgcacctatcagacggttggtttgataattcgagtcatgagacggacaccggcttgcttgatgagatgaacagtggtacgggaagtagaacaatagtgcggccgggcccggaccactaggctgattcatcgcggcagcaacggcactcaacgatgacagccttgcggccgtgcaacttgttggtcacctgacctgacgccttctagagaaagcgagtttgtacgctatgttacgcgggtccgattaataaattcccctttaatttgctgcccaggtgaacttaggagtactttaaatcgatatttgtcctactcacaattttcaaatacaaatatgtataattgaactttgagatgatttttttcttttcatttttgcatcatacggaagacaccctttccatgataagacaaatttaataagtacagattatagcacaaatttgaatttacactatctttgttttttacgccattgacttctgaacataggattaaccattcatcttattaaaaaatattaaaaaaatattgtgtaaatgtataatacccgtacattgctgataaaaaatgatgcaaactcgtgtgttacagcgggctccaattatattaaatgaactgattaaaactaaatcatcactctcaaactctaattaacgatgataggataaacagtacgttgtacactgtacatgaagaaaatagagcttcttactctagtacatttctgataaaaaatgatgagcccatatgatagatggtgatccttgcttgtcagataaatggaggtggcaggaccaccaccaccagaatcttttaagatggtatagataaatcatattagagaacttttggtataaaataactcatagcaaaataaataacagttacttaactttttaaataggataaatagttaaacatgtattcaaaagttaacaatgttatgtactttctttgttttatattataagactttatagccttgtccacatatatacatgtgttaatgaatctaaacacatatatatgtctagattcattaacatctatatgaatgtgggtaatatgaaacggaggaagtattaaaaaacgaggtagtacaatattactctctcttcaatcatacatgagatatgcacaatcagacacacaataatagtacaccctttttaaatatttacattatgtatgaaaggtgcccacgcactgaaccagaagttgttttttccatggtaacacatactccacataataaatatttttagacaacaacacaaattttagtgtatacattattgctttcttttcgatcatacgggagagatgcacaatgacgcacaccataacagaaccacttaatttgttttaaaattcgtatatttttcgtaatatttgaccatggcccaattagtaatcgtgtgactgacaagtgcatcaaacacatcatatgtggaagccgtgctattggtctctctgtctcaggcgccatttcttttttacctctgatagctagtgcttgttgttttccttggtgccgtcacggagcaaatacaactctacacgctcgaatagagattgagatttgtgcctaaacaactcggcagatgttaacttcgcacttagatcaggtataataacagaatataaatcagctataaaaatattttaaaaagataaaagaagagagaaaaaacatcaggctatagatctatagccatctttagcacggactccaagacgtaatgtatgacatatgggaccaggtattaatagtgcagtaagtaattattatataaattggctattacattagttataaatgatttggagctagtagttgactatactattaaacctgctcttatgagcaaggaacatctgtgttcgttacttgtggattgggaatccatctccccgcaaggaaaacatagcagtctattagcatgtgattaattaagtattagctaatttttttaaaaaaggattaatttgatttttttaagcaacttacgtatagaaactttttataaaaaatgcatcgtttaacagtttgaaaagcgtgtgcgcggaaaacgagagaggggatggaaccggaagttccaaacacagcctatataaaaagttccacaattatcccatcttacaaaagagcccaatgtagatgtagatttcagtaactacacaaagccaaaacacaccaagtcccataaagaaattcacaaaacagtggaggactaattcggaaatctccccttcccgtccatctccctccatgataaaacccgagttgcttctcccgctccgccatcactcccctttcccaaccggaaaaacgagaaaacagagagagctcatttgccgaaggccgaagcaaaccaagccaagaaatggcgcgctaccaccccacctccatccacgacgacatcgaggccggcttctccggccactccgcctcccccgtgaagcccgcggcgtcgcctcggcggcccggcggccgcctcttctgcgacccgtgcgacgacgccgacgacctcctcggccaccaccactacctcgacatctgcttccgctgccggagacccctcggaggaaacagagacatcttcatgtacaggtaaatattcagcacaactgtcgtcagtctcttgacaggttaaatctctctggaagaatgtgtttctaatggcgttgtgattccttctgttcttgcagaggtgacatgcccttctgcagcgaggagtgcaggcaggagcagatcgagatcgacgaggcgagagagcagagatcgaagcagacggggagggcagagcaggagaggcagaggcagcagaaggcgagccacccgaggatcccggtctgggcatggtaaacaattttggtcacggaacagtagatcttagagaaactcaagaaccgaaaaaacgaggaggagatcgagagacagcttgtccatgaccgtgtgtgcggatggagaaagatccagtcgagcgcacgcggatcaaacagttccacgggaacgaaagccaagcccggggaagcagaagcaaaccggctgcgtctttcttttcgcgatgaaattgttcggttccttcctcctgatctccgcaacaaggagatgaggagtcaatttggtgtgtgaattttactttcttggcacggttgcaaattcgcaaaaaaatatggtgcgtgcgtgcagccggtgcagcgttttgtgtcattgtgtgtgtgcttgtaatgcaacctgttgatatggaaaaagtgagtggcgtaaaaagctctctccgatttctcattagttcggtcgatttccttcctagtactccatgctgtgttcgttgcgtagcttttttactacttgctccgtttaacaatataagactttctatcattgtccatattcatatagatgttatgaatctaaacgcatagttgtgtttagattcattaacatctacttcctccgtttcacaatgtaagtcattctagcatt

SEQ ID NO: 58572 - DNA, 14567 bp, Oryza sativa
aaatgctagaatgacttacattgtagaacggatgaagtatatgaatatgggtaatactagaaagttttatattgtgaaacgaagggagtactctactagagctcacgctgcagctacaattagatgttctttttctgatgaaaatacagttaaagcggccattattcagttgccctctgaacagaattcatactgtacgttcgatgcagaaattgaatgtcgtcgccgcctgctataccgtgtacaaacagtagatcatagacatgttggtacctcctgcagcagctggtccgtcatcaatggcagaggtaaattgttcgttccgttcctcgccgagaaaatatcggccctgaattgtagtaaaacagacagtttgctccacgacgaaaaagtcgggaaggtaataaagaaaggaagaaagcaacgcaggctttgttattagtattgtcattcgtgcagccttgcttcccggaaacttacacgaggtaaatggctatagcaactactaagtactagcagttggacaatttttatctcaaagcgttgcagacacagcttctccgtatcgtttcctcaacaacactgcctgacaggcggtccacaaaagaaaaataaacggagggcccacatgacagtctcacgtatacgacctaagggcaaaatctgccggtacatgtagccatagtaggacactaacgttttttctacagcagatgatgtcacgcccaacgttgttcaccatcaaccgaattaaactacgcaaagcatgttggcattagtgcgtactccggactttaaaaagcccaaacaaccagcgataacaaatcaatcatcctcggccacgccgtggatttttttcttcaccgttttctgtggctccccaagttgcgccccatgtgcacccgagagaatccttttaggcaatctagggcctttggcgacacaaaaagaattcccccgattccccctcgccacgttacgccttctccgagccagcgagaaccaacacgagcacttgagccgttgagcgagagacgagcgcatctcgccgtgtgccggtgtttcggggggtgcatcccgcacgcacgtgccggcgccgcgcccatgcgctgtggctgccgcgctcctgccccctctgctcgctacaaccatagcagagaccacacaatactatagctctctcaagtctcacccatgtggcgctagattaacctgcactactagtactaaccacgccaactgaaaacggtttagcgaagtcgcggtgaaccatgtggtgcatatgctactcacacacggcctgcgcctgcatggaacaatgatgcaggcacggctcgcgagagagagagagagtgttgctgtggcgaagttggctactgttagagcaagtttaatagtatagccaactaatagctccaattaatctatagtcaatctaatagcttatttatacaatagttacatactacactattaatatatggtcttatctgtcatacacacatcgcgttttggagtctgtgctacaactagctataaatcagtagccagctgttcttctctctccttatttatctccttaaaatatgtttgcagctggtttatagcctgctattgtacatgctcttacctcagctcggctggacttgggccaaaatgtccctctcctagcggaggaaaaaggtggatgaatagagagggtgattcttcccggtgagattagctagcggcacaccggtttcaaaaaggttgacgtacgctgttgctgtcgtgtcaatagtaacagacgccagtgaaggtgacgagaaatgttttcttcttcagagcgttgttgtcaagaaaatgacctcggtagtaaatggacaagtgggatacgtacaggtaggatctacgtataatttctgaaagacatgttgatcgaggtgtggtgtatgtattcacatgtactgctagcatgttacacatgtgagctatagaccaatgtcaataacataatagtgctcctacttcagtatatgctggtagtagtaaattatacgcacacgcattttcaagaaagaaaaaggaagaaaacaagattgctagggtggcaccgaccgcgtagtacattggagaatgtttcttgcaaccacgacagattgacagaatatactactccataacttttgaagcggcagtaaaacagaagcattacacgttaagaaagtgctaagtaaacaagactgcctgaactccataatcccttttttttcctgcccaaacagcatactgattgttgaggtaggtaaacaacctccaaaacagcgtacatactgcctagtaactatctgtaagtaagaatcacgtgccaagggggcatccacttcatgtcttcatctctctgaacctgcggtctatgcgctgtttttaaattttagcccccgtgttcattgtccctaagaatgatctcagacgccttgattttaatggctcccatttcctcactaaatctccaatggccagtagtgtgttgttccaaattttgcagtaaacaagaatcacaaaaccaaacaaagtatacgcagatttttcacgcgtgtcatgctccgttgattggcgtccgcttctattcataggtttgccgtcggacgctgccaattcccagcctctccttgtctccccgaggctaaaaatgggaagtgccggcgacctatttgtacattcctccggcgaaccggagctccgtcaagccagccgagatccttgacagtgcagtgccaagactcgggggggcaattttgctccctcttcccgctcgtgcccaggccggggccttgcttgctagctagctttgaagccagccagcaacgccgccgccgcaggcatgaaggggagcggtgcagcgatgccgtcgtccatgttctacgtccacgaggcggacgtcgcccaaatccaccacttcctcgaggagtgctccctctgcggcaagtccctctccggtgacatcttcatgtacaggtttaaagctttttttttttttgtcctctccctcctttcaccgcgatgcatgcacgcaaaagtttgttgaggttttgtggcgtgggtgcacaggggagacacgccgttctgcagcgaggagtgcaggcagcagcagatcgaggtggacagggcgaagcaccggcggaagaagcgtgcggcggcgcacgcggtgtcggtgcggaaggagcaccggaaccaccaccaccaccaccggcaccaccaccagcagccacagccgcggccggccatcgacgccaacccgtggggcaccgcgcgaggccccgcgttgcgcgtgtgagaccgatcgagccgcatccgcgcgtcgggcgcgcggggaggccacgtcttttttattttcgggacttctggtgcgacacgggcaggacgacggagacaaatacattttcacaacaataaaacgtacgcgaccctgtttctgtttgtagggggactggtgctactagtactacgtgcgtacacgcgcctgagggtcttgggccgagttgggccctagcttcctcgggcgagtcttggtttgttttttttttctcatttctcaaggttagaacattggagctaggcgatcgattcatgggctctcctccatttttgcctcctgtttttttggccgctgtgttctgcttttgaggaatgaaatatgttttttttctccaactgaactgtcccccatgtacattttgttacttcccttagcaattcttaggtgttttataggcagcgaaatggacatgttttttttaaagaaaaatgtttttactaaagttttgcagctggcttacaaggtattgtcgttttctttttcttttttgcaacagtggaagccgtttgtttcgccgaagctgttagggggatttggaggtcatcaagggcctgtccctttgccaagctgcaaaatctaagtgcccaaggagtcctgacagaaaaacaagttcttgaagttaaggttatggtccttctagatgttagcatggagtagatttctttatgatgagaacacagagttgtgtctttagtatgtcgatgcaagcttatttacttgttctttagaaacagagaggaaaaccccggttccaacatatttgaaaccgaagaggcttgctttacttgttgcttccctacttttgcttttgctgggctcaactgtaagcgtgtgaaacccaacaagttttatgaacactcttaggctgactcttaggctgtgttcgcatgcaccttttccatcctctcttcatcgtttttcgcgtgcacgcttttcaaactgttaaacggtgcattttttgtaaaaagtttctttacgaaagttgcttaaaaaatcaaattaatccttttttaaaaaaaaattagctaatacttaattaatcacgtgttaatggactgctccgttttccgtgcgcagaagttgggttcccatctcccccatccgaactcagccttagtatgctttctattgaaactgtgccgaatgagagaaaagtatgtgacattgtgagttgtgacacataataagcacgcttatctagtaggtgcaacctaggtttgaacattacaagcacgctcgcagtgctgcagcttgcgaagttcagatttcagaacttcaggggtaggaaatcaaaccagtggcgccaccgttacaactcaacatctcaacagactagcgggtctctatagcaggaaaagtctgatacggttagctgtaacccatcctttacctgcaaattacaggtttggtcgctagcttttgccacagtttcagaattgagatgctgtcgatccggcaacgtccgagtctcaaatgaatgatttcctgtcccctttgcaatctcactgatggcaacctgagtcatattgaaagatcaaggatggaacggagcaatcaggaatcccataaactactacatacatacatgtcgatgagatcgatctacaatcaaaacaggattagctcaacaatgatagaaagaaaaacacaacagaataaaaaaactgaccggcaaattggagccggtgatgatgcaaacacagatatataatttgtgccaaactgacattatagctacttttaaaagttccattagatgcgtaggattagatgctcccgagtattgttaaaggaatacaaccaaagcccatgattctgtgtgggatttcctgcctgattttccggcatctttttccttgccacgttcgacagggaaaagcaggagcatttttccggcgatggcgaggagcacaagtgcacagctcttcttcagctttgactgtcccaaccgatcctggttttacgtgcctccataattttaactttttttttcccctcctagactagattcgtatacttctcttgtggtagcaaacgaatcaatgcacaaacttttctagcacagcaaggtttttgtatgagacgagcgaatattaccgcgatttaccaaaccgaacagttcaaagcaaggcaaaagcagatttgtgctgcttaaaagaaaaacgcgagatcgttgggtccatccagctgtatcactgaatgtctccccagcgagagacgcggcccggttggaatccaggagaccaaattttggggtcagcttgtccttattttactccacatgggatactttactgaccttgctactagcctagtacaagtagtaggtccgtgctttgatcgcaatttctttagacgtttattgccacagcgtccaaaggtgaccacaataccaccaagattactgtacacacaattaactagtgctgcccatcaccaataatttgctcacttttgttgggcactgcgatttcttctgttttgtaacaggatcgtacgcacgaatctcgatggtggtctcagcaaaattatagtgtaagccagtgcctggagacgcgctcaaccggcggcgtaaaacttaaccccatgctaatgctagctgctggctgtaccggggacctgctggtcgttggggaggcatatgccatcagaaatcccgaatacacagtacatgcggtaatagcacacagttgattaatgaatgctgggattatgaaatgtgaatgccgttaaaattatgtacttactactagcggcattggagttagcttacgtactgcgcccacttatttaatttatttatttaatgtcctttgtagaggtagattagatcacctaatcttggattcttggtactacagattataaaatttgattagctggtgagtcacgattagccatgggtttaggctttagatcgatgcattaggcccaacccattagctagctgcatctacatgatggctcactgtccacagattgttttgacatggaagggagggatctatgtagctagtgtacaattgtaacgttacatctggggcaagctccctcccacgctgtactgccctgacggcgatctcaccacatcccgttgtcaaacaccgtcgcttttgtttttggcacctgtctcgcttgacttaaacggtagccagcatcacaggtcgcgattagatatagtcgctagtagtgatgatggtgaatttaccgtcctgtagagtgtttcaactttcaaggcggcgaatacggtacagtcgtgtacagagactaggaacagggtgagtagaaaatggattcaatagtactccgtacgtctcgtctaggtgcatgttcttgcgaaaaggaaaaaaaatggtgatgaagggttaaatcaaacatgaactagttaggtgaattacgttgtgtgtgatgtcttgtcccttgtttaaagagtcacttagcatgccaaagggcttgatcccaaaaatctctgaaacgttactgcgattggaagcgaagcaactgatggcaaatgtgcgtctcagccattttgatggcttgagcttcagatacgcagagcatcgagagatagtgcttacctctatcgttttgtagcgttaaaagtttttaatggccatggaagaaggcgattggtcacggcctcacgggatattggaactctacctaattcgggtcacttcggatataaaactacgtacgtagcaaactagcaatcataaatcagtagattaaaaacgttctagaagtgattttctttttcggaaaatattcagtaagtgtcatcactgaacacagacttcaattatcgaatcaaaggaaaaaaaaaagtaagtgtcgtcactgaacacagacttcaattatcgtggtttgcatccgtggacctggagaaaaaaaaagtactagtagctcggatcattttcgagtccagcaaaaagaagcaataagaggaacagtcatagactcaataggctcgtagcatatccctttttcttgaacaaacataccaccgcaccaaataccagagtatatgtgttacagtaaacatgtattattcgtatgttttatgcacacggatataccagcagagactttttcaaccgtgtgtatatatacaccacacgaattttttattacacgtatataggcacgtagagtaggattgcatttgcatatggtggagcggtacagctacgtgtgtgtgtgcacaaaatatctgtggctgtcgttttataccgagatggcggaccacccaaggcgtacccaccgcgcacacaggccacgggcccaccggacaaagggagcgtggaaccggtgctgcgcgtctccaccgtcgctttcgtcttgctactgctccgctgcgcgtttaaaagtcccgtgtcctttccaagccccggtttcgtgctccatgacatgtgggccctccgcggtgcacttttccgggcccttttgctttcgccgctgcgtccctttccgttctctgtggaaaaatggagggtctcaccgtgtccaaaggtcttgctccgctctgtgttgcattgcaactaggcaacttatgctgcagcaaatatcattcgatggttttagtgaaaaggatattcataagtttgagattgggaacacccttttttttcccatatttttcttacgggtcagtatatcattagaatcactaaaagattttcatatggagtcaccgaaactgaaattgattattctgacggtgacattggatccacaatctaaaatacagggcaggtgtcccccaaactttgtttgcatcccgaatcaaacaaatcaaaaggaccaccgggacacatgagcatgtccgatatactaattgaacatttcaaccaacaaaagggcgttgctctagaattagtacataaaacaacaaacatattcacctaagaaaaatgaaggaatgtgctcaacaaacggtcattatcttgcgctggagtggccgacctaaaaggacgattagtaactattaagagtccagttttgtcagggagctattaagagtctttaatggtattatagaaaaaaacagtggtcatttaggacactaggacagcacgatgttggaacagtgagctcttataatcaccttcaattcacagcgtttagggtttcttcatagtccatagcgcagtaattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacgcgcgcgctcgctcgcctggccgggccggcggcgcgcgtgcacgacgtacgcgttgaatggtccgaaaaattggctcctcacccttgcgcagatgcagcctccttttgcagttttgttttgctgcaaattcggattcgtttttgttttggaaacgttccgaaaaatccggtgcgtgcaaacggcatggagttcggataagttacgcgcgacttatccggttcggttacgcgcagtagagatcgtgcgggcgccctgatcaagcaacccttctctatataaaccgacttgccgtcttcacgcaactcacgaaaaatcaatctagggtttgcctcctactctgtactgcgccgtcgctcgtagactactccatcccgctcgccggcgtgcaccggcgatcgggagagcaggtctccggaacctctgccttcgacgttctgcaccgggagaaggcggcaataaggtttttggaaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttataccgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaatttgaggaagccactactctctttgtgggatgcattcttagcattcttggtgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttttgtagtcgaacaggctcatgagatacaaaccatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatttttgtgctgacatctcattgttttcttcttatcaggtcgcacggggttccaccgttctaatggggaatgggtcacatgcttctgttcatggtgttggcacggtagatctgaagtttacttcgggaaagatcgtgcagctgaagaacgtgcaacatgtcccttctatcgacaggaatcttgttagtggctcccgtctgactagaaacggatttaagttggtttttgagtctaataaagtagtcgtgtctaaacatggatattttattggtaaaggttatgagtgcggaggcctgtttcgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaataggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgcttatcatagcattgcctatagatttttattagttaaatctgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgatagagcgaccctatgggtgtaaacctgtggggtacaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcacctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatattatcttaaacattaagctaattagaggtgagaatgggattacactcttgcagtcccattatgtggagaagatcttaaatcgctttggctacattgatagtaagccttctccaacaccttatgatcctagcttgttgcttcgcaagaacaagagaattgctaggaatcaactggaatactcccaaatcattggatcgttgatgtacctggctagtgcaactaggcctgatatctcctttgctgtgagcaagttgagccgatttacctctaatccaggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggcttgagacccatgtgagttatactatggtggtaacccagtctatgtgatcggagatcccgtgaattagatcctgggaagaacaaaccattaataaactagaggagagtaccaatatatataccctctccaagtgaagatgcatatactcttgtgagctgcaaggcaggttgactatgccttaatgagttctgttggctttaattagcgaagatgttgtcctgcagagcattcttgaaagaactcacctttgtgagcttgactgttggtcgcagtctatgaagattttgggtgaatcttctaggaagattactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagaggggaaacacacgcgcgcgctcgctcgcctggccgggccgggccgggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcatggagtccggataagttacgcgcgacttatccggttcggttacgcgcagtagagatcgtgcgggcgccctgatcaagcgacccttctctatataaaccgacttgccgtcttcacgcaactcacgaaaaatcaatctagggtttgcctcctactctgtactgcgccgtcgctcgtagactactccatcccgctcgccggcgtgcaccgg

SEQ ID NO: 58573 - DNA, 2376 bp, Oryza sativa
aatcaatctagggtttgcctcctactctgtactgcgccgtcgctcgtagactactccatcccgctcgccggcgtgcaccggcgatcgggagagcaggtctccggaacctctgccttcgacgttctgcaccgggagaaggcggcaataaggtttttggaaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacagtaattttacaatatttcataagaactgatttattttatgtaaaatttctcgataccaaagaaaaccttagtagcagtaggtcagtatgcaggtgcagatgtgcagtcgcctatcaacaagtgatgttgctgcaacaagatctcgaaatacccgggaccatgtgctgcaaacttgcattctataccgtctaagaaaagtctttcagtaaaaataagctcttcacggtatatggacgacaagacgagagaaaataatatactctctccatctcataatataattttttttgcgatgtgatatccctgttcgtgatattagtaagtgtcacatcccaccaaaatcttttatactatagaacagagggagtattcattaagaatttattaaacttaactctgtcgaagtgaagggaaagtagcttgttagaagtatggacgttaggtcattttcacccggatttttttttcttctaggtgagaaagttttctttttagaaaaaacctaacattttcttgtgggtgcagggttgaattttcatgcctttctcaatcctcaccgtcgcagcagagaagaatagtcacagagcaatgttcacttgtttagagtcacagagcaatatcgaaatggttccctgcaataatattttagatgagcggccggccggtgagagcgagagtgagaggaaaatgtcaattcagtgtgacaaatacaataaatatataagtgagagatagatagagaagaagaaaattatagcaaattttattgctaatctattactaaatgttagttttaagattgattaatagtagtaaatgagctttaatattatccttgctcttactgatgtaaatactactcctactaactttcacctcctagaaacgagcccacgaaatgacaagtttataacgttgttgtctgcaaccgatgaccaataaggccgtaacacgcactctctttctcttcccttgtcgacacggtcagcacagtaactgtcgcgcttcacttccttgtctggttagcagagcacagctgcacaggagagcatccagtgccgtcaattttgtcaaaagagaaaaaaacagaggtaattaccggacgtccagggtgatctgatgctctaagtaagctaggctaaagtagctttagactttacgcttactcattcctcacatgatttgagtgccactataggcagtagaagagaggagcggagtaaagtagacagtgaaatccacatcggaggtgatgagcatacttaattaccgcaagtcactagctttaactagcccagataactttgcttcaactgctagtggagtagtacacgagtcgcgtagcaacgtatctggcgtaatcctcacttgctccactgctccacacaccattggcctaagcttatgggctgatcaaagtatggaaattagtagcagtgggaagaaatgtgagctcgaatcaagcgtggttatcaggttaagtcgcattcagcgccataattgagctgcctgcccggttggtttggcctggccaatctgaatttactgagtatgcagtacaccagtagtaccctttcaattctttcgcctgtctccatgaatgatctaaacatgaaccctgctctgcaacgccggaatagtgcgcacacggcatggatcaacaggaggagtatttactagcccaagaatgtgaatcaatgcaacgccggaattgcagctgagaaatggagataaaaagatgatttgtcagcgttttctgtttgcatgtagtagtccatcatcgttacaatggtcaacaaaagagggtaattgacccaggacgggatcactggtagaccaggtggtcaaagtatgaagtagggaaagcagcctatgggcctgtttggtatagctctaactcctaaatttagcttcaggagttgggtctggagtgg

SEQ ID NO: 58574 - DNA, 20872 bp, Oryza sativa
tcccagttttagtggagctgaaactgtttggctgagctccagctccaggaggggtggagctggagctggagctgtgccaaacaggccctatgtttcagtaatccagtctacgacaggttgatccgttgatgtggtacaccatctagccggccatactgagctgccgttgaagtgttgaacgcgatgcagtgctgctgactttgctgcgccgatcagtgcagcctgcagcgacggcatgcagcgtgctaacatacctttcgctttaaactcgtggagtactcttacttcctatccatgagacaagaaaaagccttaggccttctttagatatcactctaaaatttttcatcatatcacatcgaacatttgaacacctgcataaaataataaatataggctaaaaaaataattacacggattacgactaatttatgagacgaatctttgaagcctaattgctaaatgatttgacaatgtggtgctacagtaaatatttgctaataacagattaatcatgcttaataaatttgtctcgtggtttactcaagtattctgtttttttattagtgcctgaacacctcatacgataccctatataatatccgatatgacacgctgaaactttacatcccttatctgaaattggggagaagtttgggaaaagttgttagtctagaaaaaaaagttataagtttatatgtgtaggaaagttttggatgtgatgtgatgtgatgtaatggaaagttgggagtagaggtggatagcgagccagctcggctcggctcggtcgagctcattaagataacgagctggctcggctctgctcgttatcttaacgagctaaaaacctagctcgagctggctcgtttggctcgtgagctaatgccctgaaacactgacccaaacaattttttcaatggatacacagggtaagtgcgtaagtgcaatgaggtgctgaaactggacctataattgaagaactaaagtactgaatataagattaacaacaacaaatcgcgcatttgctctgggatctggttgaggtagctcctgatcctccatggcagccagcggcgcagccacacagccagcagcggaccatggacgtggatgatgagtggcgcggcgtggggcggcgtcgtggaatcatgggcgatgagcggcggcgcgagcgcatgacactcgctgctagagcgctggtgcctagcgcggaggtggattggcggcggcagagcgacggtggattggtggcagcggagcagtggagtgaagaggagagggagatccggagaggcagtggcgcacgggatggtggcgtcgtggtgggttggcggcgccgcacggagtgaagagaagaggaaaggggacgcgagtcgcgaactcgcgatggtgggtggcgcggagcgaacaggaagaggagggcgagactcatgtggtggtaggtcagctagggttgtccttatatgatgggccattcgtctatgggctttgtggcctttgtggcctgctgttgttgggctgttggctaatgaaagctcgttaaggctcgcgagcagctagctcgagctggctcgttatctctaacgagctttagagccagctcggttcgttacgaaatttaaatgagccgagccgagccgagccgagcgagctaacgagccacgagcttcctgtccacccctagttgggagttgagagaaagtagcttcctgtccacccctagttaggagttgagggaaagtttggtgtgaactaaacctaaaccgggccaggacacccctaaacacgagatgcaaatgcgttgcaaatccacctacaagggcgacgtaatatcacgcgcgaattgaatggcatttgctgcttcctggggagaaagatggagtacaaaaattaatgccatctattactactccctcgcacctcatgtgtttgctgcctggagcaaaggatttttaccggtccaattcggggcacacggacgagtagcatgagcttctgggactctcacacgcccatggcctcgcatgagtcactgacgtgtgtggtggtgcaagactctagctctaggactgtgcgccaacctgcaacagacgccgaagcgaagctcctagactgatactcctagatcctagcacaactccttgggatctcactgaccggtgggccccagcagggctcggctccaaagcagcgtcaaagaacgccgcggggcccgcatgacctagcgatcccgagatgggcccacggttacagaagcaaggagcgctcgtgaaaaaacagcaaaaagaaattaaaagccctcgaaaaagaaaagaaggccggtgcggggcccagaaggcaacggatcccactagccaacaccgtcaggtgggccccgcgtacgggcccaccacccacccttttctccccctcaaccttaataaaaccacctcccaccgcctgtctcccctttaaacgcagcagcacgaacacttccccgtgcccgcgcctcgcgacgggcccaaatccaacacgacgacgaggaggaggagatcgagtgcgccaccgaatcgaataaccacaagccgcggaagatttcccctccccccggtggatccctcctcctcctcctcctcctcctcctcctccggggtcgcctcctcccctccgatggagtccgggagcgagagcggcagcgggagcgggagccgaggggagatcacgctggccatcggcggtggcggcgcgtcggcggcggcgtggactcggctggtcagctccggcgtggaggacgtgctggtggtggggggcgcgggtggctggcgtggaggaggaggaggagatggagcgggtgggctgctgccgtacgggcacttcctggaggcctgcttcctctgccggaagccgctcgccagcaaccgcgatatctacatgtacaggtaatccctccctccgctcgacgccgatgcctgattcggttcgtgttcttctgctgggttagtttggtgtatttggtagcggtgggtcccgtggccgggacttctccggcgtcattggaagctttgttttgtatatgaagaaaaggaaattttgccgctgattccagctgaagcctgcgggaaaagtgagagttagtgcatactccgatggagtatttctcagggttttttttgtcgtctgcaccgtccgttttttttattggtgcgttaggttgctacgcttctgagctgaagggaagaaatttgtgcgagtatccttcaaaagagaaaattatgcgacttgttttttcccttctgccggattttgcgttggtgtaaaggttttgtcgttcatattgtgttcgtacaagcccttgtttactttggcgcgtgaatatattaaatccttagtgggtgggcttatttatgatcatgctgtcatcaagagtagataccaactactgtttgctctttgtttatgaagcgtctgattcgggagggagttggatgctaggcacggacgatttcttgctctttttcccccttccaacgaaaataatgaacgtttttgctgcttaaccatgttagtttcgaacaggtggatgaattgaaccgaactgcggctattttttgttctccgatcttttggtttctttcttaattgtgatctagtggtggtggtggatacagctatcgaagagagccgtccttttgaatttattttcaatttttcatgtaagaaaattaattgttcattgatgtgtgctcacgggaacttctgatgaaagggacctgcaacctaactggatctttctgaatcttaagactttgaatttttcctgttaaagaaaatgcttgttagcttatttaaactggatgttgtgacttgaacacaccgtgtacagcaatacagcatgatatatcatagaagaagaaataattcagacatgtaactagtgtgaagacttatcagttaaacagtaaaatgcaatttctttttttagataatggaatcgattctctgttaaatgaaattcttcgacgtaattgccctcgtccttttatagctggtaggctagtagctattgtcacattcatgtcactaagtttgctaattgatgatcctacggatcctttggttgagcaggggggacattccgttctgcagcgaggagtgcaggagggagcagatcgaaatggacgacgagatggagaggaaggagaagaagaacatctccaagaaggtggcgccacgtactcccgaccccagagaggtggagtccactccgaggcctccgaaagctcgcgccggctcgatcctcgccgggtgacaactgacaaggaggagggactgaaagtgaggaaactcctccgggattgtgctgctcgttttccggcaagccaagaccagatgatcctcacaccttaccaccagaaaactatcacttacaaagttacatatgggtttgtgtttttgtttaaaccccctttgctcttttggtggtgtttgttagcgcctccctaatatcggtgatcgatgatgtatagagacggatggaaaggaagatcagcgctggttattagtaggagtgactggctgactgcagctttctgtaatctgtgttatcaagggggggggggggggggtttcctgaccttcgtcttgggggtgttgtgaatttttcctacgtgtagctgattactgtggtaggtgtaaggttttttctaatgaatctgaggaaacatatgcctatagaagaaatagacatatggacgaatgaatccttgactttttttcatgtactgtaatcttttcgttgaagatcttgtatgagctgtgacaggaagctcaggaaagatcttgtgtgtgcttgttgctatggttgatggagcatgtgcagcagtttattgacccttaactcggtacaattctccaaaatcaattggaagcatatttttatcaaatgaccactgaactttcatggtagaaccatgaacctcataaactttcaaacatgtacttatgcacaatcacatactatttcaacaaaatacacaccgtaaaatgataggctcttaagacagtaaaatgatgttatacgtagtactacgagcacttgacctgcaaacagaaaaggcattcatcctctgatgtgtcaacgagacgaggacaaaaacaaatcaatcggcaattaaagaatactagcagtacaacgtacagtcatgaccaaatctagaaggacagcagagcagacgtactcacagtttcacagtgcaggctaaacgacagcctctcccaggctacgctccctttgacccctagcatctaccggtagccgagtactccctctatttcataaaaaaccaacttagcactgaatgtgcaccattgtaatttgtttttttttaaaacggagatagttcctatgtaccactgcactgtactagtagtacgagtagattagagtacggagtagaatagtagtactccgtattgtattttactacactactgcagctgccacagtgccacttcaattctctctttcccgtccgtcacgagccttgtggaagaataggaaaggaattgaatgccacttgacgcgaaggtgcagatcgagcaggtgaggtgaaggtgatgtgatgaggtgaacgatttcctttccacgaaccgcgccgactttatggaatggaaatcagagggaacgattcggccggccccacctgtctgtctcccacgcgcctggacaacggggaaagcttccggcgggggaaaggcagaggcgggcgcgcgcgcgccgacggccatgtgcttgctgttgctgcctcccgcttcagagaaaaagcgagcgtgcggtgaagtgaaacgacatcggggaggaggaggaggaggaggaggaggggttggtcacttggggtgtgttcggacctctaggttcccaacccaaatctctcgtttttcgcgtgcacgcttttcaaactgctaaatggtgtattttttacaaaaagtttctatacaaaagttgtttaaaaaatcaaattaatttatttttgaaaaaaattaactaatacttaattaatcacgtgctaatggattgctccgttttccgtgcggagtcactatgttcccatcatccacatgcgaacacagccttggttggttgcgatgctttgatcagagttcacgaggacgaagctttggtcggtggcagcgccccccccccctctctctctctctctctctcctcccttttactgctaccgcacgcccgcctcgctcgctacctcacttccgccgcggagaacgaccaaccaacgaaccaaaagtttgatcacatttgcgtcatctcctccggtttggggggagtacctttttctccgagtggttgggttgaccttttttttttctcttgcggacaacttgtttaaacgtttcggttgctttgcgaaacgttactgttgtgagtaagtgagttcgtgacaaactatattacattttgtagcaacgtcgggttgtcaaatactgccgtaggttctggagttttgttttaattccgttgacagcttgtttggcaacttgagggaaggggattgagagtttacacgagggaattgatggtgagattaagatgggaatttgatttttattcccaatatcttgtttggcagaggtggtgaaaattgacagggagtttagttggagattagtttattaatggaaacggttggctgagatttgtttagacagagtaaaggagaaattccctcccaattactactcctacccaggtattgaaaatgagggagtttcttcctcaattcctcatcctcatcccaccaaaattctcatgtctcccaatcaaacaaaacagttaatagtctcatccctctaaactcccaatcccttctaaaaactccctccaaccaaacggacatttggtgaactgaactgtctcgcgcgaatatacttgcagtgttcagcactatgctccattgctcctacggctacgttcgtggatgtggacaagtggatgggtgcctttttgtcaaagtcatggatggcgtcaaccatgactcggtagtgtgcaactctgccgcaacagcagggatggaccgatattgatggtgaggcccattgaccagggattggacaggctgggcattaaatggctctgaagtctaggcccgacaataattaattggaccgttcggagtttgttttctggcccaaaactcatggcccgtgtgagggattaatcggcaactaggactaggatgcgcgatcgcctcttgaaggcgtaaacttgagctttccacatccgtcgaaggcggaaaggggctttcccttaccaaccttgcctggtttgctctgccctgctctcccagcaacgccaaccccgatgctagccgccgccgccgccctccgcccgcccttccgccgcgcccgcctgagcacctcccatggaggaggcggaggagtgacgcaccctctgcgcccgcgcctgcagcggcgtgctttggcctgccgggctgacctgcagcaggacgcgccgttcgccgccgccatcggcgcctgcttgctagcctccctcgtgctcccgacgtcgagaggccgacgagatgacgacgaggaggaaggggagtttggcgcgacggacacgaggatgggcgtcatggggatcatctccttgctgccttacttcaactggctggtgagagcttaaggatagtcttgctgcccctctttgttccttctgcttagatttgaccccttctttttttttgtcttttacttcacgattagagctggatcttcgcgtggctggacagcgggaagcggcgttatctgttctacgccgctgcatacttggctccttatctgaggtttgaaattccaaactatgaactgctaatatggttaccctttgtcatgctggatgtggctatgcactgggattaattgagtttgtttgctgtgttggcttaatttgatcatgaccaacacttttgcaatgaccaattagacctccactttgtaatgtatggcgtcttgggtagctgttagtagtgttacttatcactggatcttctctggttgagaaaatgcttgtaataacgatccgattgtagaatctataaaaaaatagtcttgaggatcaataatctcttgggcctccttcgagtaagatcaaattgcttgagtgtttcatgtgaaattatggggaaccactgaaccatgtatgttggttgatcttgttttatatggactgttctacactttatggagttttcctgtcttattagatactggactcatgctgtctgctaaggtaaccaacaaaaactagcatcaattttcagaacaaatttatcactgtcgcccgaagagagctggttacctatagctagcatctttgcctgcattctccatgttcaggtcagtgagcaagcaattccagtattctggcaagctatagcttctttgctgatattttttcccttgcagctagaggcaagcatcaggactggtgatatcgagaccttcaggtttgttcagagagcttggaggcttattttccctagtgctctgaaggaggatgttcaacatagaaacaagggaaaatcaatcagaatggtacaatataaatgaactttataatctgatgttatgaatctctattcaactaaattttggcaatcttctcctacaatggttcagggcagcggtaacaggagaattccatcagcacatgaatctagagaaaagcttcgtaattcagatatcttcaaaaggagacttgatgagcccaacgacgagaaacaaaacaaatcagattggaactgaactcaaacagtgtcgtcctttctcttgtcaagctgtttaaggaagatccacatccttgtggaaaactcctgtggctgcttgcaaaaccgatgtgcagtatgtcaaattaggcttaggtgtagttagtttccaagttagtccacgaccacgagttgttggatcaagcaggcaaccaggctgatcagagtgaggcacctgctgttttcaggtttctgcaaattatgttttgtttgttgtgtgtagcattcagcaagaataattaacgttgcatgcttgctctatctgaaattctgaatgaaagtagctttatgcctggtttgtctctctctcatccgtggttagaactcagaacaaaccgctgcctgcttccctagcttgcttggctgttgctgattactgtgagcacctttgatcatacgttgtcatggactcctgaagcctcatctttccgcttatgcttatgcctatcaaccaaaatttaaatttttaaccttaaatttggagttgatttcggggttttttcatcgaagtttatttttaatccttgttttagatagttaaaaacacacatatatataaatttattcacaaattatttttcatttacaaatatgccgatggtagatgttagctagctttgttcatcggggagggcaggtctttggtacgtttccgcgtgttccgtttcacagcaaatcactgtgaaaactaaattgtacacagaatgatgcgaataccacgttttagatgaagattttttttcccggtttggaaggttcggaaaggaggattagtgaggactcagtgaggtgttggcatgttgccgtgttggagcatttgttcctggatgccaatcgtgaatattgatgtcgaaatgcacctgcggccactagtatgttcttccgttccgtccattttgctgctattgcgcatcagtttcatatcacactagccactgggtctcatcgtattcgttgattgacataaccacgcgacatctagccaattgtttgatgcttcaaaacaaaaaacagtttaaaatgcatacatcaaactcattgttcaagccaaattctgtgcttaccatccgattaatcaaccaagagtaaaatgcaccagcggtttttaaacttgtcataaggtttcacttaggtccacgaacttacaaaacgcacatcgagatctctaaacttggtttattgtatcatcctaatccaaagtctcgtttgaccgtggtctttcctacgtggcacaccatgtggacgatgacatggcccttttttttcctttttccccgttttctttttcctcatcttcttttatcttattcctccgcttagcacgacggtggctagggtgtcggcgacgcgcggccagaagacggtggcgagagggagcggcatggaggatgcgatagagggtacgatgagcttggggagttgggaaaatggtggaggggagcaggggtggacattatatccttgggaggctggaattgtgcccagggtgagcagatttgaagcgggaggggaaggcgggacaatatctcgggcggcttgggtcagccgccggtttgtgtggggaagtgggggaggtgggcgatgaccgtgtcccctgcacgtgcggacgagtcgggaaggcgcgaggacagtgacgtcgtggggagcgacgtgcacaggaggggtgtccatggcggttgccggtcggaggaggaagaaggccctgacaggtcggcggcggaagggagaaaaaataaaaaaaaaattacatgtcatcatccatgtagtatgccacgtaggcaagaccacagtcaaataaggttttggactgggatgagatattaaatcaagtttacgaatttcgatacgtgttttgtaagtttatggatcttagtaagtactcgccgtcagtaggggtggataaaaagctcgggctcgtgagcttagctcgggcttggcttgagctcgtaaagcttggctcggcttgaaaactaaacgagccgagctcgagctgcctccatggctcgcttctaaatcgagccgagcccaagctgctcgcaagccgctcgtgaagcttgtcgagcttgtgaaaaaaatggcctggcccattaacagctgatttggcccatgaaaaactctaacctcaccgttcctctcccactccctcgtcatttccttccctagaccccttctcacgccgccagcccgtcacaccgagtccaacgcctttcaacgcgcgcgcgacaggcgacaccgctcgaggcctagggcgcgaccgcgcgaggctccctgcgccgcctccctcccctatgctttcctccccagctccgctcgacgctccctgcgccgaccttccctgactcgatgttgttcatcacctcgccgagacaccaacccaccgacggcagttttcgctgcgacgagcccaggatgaagaggttttgggatgtgttttcttatttttcttatgcatgtagcaatagcatgttgtggtcttagcacttgtggtctattggtcttgtgattgtagagcaatagtacgtgtagtatgtgcgtgatgaattgataatagaaagattaaggcaaataaatcaaaattgtcgtaccagtagtgtatgtatgatgtatctgtgactttgtgttactgttagtgctatacttcactcttttttagttgttcttgctactgcattgcaatttgcattatttgaggcctacatgacctgtaggagtttgatcctgatgcatacttgacgtttacttgttgaaaattgattgctttgttgttgtagtgtttacttactgctagcatcacaagccggctcgagctggctcgagctttgaaacgagccgagccaagctgctgttttagttcgtttagttaatcaaaccgagccaatccaagcctgttctttgccaagctttcctcggctcgtttccacccctagccgtcagtgtatttcactcatcaattaaattaggcggttgatactgagtacgaatagccacgagtcagtccgcgtactttactatactttagccattccacatcagtccgtgccgctctctgcccattctcttctccacggcaaaccaccaccggcgtcaccagcccaccaccggtctccaccgccacccttttctccgaatcccgacatggagaggcctccgcgcaggccctccgccgcgcgcccgcgcccgcgctccctccagcgagccgccgcggcgctcttcctcgccatcttcgtcgcgctgcccttcgccgtgctgtaccgtggccccgtgtcgcggtcgctgcacgactcgtgggagtgggacccgctgccttcgctcgacgcatccgaggaggacggcgccgcccgggatgatgatctggtaatcctgccccctcccttcctactgatggcgttcgtttggttcccaatttttagtgtaactgctctggaactggaatgatatccactgttaaaccatgaacgaacaacgataaattttggtagtacttctgctcaaaaaggagaaaaaaaaacattggtcctctcctcttagttttgtgaatgtcaggtagggtttaataagttcgcagtgcggtgttgttcgtggattcatttatgatcagttcatgtggttggattttgcgatctcgtgtagtgtagtctaatttagagctgttactgccaatgcgtaatgacatattgtgttcacaatacttagtagtggctgcactagagatgtgttatcttgaagggtttatcttaggatgaagcaattctatccagttgggtttagatgttatagtaaacacacacgagtaaatgcagatggtgttgttgtgttaaaagacagaagaacagtgaacacatatgtgatagccagaaccttccaatctgtttttcagtttgaacatgggaatcacttccacctagtgaaatactccctctgtttgggacggtgggagtagatgttactgacgcggtagtgtctgctctaggtgtcattgacatgtggataacttcattgaattttgtaagagaagtagattactgtttttctccaccatagtaatgtcagaaagtttggtaccttacatatttgctttgtttcagctgattattaacggatgttttcacattgaacaattgactaggttggcaattgaaaggccaacatggcttttgattgcaggactttaggaaaatttaagaaagtaataatgaccctaagtttttttattgtttatcttagctgtcaatgttacatttcagatttcattttagctgtatgtttcatgtattcattgtcccctaggccctaatagtccaaattcagaataaccatcttaatttttgaactactttttatgtgatcatttgcgcggccactttccagttaactttctccttttatttaattgtatccttctaggacagtcaagatctgaaactcgagcaagtcctgcagaaagcctcaatgggagataacacggttatattgaccactcttaattctgcatgggcttctcctggctcagtgatagacctattcattgacagttttcgatctggtgttagaacaagttcacttataaaccatcttgtcattatagcatttgattggaatgcttacaagcaatgtctcaagatccatccttattgctttgctctcggaactgatggtgtggatttctctgaggagaagaggttcttgacttctgggtatctggagatgatgtggaaaaggatagatttcttgcggctggtcctggaaagtggttttagcttcatattctcggtaaattctgttgcatgcagttcagtcaccattgataaatagttattcccattttgcaaattccaacagcaagtgattcggctttgttactaaccatgatgagattactattttcttttgttcataatatgatcgctagttgtttcaaaacaatgatgaaatggaggtgtcttttggttgtcactttcatatacttattttccatttattttgataaatttcaggatgcagatatcatgtggtttcgcagtccgtttccttatttttatcctgatggcgattttcagattgcttgtgaccactattttgggaatgcaactgatctgagaaacattgctaatggaggcttcaactacgtgaaatcaaatgaacgaagcatagagttttacagtttctggtattcctcacgattgagatatcctggccttcatgatcaggatgtatttaatgtcatcaagcacgacccttatgtttcagatattggactgaaaattaagtttttgagtacttcatactttggtggattttgtgaaccaagcagagatctaaacaaagtttgcaccatgcacgctaactgttgcattggactgcaaagcaaggtacatgatctaagagttatgatggaagattggaggagttatttgtccttacctccaagcttgaaaagattgagtgcattggcatggagggtgccgcaaaattgcaggtattagaaccaaccttgaaatccaatttagattgtttcaaatggaaaatacaattaaatgaagttcaactaaaatctttctttcacattgttttcatgttgcatctgagcattttttttggcagcctttcttggtcacaccaataaaacgtccttatggacagcaaaaagaaatgaaaatggtgaagcccgccgaaagcgctctgccttccccccgaaagaaccttcagctaaacatctaaacagtgtgacgagattctgattgaaaggtcgcggtaagttttgccaaacacttcggagatccttgacaatatagagcggagttgccggaccgctctggaaaaatacactacaaggatggagcggccttagcactgctcctcagctccgctggctgtaccgaacgggccttcagacttcagtgacaaccagcttcatttggctacgagaaaaggagtgcctgcttcttcaaggaaaactgaagcaattacaccgtcttgaaaagcaagactgctgcaatggatctgtcaagagtaaaatggaaaaaaaagaatgtatatcctggttgatttcataggtaagtttgaaaactggatgctcttttttttcctgtgttagaacaattttgttagatggatagatgtatgaaatatgaaaaaaatgaatggcctagtctcgcgattttcaaatatgaattcaagttcagctgtgttagatggctagatgcacgccaagccgccgagtaccgtgcacctttgcaaagcatattgaaagctgcataactgggtgagccatccttgggccagatcaagtaattgggcggactctagaccgaaattgttgttggcgaggggtaatattttgggcctgtggcatagcccatggggccgaattacagacccattttccttcattctaggcctttgccttatggccctaactgacatatgggacccagttgccagtgtcatccgtcaataaaccccagaacccgcgtccgcgaacaattcctctccccagcctcgccgcccggccgcacctcgtcccctcgcctcgccgccgcctcctcccccacgcgcgcggtcgtccagccatggggagatcgtcgtcggcgacggcggcgggaagtaagaagcggaggtccaaaaccggagctctaaccctaggggaggtgaagacgcttggcgaggagctcctctcgtcgcgcgccaacctcaaccacgcccccaccctcctcgcgctcctctccccctccgcgccgctggacctcgcgctggaggcgctcatctcgctccagtcgttcttcgtgcccctcctcccttccatcccctccgccgccgccacggccgccgcggccgcgggggatgcagaccccgagcttgtgtttaggtcctggttgcggaagcgtttcgacgagctcgttgcggcgctcgtcgagctcaccgtgtctccgcacagtgatgatgcaatcagggtgagtgctgctgcagcacctattcatttgtgtgctcggttgatggtttgatggtgaatggttcgattagcatgctcctttgttcactgtaggatctggcacttgatgcgctcatggatttcgtgaagctgggcaaggatgggagattccagtcggcaatttaccacaagtttatccacaatttggtgagtttttatcctctcatgctgttgcatcggtgtgaaattggggaaatactataatactagcagtatttaggggtggtttggctgagaagtgaactcgtggactagtttttactgttcgcttgctgctaagtttgcctgtttttgtgcagattcatgctaccgactcaattgatcctttgctagagttgcttggaccaaagtacttcatatacactgatgtttggtatgtcgtggtcaccttttgagtaatttttgctgtactttagtatctggtcctgataatcttaccttgagtgctttgctaacttgttctgcagtatttctaccatgcatttttttaatgttttcttgtaatatacttaattgttttctccatttgcttctgtagttacttcacttacactagcttagacaagatcgccagcagtataggcaataaagccaccggtaataccctctctcgttaaaaaatataacttattacaaactagttacctcattctattcttatcaggttctgaaaagagtgtcttgcatagtggcgatgatgggccagaagacaggtatgcttaagctcttttacatgatacatatattaagattggatgattgtgatcataaattcatagtattacctatggtaagatccaaccaatataccattgtgcattgcattaaatgagcgtttcaaatgcctgcacgcaaatgttttgcagtattgcttcgaaagaaaaaggtaagctgggaaagctttgttgttgttttacatgttcatgtgatccatctctgcctgttaaggaacaattggtactctgatgtgttgcttgtacttcatgcttgcatttctgtgttggtgtgttcttggaaagtacaatggcatgtgcttttcaaagttttacccctgcaatatcatttgaagacttgcaggtagtgatctatgttgtgaattattttgatcgtgtaattgtttgatttagatatcccataaaacacttgtagtgtgatttgccaatgtttatacatttctagtttttaacaactttcttagtcccatttatattcttctgatcttctctcttgctataacagaggcactatttatgtacgcaatatatacaatactttggcgcatattcctgccttggattttcaggagtcaaagtttaatatgtggagtactgttggtgagtcttttaactcttttgaaggctctattttccagtatgtaaaaatacttacagttgtccttttatacattgcattccctttttcatgtatgtccttatctattgaagaaccttgagacccattttctgttaggggtaggcagatataaaccattaactgaaggctgaacgaacttaagtagcagtttgtctggtggcaggtttggtttttataattggctgcttcggtgtttggttggaagatcagtacttatctcccgtaaatctcctataaaccgagcctcctgataaaaccgaggacagtgttctcaacagatagagcgcgtgggagaccgtgccctttcgtcgcatgatttttgctgacggtggctccacgcacacgccctcgcatgattcaagcagcggacccttgtgggatctggcagactactgcccaatggccatcacacataggtggggcggaagcagattgttcggtcggtttctttagtaaaaaaaacaaaaccaaatcgaagtagtttggtttttccctgatgagatcggttggtgtttcttaaaagccaaaaatccaccaagcggtaaaaatcgaaccgaagaacctggacgcccacccctactttctgtaattgttgaattctctctcacaaagacacccacatgtctcatagtcattgttccttttgaatgttctacttgcctacttcacttatccatctccgctccttttcatttgttggtctttgctatgcaacattgttggaatagtgatgttattctgacttctcttttttgtttgtgaaggcctttcttccaaaggagaaaagaactcatctgaggtacttcatatacacttcatgaagtaaactgcaactttgcctagtgactaagctttaacgttctgcaggactgctctgctacttacattaacaaaaaactcaaatcaaagttcagcaaagcctggatatcctttctcaagctgccacttccgcttgatgtgtacaaggaggttaatctctaatttatcttaaagcaattagaaatgatgtgatgctgctatctctctctttttttttcttggcttgaaaccagaccttcgccctttcaacattctacaataagtagcaattggtctcaattgcttcatctttaactttttatgaatggtataagtgttgcatgagcactcttgcaacagcaatttttccgaggatgtaatttacttatttacatgtagccttatggacttagtttacttggagtactgtaataattcaatggccaattagggtgatgtaactatttgttcaacaaattttgttgtttgctgttgccacactaagaattttggtcttgttttgtgatactgccttcttttagtgcacattaactgcgagtactgagcagtgatgatctataaattgcaggtccttgcaacaattcataagaatgtaattccttcaatgtcgaacccggccatcttgtggtaggttattccatttgatctgcatatttgtttgacaccattaatagaattctcataacctctgtattttggtgttgaagtgatttcttgactagatcatatgacattggtggtgttatcagtgtgatggccctaagtggtcttttcattcttatgacacaacatggcctggaatatccaaaattctatgacaaactctatgcattactgactcctgctgttttcatggcgaaacatcgggcagttttcttgcaagtaagtatctcagtaaatatgatgtggcattatcatctgttaatcaagtcatgtcaagtgtaaactgattgcagcttggactgttactccaccaacactttctatcgtcttaataaaatgactgccacacccagcatcacgtttttgaaggcgttctgtaggatttctataaatctaatttttgtagatatccattttccagcaatctgtaatatacttggttaggtcttaggcagtaatcactcgtcaggcggtacagtagcagaatacccaatcttgatgtgatagctaaaaagagaattaatcatgcaaaaggtttataccagttatggcatattagacttgttgactaacctgatgcctgcagcctcccacatccaaatacacctgtggtctttttaatatccatcggattggataatgggaaccaaggaggggtatgtttgccacctgctttggcattgtttgtcactcgctttattctcttaagccacaacttgcagccattgagtgacattctataaattgtggttgtggaaaaagagatggcacttgacacccttaattcatgtagactcatgggtgcaactaagcgaatcaaggcactaaattgtcacccatatgtttgagctatgaaccaccaatcttcaatccatgaatcaactcgataatacaagttaatatgagattttttttgtgcatatttctttttttaaggattattttattattcttaccatctattatggatttcctttttacattttttgactttttttttaaaattgcagcttctggatgcatgtctgaaatcttcatatcttcctgcatatcttgctgccgcgtttgcaaaaagattgagtagactaaccctttcagttccacctgctggcgctcttattattattgctttaattcacaatctactgcggagacacccgtcaataaattttttggtccattgggtatgttacttgttgtaccctttggtgcatatatataatatatagtagctgctgattgatatccttccctgggcagccactttgtgccaacaaagtgaatggcatcatgttcatgtagtccacattctatgttcttttttgtgttgttccgtaagctgtttgtattgctcttctgaataattttcaggaaattgatgcaaatgattctgaaatctttaacgaagctagtcaacgtaagaaggttggcgctgatcctttcaacaatgaagagactgaccctgcaaagtctggtgcaatgcgtaagtgatacctgtatcaaacatatttttcttcatttcatttctttgcaatcctgaattcctaagttgtcagtggttttctgcataccatgtactaatacttgaaaatgcacaacaggaagttctctatgggaaatagacacactgcgccatcattactctcctgctgtttcaaggtaccgggaagcttgatgccctgtttctatgacatctacatttcttgtttgattgtttagctcatttattgtgatactgttaactattgtcagattcgttgcttcacttgaaaatgatctcactgttcgggccaaaactactgagatgaaaataacggactttagttcaggctcctacgcaacagttttcagagatgaggtttgtctgtccgataccttacactatactcaccctcgtatgtatgcctgtatgcatgcacatgtattttacaccaatgcgcaaaatattagggatatgttacatccagcgtacctttcactagatttcaccatgtgttctatgcatatacatatgaaccatgtttacatggttttttctattgaaatgaatccgacaaacctgcttgtttttggagttattgttaaaccaaagtttagtcttgtcacttgtcttatccgctgccatttgagtgtctattattaaataatcactgggaatttactaaaaatctaccaaccctggttttgaattgtaggtacgacggcg

SEQ ID NO: 58575 - DNA, 12829 bp, Oryza sativa
  unsure (1)..(12829): unsure at all n locations
tggacttttagggatcaattcaaaaacatggcagaaactagtgtagaaggcaatgggatcagtacggtagatattagcaacagctcgcccgccaaaaggttgcggatggagacctgagtagggacccagacagggtgtaccatcttgatccaagttttggaccgtttaagagggggaccaatggacctgttgtatggcctaccattttagtttcattttgtttttttaacatattggaaacaattatgaaattaagttgtttttaacagtccaccagtgttgcaagttttgaactgaaaggagtgaagtatgaattacgcgggtaatcttttgctctgattactactaccagtgaaagatgtagccttgaaagttatcaactctagagtaaatgccatttagctcaatcatgcgtgcagattgtggataaaatcaatatttaatccatctccgtggatcctttgttggaatgatcctctgtgggcctatcttcttgccaataattctcttaatggaacaggctggatactactgtggtagtactcattttgttttgacttttgaggaaaacggtctgcaatatactggttttgtgcattatactcgtgtcgtttggactttttgtgcattatactcgtgttgttttgacttttgagaaaaacaatctgcaatatggtttagactttagaatgcttgagactacccggacatctacattgagatgatcggcgtcttcggaagcaattcagatggtccgttcttgttcctttctatcagaacttctgaaagacgctttctatcagaacttaagaaagacgcttctgaaatatctatgctgactagtctttattgtgtgttagttaacggaatgcgtacaccaggaaagaacacattcaaaggagcacgtcgttctcagaactcggaagagttgctgcaagccatgtgcaaaggatccaagacctaaatgaccgtgataggatccggaaatttaacgaggatgctacaaatttcttcgctgtcagatgtgattgccgggcccaacgtcgtgtcttcagtgaacaaatcagcttgtgttgtttatcaccaagtcattgtactgatgttgttgttcttgacctttttcaggtacgtatgtgggtttggatcgtcaaactatcttggccatccgaatgcttaagctcgatatctgcagatatctttgcacagaaactcatctcctcatcgtttatacttaagctcatttgtttgtttgtttgtttttgtgtgtgtcgaagagagtttgttcttcacgcgctgacgcgcacgggggtggggtccttccgtccctgtgaatgattcgacctgacgagatttgactggtacgcagataacgaatgctctaccacaaattcatacaaaccagtattactccgttttacatatatcacatgtgtaaaagcgatgtagaatgtagatgcatttaccatcggtacgctttcgtcttccaagttccaaccacatgtttgatgtgagggcctgaatattttctgaaaaaaaaaggggttaatgatcgtacttggcctgagaaagtgacacctagggagtagggacactcagtcgtaacatttcaggcggtcattaacccattttagtatctgggctccaaacagttgccatgatatagctaggcgaactgcaagcgaggtcttgagaaacagaacccgctgcagtggcacatttggtgaggcttcgggaggtcaccagaattgttcctgttcacacgggctgctagttcttcacagctatctcgtgtcatccgagcagaagcaactacctaccaataagaggttgcttcagacccaaatggtaagaggaactgtacctgaatccacataaagaaaaggggaaaggggagaggttcagttccatggggatttgtttgtttaagctgtatgtgccacactttcttattcctgaaaagaagattggtttccctcttcaacttcatactccgatgttcttgcccctctatagctcattaaaaagttagtagttgagttcatctcagctgctcttcttctggttcttttatcttttgtttttttggtggttccttgcaagtgctttttctcgaggaatgtcccttttggttctgttgcctgttggacctcagttcttatttatttaatgatttgtgctcctctgtaacctggtgttctcgctttctaatctgtaacgctatacctgtgcttaacaggcatcgtcaggaatttttcctcggttattccagcatgtgcgttgttacgttgaaggatgaattccaaaagagcactacattaatcctctaggtcactttgtcaccatgaagttcattttctatctgttcagtattttctgttgtctgtgttcctgcgcacaaagccaaaacatctctgggaggcccgatgcagtgagaattggagctcagttcgcaaggaattcaacaattgggagagttgccgcagttgccgtccttgctgctgtcaatgacatcaacaatgattcgaatatccttccgggaacaaagctggatcttcatatgcatgattccagttgcaatcgctttcttggcattgtgcaaggtaatccattcgtgctttttctgccactgagtcaagcggacttatgttaccacatggtataaaacataactagtttcttcttcttctttgcatttgtcagccttgcaattcatggagaaagatacagtggcaatcatcggcccattgtcttctaccaccgcccatgtcctttctcatcttgcaaatgaactccacgtacctctgatgtccttttctgcaactgatccaactctttcgtcacttgagtatccgttctttgtgcggactaccgtcagtgatcaatttcaaatgactgctgttgctgacttagttgagtattatgggtggaagcaagtgacaaccatatttgtggataatgattatggaagaaatgcaatatcctctttaggcgatgaactttccaagaggcgatctaagatcctgtataaagctccatttaggccaggagcaagcaacaatgaaatagctgatgtgctgatcaaggttgcaatgatggagtctcgggtcatcatcctgcatgcgaatcccgactctggacttgtggttttccaacaagcactcaaacttggcatggtatccaatgggtatgcgtggattgcaacagattggctcacttcataccttgatccatcggtacatctcgacattggattactgagcacaatgcagggtgttcttacattgcgtcaccacactgaaaataccagaaggaagagtatgttgtcttcaaaatggagtgaattgcttaaggaggatagtggtcacagcagattcttgcttagtacttatggcctgtatgcttatgatactgtctggatgcttgctcatgcgctggatgcatttttcaatagtggcggaaacatttctttctctcctgaccccaaactaaatgaaatttcaggaagagggttgaatttggaagcattgagtgtctttgacggcggacagctgctactagaaaaaatccaccaggtagacttcttgggtgcaactggcccagtaaaatttgattcaggtggtaatcttatccagcctgcatatgacattgtcagcataataggatctggtttgcggacagttggttactggtccaactattctgggctatcagttatatctcctgagactctctacaagaaaccagcaaatcgtactagagaaactcaaaaacttcatgatgtgatctggccaggtgagactataaataagcctcggggatgggtttttcctaacaatggaaatgagataaagattggagttcccgatagggtaagttaccgtcaatttgtatcagttgatagtgaaactggaatggtgcggggactctgtattgatgtgtttgtcgctgcaataaacttgttagcatatccagttccgtataggtttgtaccttttgggaacaacagggagaatccaagctattcggagcttatcaataaaattataacagatgtaagtcctaattctgaaacttgcatcatgcttatcagcttatgattgattggtttatgtgtatctttcatggctaggactttgatgctgtggtaggcgatgtaactatcatcacaaatcgaacaaaggttgttgatttcactcagccatatgtgtcgtctgggcttgtggtccttacctctgttaagaggcagaactcgggtggatgggcctttctgcagccattcacgatcaagatgtggaccgtcactggactgttctttcttatcatagggacagtagtttggatgcttgaacatagaatcaatgatgaattccgtggccctcctgcgaaacagcttattactgtgttctggtaaggctataatttcgtcagtttgtatttatcgcgtgtacaattcctgcaaatatcattccatgttttctgtcaccattatccagattcttggacgatgaactggttttatttgcctgacacttcatgttctacttactttgcaggttcagtttctcaactctgtttttcgcacacagtgagtgaaacgacagcttgtcacattctcgacattttcaataaccatgatggaattttccagctcataggagctactctttcttctatgtttatacaggagaggacaccaggagcactctcggccgcttcgtgatcatcatatggctgttcgtcgttctgatcatccagtcgagctacactgccagcctgacctccatactcaccgtgcagcagctcacgtcgccgatcaccgggatcgacagcttgatcaccagcgacgttcccatcgggtttcaggtcgggtccttcgcggagaactacctcgcccaggagctcggcgttgcccactcgaggcttaaggcgctcggctcaccagaggagtacaagaaggcacttgaccttggccccagcaaaggaggcgttgcggccatcgtcgacgagcgcccgtacattgagctcttcttgtatcagaaccctaagttcgccgtcgtgggctccgagttcaccaagagcggctggggcttcgtgagttctcctcttttttctctcacagtttgacagtgggagatggattatctaattcaggggacatctatcttttcttacatttttcttacatgtcaactaaataaccattaagtttttttaaaaaaattaacaacatgcatggttaaatttgatcacttcaagttcaaaaaaaacaaattaaactaaaaatagttaacatacttgcaattataattgttatcgttcgtagttatacttgttattttattattatttttttagataagtttgttattttattataacttgtagaggttgaatttacacttgcattattctatagtgatatgttttataaatctatattattaaaaaaatatttttttataactatttagatggtatgcaagaaatgattgatatcttcggggagatgaaaacactttccttttgatagtgagttccatgcttttttttttctcatctcatgcaaaacgtgtgtacgattattgttaggcgttcccgagggactcgccgctgtcagtggacctgtcgacggcgatcctggagctgtcggagaacggcgacctgcagaggatccacgacaagtggctggcgagcgacatgtcgtccatgtcgcaggccagcgagctggatcaggatccggaccggctggacgtgtacagcttctcggcgctgttcctcatctgcggcctcgcctgcatcttcgccctcgccatacacgcctgcaacctcttctaccagtactcccgccacgccgcggaggaggaccccgctgcgctgcagccgtccgccagcgacggcagccgctccctctcccggcgcagcaagctccagtccttcctgtccttcgccgaccgccgggaagccgacatccggagggcggccaaggagaaggcgtctggtctgggcggcagcggagggtccatgagcggcgtcagcttcacgtcaagcggcagcggcagcaccaccgcttcatgctaaagccttgataattagttaattttcaggttaattactttacctctccttgtgctgcagaattgtagagatacgtaagcacattggaacttttgctgcgctccggcgcttactgaaacactagtatagcaatatactgaaacacattggagtaacattttgatcgactaaaacggcacgacctactatgatcatggtgcatgatttcacggacagactgtggaacaatatcctctaccctaagccactaactttgggttactaataacatattaatccactttgttacatatttatatgtcagtgatctaaagttaatccgcattgcgtccatagactgtacggcatgaatctggcaaatggattgggctggattgatagtttgggcctctagagttgtacaaattctgacacttgtactcgtactccctccatcccacagtataagggattttgaatttttatttgcaacgtttggccgttcgtcttattcaatttttttttgcaaatataaaaaatgaaaagttgtgcttaaagtactgtggataataaagtaagtcacaaataaaataaataataatttcaattttttttgaataagacgagtgattaaacgttacaagaaaaactcaaaatcctttatattatgggacgggagtagaagttaaggccaccagcttggactcggctgtatctctggcctctgcggcgtttttcccatgtaaaccatgatggatttgatggtgaagccacgcgcccatgatgaggcgttgaggatgggcatgattcactcactcaactgtttcagcccctcttcattggggagctcattctctctcgtcccattggttgcttgctcgtgaccgtgagttgtccatactccataggcgagagagctataaagacgagctcgtggcgccacactattccagatagctggatgatgtacagacaacagcaatcacattcatggctctgcattgtgcaacacatagtacacactctactccgtacgtgtatcctacagttctgcacagtggattactatcatttgcagaagccactgctatactggaaagaaagagagggaaattgcttttttactgctaactccgtttcacaacataagtcattctatcatttctcacatttatattgatatatatatattagcataaatataaatgtggaaaatattagaatgacttacactataaaacggagggagtactaactaacctgacctgttgggggtgttacttcgcagacactggaaaaacatcctgaaagttcattccacaaaaggccaaccagagaaaggccaagagcactatgccgacgaacaatcaaacaaatggctgatgcttttggatctgaaactgtctgaacaacaccaaaatttttcatgtcaagtcatttcgggaattgtcgggtgccagcttcacgtacctgttggtgttgggtttaggtgcatttgcgtgcatattttctcttactccgacatgagcgaagccgtccacatgcgtgttacattagtttagatagcacaaatattcccaagataaaaaaaatagaggacttatattggcacaatatcacaagttaacaaacaaaataatgataattttcacacagacgagaggggtgaccaaccaacgcacgcatcacgttccacggacacgattcgattatgttctttccccggggaaaaaaaacagaaaacgatttgtgtccggttcaaagaattattcgccgtgtctgaaagtgtacaggtaaccgggatgtcaactgcttgattgatcaaaaaatgatttcgttttggggcaattgtgtttgtgcaaagcgctgcagatttgtcttgggcgattgcagcatcggcagttgcattattatatcgatcacgtcgctgcaaattgcagcctcctccatgtgccgggataggggggagagcacagaaacaaaggtccacggtgtagcagcatattggtgtactctgtactcttcttccctctggtttgtctgcacgtatagcctaggtgaaaaggtcatggactcttacgtagttttaatatagacatggagattgtccccaaaataaaattatactaccgaacagattcccagggcagatcactgcgctctcttcgagagaagaaacaatgcttgtgataaactggatggatggcattggagataaggatatctgagcacccaattttgcatactttagaacaagtgtccacatgcaaatatccataggtaattctgtatcattttggacaagactttccgaaaatattatttgaatacttatatttgtcaaatgttatattttgtgcttagtgaactagagattttgagaaactagattatccgactggtcatggttactcaagtccgatcttcttttcagttcagtagctacttagttttagagtttttgctattttagaggtattctaggagtagctatgtcattaatgatttaatcttttattcttctgaaaaatgggaatgaattttttttaagtgaaatgaaaatgaaagggtcttcagattgacagtggggcccaccggcaccaaccgcgattataccgtacggcgaaaggagaggacggcccatgaggagaatccaagaccgaaaaaccccacaactatctcctcccttccacctcgcctccctccctccctcccctccccaagtatccactcctctcctctctcgcctgactggcacaggcaccagcgccgagagggggagaggccagaggaggagaagccgtacgtacgggggcgctcgctagggtttgccacgccgcgccgctgaccccgcgaggacgtccctaccgccgacgacgccgccgccatggcgcggcgtcacgggtggcagctccccgcccacaccctgcaggtgcgctcgctgcttgcgcgccgtctcgtctcccctcctgttgctgtctgtgctcgcgcgcgcaatgtggctacggatctcgctgcgtctccattattccgcggtctgacgagcggagctcgctgttgctggtgctattgcttacgcgtctactactctactactagtagtatgttttaggttccaatgagtcagtatgcgttgtttgatttgatacgatgtttttactctcttgtgtagtctctactccgtaggtatgtgtgtgtttgatgcaattggttgcttcgcctgaatattgtttatgcttctaggcgagttcactctatagtctatgtctagaaccacactagtattccagtacgaggatttgatttgcttctgctgctgtgacacgaaattgtacgtcgatttgattttcttaatggttcccctgatggcatatgctatctgaattttaggcggatgctacgttcctgatcccgtgcgttgtagtatatgtggtgtctgatttgatctggcagtagctttgggcataaaagtggtactttttgttcgttttctgttggtctcgtctgctctttctttctctgatgtgatgtgcgaccctggacttgggggctcccctaggccctaactctccttttgtcttcttcctatttgcactatggattctctggtttgagtttttcttttttttgagggcctcctatttgatttctttctcacacctgagttaaacattaggatatctatggattcgtgatttcctgttgatttttcagatgcagaattttagttactccaacctttttgatgttatccgtttagagtaggagtagaaaagatgcatccgtgtttgaaatgatggagtgctcagttcggtgccagtggctttgccattctggacaacgttcattttttttttccttttctttgtttttatatttcttagtatctctttgttgcatatcgttttatgctagagccaactttcgtttctatcatgaaattcttattacccggcaaaaatcattaaattcttattgtcaacaattagcactgcttcaactaagttatactagtgaaatcaaattagttaccttcaactagagactaaggataataatccgaatgacgttttagcgtcatgttggtggtctgttgggtttcaaaaaaatgttggtggtctgtcctattatgttgttagtgcttttacctttttatcttacggtcccagttatgcactttttcagctctgtttaatgtgtcatgtgcaagaatttatctggattcattgaagaactgtagtttacctgtgtaactgcagtatcccgctaaaatttagatcaacttgtgtgcattcttagtcatggactcatggctctggtctatgttgttttatctgcactacctcactaagtttacatgttttggagatcaaacaagggaagaggctataaactcttggcaaataaagcttaatctttcataaaagcctgtaagatctgagcatgcatgatcgtcttgtgtaattttgttttaagtttttcgcctataaacctcatactcaaagctcttgaaatattcaatgtttgtaagaatcccctaggatcagtaatgttcagccttccttttaactagaaagatggtgtatatatggggatcttggactcttagtcttctactcttctttatctgctgaatttgtagcctcttaattagatcctgtacttcctttcatgtgctgatgtcgatgcatgctatcccatgtttacctcttattaaagcaagtgattgaatattttttttctttttcttttttgcaggtggtagctataacggtgttcttcttgttgtgtatagaattctatgctttcttttcaccatttcttgggaaggacttgtatcaatttatcgcaataggtgtttatagttttctggtaatgttcttcctgttcacgcattgaattttggagtagtagattttgtttgacaagcgtttgatgttcatttctggcatttcaggccttatcagtactgattctatatgtaagatgtactgctattgatcctgctgaccctggaatcatgattactgtcaacggtgctctaacctataagtcagaaggtatctgctcatacttggaactttgatgtaattcatgtagtagtaggcacatgttatactaatgtagcaaatcatcttgttttgctcaaaagcaaaattagacacacaagacgaaacgggcaaatcagaatcgagaacctatgaggatgtccaaaagcacaaatcatgtttaggagctggttgtttgtgttgtgctatatttgtgaaagaggattgtcgcaaagatgacgaagcttaccaacaagaagattatgatgaagaggcactcttttgcaccctttgcaatgcagaggtacttatccacagccccatccttagcgtgtgcataccataccatttttaagacctcgtattcattttctctgcttttgcaacatatatggacttggtattttgaaaaacataattgaactgtaaatacttacctgctgcatccattgattcaagtttacatgtctgtttaacacctgtatatttgacctgaacatagtggtacaaggctattattcatggttgctttacaacagacgcacataacaaagtcttatcgttcatttgtatcacttcgaattatatttgcatgaatgtggcctaaccagagttataatgtttcaagacttctctaacagtcaacaggtgctatgtaagaggcaaaacttttgaaaaagcttttcattacaagttcttcgaatcaatttttgcctatagacacacagaatttagaattcttatgacaatacagggacatagatgcccgggaaaatatgtggtggaaacttggaaactaccgttggatcgaaaaatggacattcgatattcatccacgtcatcacaagtaaacagtaaaatttttactcatgatgatgtggatgaatctcggacgtccatttttcgatccaacggcagtttgcaagtttgcactacatatgtggtttccaccacatattttccctggatgcccagatcaaacagaattaattagcatggtttaacagctaataaagaaaactcgtactaaggatgattaggaatttaggatccaagtatgaaataactaaaaaaaaaatcccctgttgagacattatatcagttattgttagtgccatcaacattttgtgcttcttaactattttggtgcttctgaaatattagtggatcgtgagtagagaccatttaacatatttgtttacagcagtttttattcactgtatatgctaataatccaaagttttggttcatactcagtaccctttccttgtacattgatataggtgcggaaaaatagtaaacattgtcggagttgtgacaaatgtgttgatggttttgatcatcattgccgggtaggtttatgttaaagcttctgtttcataaacttcacttgtccttttgccctttcactttagtttgttgacatggctattctgatgttgttttggtgtttctgatgcagtggctgaacaattgtgttggaagaaaaaactatgtcacatttctgtgccttatggctgtgagccttgcttgggtatgtaaaataatcaaaacaatattaatatttctatcaatgtttatattcttttaactgctgagaaacttgtgtcttgtggatttggtgctctggaagcaatttttcatgtttctaattgtggttgttcataatcttaaatgcatannnnnnnnnnnnnnnnnnnnnnnnnnnnnnnnnnnnnnnnnnnnnn

SEQ ID NO: 58576 - DNA, 2060 bp, Oryza sativa
aagtagatttttcccaacattaaatacacaaatgaaaaataaacgtaacataggaatggatatgtaccttctgttgtatattactatatcgcaattctgttatttctttcaatgtctttctattgtagaacatttgctcttcaatggttccttgagtgcttgcgtccacttcaatcattgtgggcaaaaccttttcagcattatgcctataaataaaatgcaatataatccatcagataattttagacaaatcaacaaatatatatatgaatttaaagctactactgcacacctgctcaatatttccatgcttgcaggaatttccatatccaaaaaaacttctgtcgaacttgttactccaaatgataataattctaaatgatcaatgtcgttagtttactaaaactataagtacgttaaattagaaaaaaataacatcctcactttcatattctttaaccagaagtccagtggcgatgaacacagtttgcttcccaagcaaatcgtcgtcaaccatatttgctaaaatatctccccatagagtaattttaactttttctcccctacaaatgcaataaagtcatgtaaaatataccacatagaaagtattagtgctggtttaaatttgcagacaacaatcttactctaataaaaggagttcaatttcacgcatgttgcaaaccctctccctgcttgtgttttttcctagcattctttgctcgatcggcttcatcccgctaagtaagccaatcacatctaaatacaaacaggtctttagtacaaataacaatgtttaaaagaagtaagattatgcacatacctgataactgttgatctttattcaacctactccttaatgttttcctgtctgtaaactcgaagtaatagtccaagaaacattgtctttttgattttacctcttttactatggtatcatgataaaaaaggattttcagattgttttttaggacacggtatttatcatgttccataactttgaaatttttaaaagtatatattgagttaatcttaatttttggcctgaagtggttcgccaattgctttgagatagagacatgtattgagttgccctgcaccaaaaaaatagtatttacataatagaacaatatattaaatcacatgtttacaacaatcatacctctgcatctagtacaatcatctgtataccatagaactcatcaaccattgtaggattaaccgcatcccatagcctaataacttttactttgattctccacctatcgttctttggtgttaattcagtaatcaaattgctaggtgccatgttatctgcaaatgagtagtactgcatatagttactaaacaaatttgacagagagtcgtatacatgtttatgttattttatagaactaattaatacaaactctcataattgtgttctttgataggtgcaaggttacttttttgtgctggaaaaaaaaatgacaaaattgtatacatagatgcaacataatgtacctctaactaatacaggatatcgtaattgttgtgctggaaaaaaaaatgacaaaattgtatacatagatgcaacataatgtacctctaactaatacaggatatcgtaattgtgttcttttgtaggtgcaatgttagtttcttctgctgaaaatatgatgacaaaactgtatagatgcatatgttatttcctagctgcaagatcatgattagatgatgtcatgattgtgttcttttgtgggtgcgtgatataccttcttatgccatagatgattcgcaaggtgccgcagacttcttctgctccgtccgccggaatcgacttcttctgctccgtcgtcggaatcgacttcttccggaatcgactaatgtcgcatgctggcggggtgtatatatatgtatgcaagccttacgaatattgtctcatgtatatggaactaatccttcttgcaattaataatctttcctagtgatctaaattttgctttttgagatttggaatcttgccctgtgtacacgtacatatatttatggaaataatgtgcggcccctacaaggtgctgaat

SEQ ID NO: 58577 - DNA, 1114 bp, Oryza sativa
  unsure (1)..(1114): unsure at all n locations
ggagcccatggcgcagtcggactcttcggttgacggcggctggatacgcggtggcaacgaggaggcggcggcggccaggagatgctccaccggccccacgcgcacgcgcgccggcgggatccgcgcgtcgtcgccggagtccttccgcgacgacctcagctgcacaggcgttggcggggatggcagggagggcagcgccccgatcgccgtcggcaaggcggcatcggcgcggcggtggagatggccatggccgccggcgagctcttcacgcgcgggacggaggaagnnnnnnnnnnnnnnnnnnnnnnnnnnnngatggcattttggcgaagacacctggttgaggatggtatttcagcgaaacccgtttttataatggtagtctagtgaagccattcttatgggatgattcttatgggatggtagatatgcaattttctcacttttacggggtgggtgggctaaaaagtggagccacgctgacacgcacgcgccgttcgccgccggcatcttcccggcgatctgctccggctccggtgggcacctcctcgacggtacgcagccactgccccctccgcgtatttcttcctattggttatctccagttttccggcgagcgcactcgcgcgcgccggataccttgtggacgatctggaaactctgcacgctgccaggaggctagcggagtagtggaggagggcgtggtgagggtcgggaggcagggatggagttggacggggagacgaggtgtagcaccggcgctgaggtttgatggtacttctcctgcatctacgaccccgagtttgctcagttgctgtcttgcgggaacaggcagtttctcattcatggataatctgaggaagtcagatggattgatgtctcatggctgtgaattttcagtgtctctggcgatttgctgtttttcgtgttcttatcagaatacatgagcttatctctgaagagattgcaaagggcaatattaagtaagctcttctctttttttaagcaatgtactcatcctactgttgatttgattaagttaagagttaagagtgactagccgtctagccgtattcgattccttctatttgcaggtccgaaagggctgcaggaa

SEQ ID NO: 58578 - DNA, 1973 bp, Oryza sativa
atttaatagaaatgcgggacatttgtaaattaggtacaatatgatcaattgcaatgtatgacttgccttgctctcgcactgatgagaccacagcaacgtcttcgagaaaccacgaatcgacgaaacgggcgaaatctacgcgacaaacaaagcacacaagcaaaacatgctataagactactgaaacaggaaacaaaaccatttttaatggattctacacatttttatgaatttactgagacttgaatggacttaatcggagctcggatgaattacgtatgatttttagaagattctctgtgtttttactattaaagaaaagccttaatgtatttattgcgcaataattcaccccagggctgacgtcagcacaaggaggggtggcgccgacacgcgggacccgcgggtcagcggcacaaggggagagggagggggcggctggcaggtgggcccactgggcagcggctcaagagagagagggaggggcgccggcacatgggccccactgacagtggcacaaggcgggagggggcgcggctggtggctcggctcggcttcaagccggccggccggttatggcgagggcggcggcgcgcgcgcacggttgccagcgacggcaaccggcgacgggaggcggcggcggacggcgcaaagacggcggcggcggccgaagcggcggcgcgagcgaccctagcggcggcgctacgcggcgggcggcgcggcaaagggagagagaggaagagagggagaccgatcctcaccgaggggctcggccggcgcgagggaggagcgacggcgaacggcaacgacgagagacgggaggatgacggcgacgggttccgggaggacctagagaaaaggttgggaggggttagagagagggagatgaaccacggcgatcggaaacatggccgaaggcggcggtggaggtggtgctcacccgtgcgcgaggggatgagggctccggcgatgaacttcgacggaggaggggtggacggggtggatctcggccacgcgaatcgaacggcggcgacggcgcaagacggcggcgagcctagcgacggctagcggcggccggagtagcgggaagaagcggcggtgggtggttgcacggcgcggggacgatggggagcacgggaggggtcggcgatatggggaaaaagagagagggggtgccggcgatgcttaaataaggggagagggggccgcacgtggccgggagcggcgggaatcgccggccgacgtggggagtgggggaggagagagaggcgggattcggttttcgaatcccggccatctcgggcgcgggcgcgaacgggagggagaggggaaagagcgcgggagacgcggcgcacgcgcgggcgtggctgacgtggcccgggagagacggaggcgtgggcgcggcggcggtttcggcgcggcggcgcgccgggatcggcgggaggagggagacgggcccgacaggtgggccccacctgtcggcgaccccgagagaggaggcagcggggcggcctggctgccggactgggcctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaatttgcactttagtgatttttaattggttaaaattatttccaaggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcagaagagctggcgaagaggtgcggatgg

SEQ ID NO: 58579 - DNA, 995 bp, Oryza sativa
attcctgcagccctgggataattggtctcgtgtggacgcaactgtcgcgaagcgtatgcgaccactctgccttcttgcatcaacacacatcccaacccttggcgagatgcatcacagtagacttggaagtcttttgtctgatctggcagaattagaactggtgcggagactaacttcttcttgagttcttcaaaactttggttgcactcagctgaccatttgaatttttcatctttctttagcaactgtgtcatgggcctggcaatcttagagaaattttcgatgaactgacggtaatagcccgcaagtccaagaaaactccggatctgagaaactgtctttggtggggtccactttgtaactgattccacatttgatggatccactgccacgccttgagcagaaatgacgtgacccagaaatttgacctccgataaccagaagttacacttgctaaacttggcatataactggtgctccttcaatttctcaagtaccagacgaagatgttgctcatgttcctcttctgattttgaataaataagtatgtcgtcaatgaataccacgacaaacttgtcaagaaactccataaacactttgttcatcaagttcatgaagaaagccggtgcattggtgagtccaaatgacataaccgtgcactcaaacaacccataccgagtgatgaaggctgtcttgggaatatcctcttcccgaattctcaactgatgatagcctgatcgcaggtctatcttggaaaacaccttagctccttttagctgatcaaacaggtcatcaattctgggcaacggatatttgttcttgattgtgacctcattaagggcgcgataatccacgcacatcctcttggtcttgtctttcttctccacaaagatcaccggagcaccccaaggtgaagtactcggtcggatgtaccctttctgcagctgttcgtcaacctgcttcttgacctctgctagctcctgggctgcaggaat

SEQ ID NO: 58580 - DNA, 2885 bp, Oryza sativa
  unsure (1)..(2885): unsure at all n locations
attcctgcagcccgacagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgagcctgggtccagtgcgattcagcttcggacacttgccagcaaagtggccgtgcttgccacagttgaagcagtgtcctggctttcctacagcccccttcttgggttgttctgactgagctgacacagctggcggatctgactgagctggtgccattagtgggggtggagtcgagttgtggttgtgctgcttactgttgttgtgactgccaccgttgtagtcgttgtcgaagttactcgggtgatagggatggtgctgacagacgatcagggtggaaggcccacctagctgtcccgtcatgaaacgaggcttctgattgttcccctgaggaaagctgatctgagctgtctttctttttcggtctattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgccacgtcgtcagggagccgtagcgcgcaagggcggttgaactcgtgcaggtacctctgtannactgacatggttccttgctagaagcgcacnggaactctctcttctgttgtgccataatcccttcaggaatctgcgccttcctgaagctttgacaaaactctgcccaagtaacctccgttgcatctagacgggtcgccacgtagttatcccaccaggcagaagcgggaccttgcaactggtgtgtagcaaaagcaactttctcttggtcgttgcattgcagtaggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatggtctgctgccagatgcactactgacatgagctccatcggtctgctcttcgctgcccctggcgtcgctggagtcacggggatcattccttgtcttcaccatctggaggggataggtagaaataagagaaaggaagaaaacagatggctcggaaactaatctttcttatgaaattaagtgccattatcttaatcttgattaaaacactgaaaaagaggcacacaactcctaataaaggctgtcataccactcacacatgatatcgaccgccgactaacccacaagcaacaaacctaaacaccaaaaactagcacgcaaacagactaagaagacgataaagctaagggcggcgactctgaagcttggagcggcgcttgcgatcggagaataggtctgacatctaaagagtacagagggataggaaccaacacatgctaaaaccaaattaaataaagcaacgaatgactcaagtaacttgccgagcatgatgatttttatgcatagaacatttttcatgaacccggataaagacactaatgcgactgaccaaaccatagcttaatgcataaactagttgcatggaaaatgatgcgcataaaattgccccatcgaacatagacacgacctaatgcatatcacccgataaatccccaactgactgtcaaatataactccaaataaaatttttctaaaaccctagaccgagctaattttaaggatccgatccgaatgaacgaccaagatttttcccacaaaccaaagaggcaaaaccccaaatttttcccgaaacaaatccaattgcaaagaatatatgcaatgaaaaggattcagagggctcttaggtttttccatttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagagaaaagcgagctaagcctgaagacttgactcctgcagcgggcgactccattccacaggcaatccttgacggcagcgacgaaaccaacctcttcgagacatcttcaactgagaaggacttcaactctggtgtgggggaaaagagagcaagactgagtactacccacggtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactagccagttcattaagctaaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggaccctt

SEQ ID NO: 58581 - DNA, 1935 bp, Oryza sativa
aggtttggattatttccatatctgttgatggaatgaagacgcctagtcaaatcaatctattttctcaaaatggttgagtttagacattcaaagattgctgtgagaagaacgtggtgtacttaattactttatatttagggtaccatcttgaattcttttgagaagtccagatggaattgaaccattgagttgatttcctgtcagatctctaaagaagccatatgcccataaggtatatgtagatgtttgttaatacaaatgatgctaggcaataaagtaaaatttgacagaagttgcgaaacttacaatactgtcaatgaaggtaactgtgaaagtgcatccggaatcgaacctgtcaaattgttgtttgacaaatccctagaagatatgaagcaagactttgcaaattttaatgcaaaattcttacaaacaaggttaacaaattaacattattcaactcagaacgtacaagtattgaagagccttgagatccccaaaagaagatgatatctcaccactcaaaccactggaggacaggtttctgcaaagagaatgtgatcagatgaccctgtttcatacttccgttatgcaactccaatattcagtacgtgtggactcaattacttacatttttattacgtgtttggagttttcatagctgcatgtcaaactttcccatgtaaattctgtcggaatgcacggatcacccatccaattcttcttcacctgatacttttccttgatcaccatcatggcagaagctgtcaagtgcaaagatgatttcgatcagtaacacgcgccaaaacaattaggccatttcacttgtgtgtgtgtgtgtgtgtgtgttctctatcgtctatgtacataccgtcctgaccatatgtgccaatggtggtggtggagaaaacggagtacacctccatggcgttgatgaacggtcgcatcgtcgagttataggtggcgttgatggagatattgtactgcgggtatcgtaggaaggggttggtgttgtagatggcgtgggcgtagagatacactggcttgtagcccttgctgtacatcatgttgccgttgaggttgatgtagaattctcgcacatcacggctgggggggctgagctccagctcggagaagtgcatgatggcgatgtaccccggcgacgggtccttgggctgtgtgtaggctacccatgcgagctcgatgttgtctgtggcaaacattgggacaatagccgtctgcatcaccgccgttggcacctcgaacaggtcgtcgtatgtctgctgcaccggcctcgtcgttgatatctcggtccaatttgatggcgagtcccaaggtgtccatactctgtcgcgtggatcgtcggggtacctggacatgaatctcttgaaaatatagcaccttgaattgactattcatcgattattttcaccagtgtataccggccaacaggcaaaagctgaaaatgtaaaccattttctgtcatccgaaactcaaactgaggtcatttatactataccatactaccgtatattagggtggtcatactaattactacctccgtcctagtaatcgctttgactttttttcttttaacgtttgaccattcgtcttatttaaaaaattagtgcaaatataaaaacggagaagtcatacttaaaaagtacttttgataataaagcaaatcataaaaaaaattccataattttttaataaaacgaaagatcaaaagttataaataaaaactcaaagcgacaagtattctgggacagaggtagtatccaatgattccattctattctattaaaattgacacttgttttatcggtattatagtacaccatcggtataaatattatatggatattatggggaaaatatgcatatttataatttgttgcgcgcgcgtgtgtttggagggacgacaacctccaccac

SEQ ID NO: 58582 - DNA, 1222 bp, Oryza sativa
ttcacctaaatggttaaatcaacatgcacgtaaaggactcaaactcggatggatcgttactcacctgatgatttcggtattactggtcggcccgaatttccatctaccgaacaaggacaggccttgcgtctcggttgcctgcgggtagagcttcttcttgagaggcctgaggtccaacccggagatgaacggtgtcccggtgccggtgttcacgaggcaaacctgcacgaagtcgtccggcacgacgacgatggcctccaggagcgtcgagccggcggggtccgtgatgttgaccatcatccagaagttgacgccgatgtagacgtcgaagattggcagcttgctgaggccgtcgtagttgccgtacatgaaggtggcgcggatgaggtacttgtgcccggccacgagcgaccggagcgtgtagcagttgcgcgcgccgtcggggaagctgcgcacgttgtagtagcgcgccgagagcgccggtgcgaagtactccgccgagatgttgtggaacgagccgccgtcggtgaagccgtcgtccgccgcgtaggaaatcttggtcttgtcgtccacgtagctcgtcttccccgggaggccacagtctacgctgatgaaacctacggcgagtcggcgacagcgacacacattagctagcgataactgcgaaattatggacaatctatgctagatcttagttcattgattggcatgggttgtacttgtagctttgctgtcaagctgggcacgagcttggagtatgccggcggtggcggcgagggcgaggcactagaacataataaaggctgaactctctttgtgatcgtgctctacctatttatagccagtcttaatccagtgagcgtaaccatgcaggtaatcaagttggaagaaaattgcgtaggactgaagtcctacccttatctgaaggacttgattcctctgcacgacacctgtcccacatgaatctcagaatagcctttctccctcatctctccagttcccatttatctatcttcctatcgtcggcgaggcgtcaaggtcaagcactcaagcccgagcaccaagcgcaacgcgctcgtgccctgtggcatcaagctcatgaggacagccgaaaattagagtcaaatttgcctgccgacctgccgcgagaaaaatctttggtttggaataagctgggttatcgattagatcgaatccatctccatgaacgggctgcaggaat

SEQ ID NO: 58583 - DNA, 2522 bp, Oryza sativa
attcctgcagcccgaagagaaaagagagttagcctattcaaagatttgcgcaagaggtgccggcggcgaggtgaccggcaggcggcggggcgtaggaggcggcggcgagccgtagagatcccgacggcgaggcggggctcgcctgcacacgggccgccggatctggctcctttctcgccggatccggcgcccccctccctccctcccactagatctggcctctccggcgaggaaggccagctcccgacgacgagacaggtacagcagaggaggcagtggcggcggggttgagggcgcggtggcacgtggtgaaggggcaggcggcagatgtggccctcggtgacggcatcaggcatggggagtccagcctgtgaggcccgcgtctacgtcagtgagtggcgccggaggcagtgaaaaggagaatgtgtggaggtacggcggtgcttgaggtgtagggggaggctggacgatgaggggtgacggagggaggctggcgcggcacaggtggcgccgacggcagcgggaggtcggcgtggcatgcgatgcggcgggcggaggcatgagcaagtgcatccatggccggcggggcacgcccagcgcgacgagtggctgtgaccagcggcgggatgtgtaggcgtggtggtgaccggcgatggtcgtggattgggcttaggtgctaaagggatggtgtggtggtcgggcaatggtcgttgtacaggatggttgtgtggagttttgattggaatcgctggcgaaagccttgccaggccatgggccggcatgacgacaacgacaccattaggcgtcgttccccttcttgaaggcgtcgttctggcgttgacctctcctggcaccaagaaccttcccccgtgcaacggtagtcattggtggactcctgcattgcctctgaagctctacaagcctaaggtgtttgacaaggtcttctctgtcttggttctgtttcttgctctacggcaagtgttcatcattcttatttggttactgctgggtagagtcagagctgcttcgctgtaggggtgcgacgaagttcggcaacgatgacacactgcaatctctttataagattgttgatgccagctgtatgtaggaagtggttccttggttgtttgggctaatgtccttcatgggtatcgtttatgcttgttcttttggcgttagggtagcattcgagtgaagtcgaagctgttgtgtcgtttgggcggcaagctcagtaacgaaaacatgtgtgggctgttgtgtcgccactatgacaagcttggtcgatgccttgtgtcgggctccgtcgttgtaatttaggttatgttagctgttagtgtggtgttgtagttgtggttttcgttcaattttccctaattaactggacactgtaaagtttggtcctgtttactccttaaattggggcaccttattcttaatataaaacgtcggcaatggcctgatcgttgaaaataaaattgtgtaagacatgtgtcaagtagagagacaagtcctttgaacgaggtgtaggacttcggtcctgctctgtaattttcttccgatcaaggagagatggattctaatatgtgatgtgaatgtacactcttttttttttcatgtaaactaaatggttataaaataattttttaaaaaaataacaagatagattatgtaatatattacttcacaaattaacatacaagtttaaatttgacttctctaagtaggaaaaaaataactagtcgattttgaagttgcatattcgtagagtgatacattacatattattaatacctatcctgtcaactttttttaaaaaaattcataaccatttagttgacatgtaaaaaagggtgaacgtccaaccaagtgcttaaaatagttttctataatcaagataattatatcactatcactagcaaatagttaccgtctccatgttttaatatcgggaatgctaggggacgggataccgtcccccaacgggatagctcctctccacaacacgattcgcgtccctcgccgctgccgcgcccgtcccccgtcgcctccgcgcccgtccgccgccgccgcgcccgtcccctgtcgacgccaccgccgccgccgctcccatcccccaccgccgtcgtcgctattctccgccgccgccatcgccgccgcggcgtccgtcccctgtcgtcgacgccgccgccgccgccgcgcccgtcccccgctaccaccaccgtcgccgcgcccgtcctctaccgccaccatcgccgtcctcgtctacaagggacggctgcagggggcgaccgcgtgtgtcggggtgctcctccccaacggtatgcccagctatatctagtaggaatcacctgatacctggtaagtatcatccgatacctcgcaagtatcacgtgagacatggtagaaatcgtctgatacctcatgagtatgacgtgatacgtggtagaaatcgtatgatagatgacatgtatcgtatgatacctcgtgagtatcacgtgatatgcggttggggctgcaggaat

SEQ ID NO: 58584 - DNA, 2923 bp, Oryza sativa
taaaaacattatgaatgaagttcattgattctgagttccaaactgaaaaaagttctactaaaaaatcttgaatatttgaaatttctacatttgcatttgctttggtgtaacatcatgtgaaagttccatagagatctctaccatgaaatggcattcaatcgaaatgagcaaaataatttatcgtgcagcaggaccgccagtgattgatggtatccttccaaaattttgctccatctctaatgtagagttgttctgacgcaaaccagtggattgttaagtggtgtagaagttagagtttagatcgccactattgccattataaaagccattgtttatatcactgacctggtgcttatcctctagctcgaggcactcttgcaactgtgccaccacgtcggtcatagtggggcggtgtgctgacgaaagcgccgtacacttgagtgcaatgtctgcaaccttccataggccattcacatcgtagtcaccatgcatgcttgcattcaccacaccctcaatgttaccccgtgctaagcgttgttgtgcccaatggatgatgctgatgggctctggatcacgcaagatagctggcttccctgttaccaactccaacaggacaacaccaaagctatagacatcactcttagtcgttggttgcattgttgattggtacctacgcatttggtcagtcccaataagtcttacaattagtatttctctaacaaaagaactttaaaaaaagggcttcaagaaagacaacatactctggatccacatatccaggtgtgccaacaagtttgttcgtagatacatgggtgccgttctcaggattgaaaaccttggacaaaccaaaatcagcaatcttggcctctagcctcgtgttcaacaaaatgttggttcccttcacatcacggtgaataagaggagggttgcaccctttgtgtaggtactctagccctgatcattaattcaccatgtaattgaaatactgatcaagcttctagagagagaaaaaatgtaaaatcaaactaaaaatagcattagaaattctaagtagttaccttgagcagattccagcgcaattcgaagcctctctttccaggttaagtatctcccatcatttccttttcctgcaaatataagaattggagatcatgaaaggactaaaaaaataagctggtagatgaagttagttcggacctgcaatgtgttcttgaagggttccttctgacatgtactcatacacaagtgccatatatttctcatccttacaatagccgatcatagagacaaggttcttgtgatgaatccgggttaaaatttgagcctaaagtggtgaaacttgtctatttaatgatgcccccatggagacttttcttgatagaaatttttacatagcaagaaaaagtgcagcttaaaaaattctacctctacaagaaactccttatcaccttggttggaagattcagtcctcactttgactgccacttcagtgccatcctccaagaagccatcatagacttttccaaagcctccttgtccaagaactcgctggaatttgttcgttatcttctccagttcattatatgtaaaccagcggttctcaagccgcagtgatgaattatgcccggagccattatttgttggcccatatctcattgtctcgttttgtcgctttacagaattgttcattgatcctttgtacgtgaagaatggaactagcatcagtagtattcaagaagatgaagtagagcagacaaatgatagcaagacccaccttgtttttttcttctcagtaggcaatagagtagtgtcgtcactgatactatcgcgaggaccagaactataggaacaacaatgtagatagctagcttgctcttgttttttggtggttgacatgagttgccattggtgcaaagatttgggttatttccatatctatatattaatgacataaatatgtttatgtccattttctgaaaaattgatctgcaccttttgctgaagaagactgctataagaagaatgtggtgtcattaccttagatttaaaaagccatcctgaattctcttgagaagtccaggcggaattgttccatttagttggtttcctgtcaaatctctaaaagaagacatacagtaggatattagttcaaaaggattctaaagagtacgtaggtaaaagagtaaagtacatggtcggtccttaaagttggagcgaggtgttacttaggtccatgatcttgaaaaatagacattagggtccgcgatcttgtttaagtgactcattgaggtccaaaggacctctgaccaggttgactggcttacgtgaccgtccagagtggcagtatatttgcatttcgcccccctcccccgcatccgatccaacccttcttccccatatcttctttcagtatgatttctatggtttgcggttgcaggggctggcggcggcagtgacgacgaggagggagacgggtacggcgacgagttggcgagcatgcgcaaagagggagaagggcgagtagggcggtggcggcggctggccagtggagcgagacggcgggcagcttttagggttttggagggttcgacttggggcggtgagggcgaggtggtgtcggagagggtgaggggacgatgaaggggttcgacgccaccaatgggttcggcttcatcactcccgacaacggcggtgaggacctcttcgtccaccggtcctccctcaagttcgacagctatcggagcctcaatgacggtgatgtcatcgagttatccatcggatccggcgacgacggccgcactaaggccgtggacatcaccgcgctaggcggcggcgcgcacaccggtggatcccgtcccagctgcggccagatccctacggctgcaagccgccgtctctcgacgtcccctcgttgtctcctggc

SEQ ID NO: 58585 - DNA, 3537 bp, Oryza sativa
aagtaccagcacgagggtgacctccggcgagctcgctcgtgtcgtccctgagctcagccgctgccgccaccataccccgagtcgtcgccggtccaacctccgccaccgtggcctcaagcttgtatagagctcagctgccggagcttgacgccctctgcccttaccgctgctcccttctccttcggccctcaaccgcgcgcgccgcgccttcaaccgtccgccatcgctgtcgttgtctaccaccagctgcgccatcgttgttgtccaccatcagccacccgtcgtcgtcctcaccaccagtgctgaaagaagatttggggaagaagggttggatcggatgtggaggagctcacatgcaaatatgttgccactctggatggccacataagctagtcaacccggtcagagatcctttagacctcaatgagtcacttaaacaagaccgtggatcctaatgtcgatttttcaagatcatggacctaagtgacacctcgctccaactttaaggaccgaccgtgtactttactctaggtaaaagttgataaaagaattgccaaacttacaagattgtcaatgaagacaactgtgaaagggcatttggaatcgagcctgtcaagttgttgtttgatagatccctgcaagatatggagcaagattttccaaattttaactcagattacgcaaacaagttaatacatccgacatcatgaactcataacatacaaatattggagggccttgagattcccaaaagaggacgatatctcaccactcaaaccaatttttgacaggtttctgcaaagagaatatgatcagcccaatttcattgcacagttaattagctcccattagatttaatttcctcttgctatttatgcatgtgctgatttggcattctgagggtgctaataataataataaaaaagatcaggctggtgattgatggtggtatcgaccaccatagattgtattaaaatttcatatcaaataaaaaattctattggaaataacatggggtcttaattaatttttactgccatgcatggcctctttagtttcattagtatcctaaaacttaataatttctaaattcacaagcaacaagtatatcatctcttttattaatttaattttgaactttaaattaataattagcaagttataattgatgggttctctttaattattttaatctaagccattaactatgcattgtgtatacaattaaaattttcatatttacaatagtttaacaatagccatacacgtttgcactctttttatttgggatggaggtaatagttttgttttttcatcacaatagtcatgttgtttttggctaatggaatgaattattacttacaagctcgtgattcttgcagggttagaaatggcatagctgcaggtcaaattatcccacgcaagatttctagggaggcacgggtcacccatccaattctttttcacctggtacttcgccttgatcgtcatgattgctgatactgtcaatcaccaaaaaatttcatcaatgcacatgacatgcttgaccatcagctagctcatgtatgtgcatatttcagtttttctcaaattttttatgaatttagtcaaattctgttaaattgtgtcaaaatttcagaaaatttcggtccaaaaatttctgaaattttcaaaattttaaaaattttaattctaccgaaatggctgaaattttagatgaaatcgaaattgaaaaccctgagcacataccatcttgtgagtcggtgccaatgttagcggtggagatgacagagtacacctcgacggcgttgatgagcggcggcatcgtcgagttggcggtggcgttaatggtgatgttgtactgcgggtgtcgcacaaagggtttggagctgtaggaggcctcggcgtagagaaacgatggtgtgaaaccatcgtcgaacaatatgccgttgatgttgatatagaattgccgtgtggcgttgttggggaggttctcaagctcggagaagtgaaagatggcgatgtaccctggcgctgggtcgttgggctgcggctgtgagttccagaagaagtcgatgttgttggaggcgttgattggcgtgaccgctgtctgcatcaccgccgtcggcgcctcgaacaggtcgttgtctatgttctgacccctgtttgtcgttgatatctcgttccacttggccgcatcaaaccaaggaaaccatactctgtcgtgcggatcatccggatacctggccattgaatcgatcagttgcatttcctacagataagggtaattttaccatccttaaaaaaaatattagaagatatcatattttctaatttaaaaattggtactttctcaaaaaccgtaaaatttatctacagagaattagagcaagtttaatagtatagccaactattagctccaatttatctatagccaatctaatagctcattcatacaatagtacatactacactattagtacctggacccacatgtcatacacactgtgtattggagtccatgctacagctggctataaatctgtagcccgcttcccttctctctcctcatctatttccttaaaatatgtttgcagctggcttatagcctgctattgtacctgctcttagctaaatatctggctcttatcgggaaaagtgatttcatcctttaagagatatcccctcattttgcatgttggtaatcagaaaaaatatatgaaagtatctgtaaatacgaatctaatattacgctatttatatcactaaacctatatattgtggaaaattttatgatatttgataaagtgcctaaagataccaagattttacaccaataattttgatacctcaaaatatttagtaccgggaggtaccaaattttacactaaaaaatatgatacctttcgataacttcttaagaatagtaaaattaccctatattgtgagactaacttttagttaaaatttatcgagtttgaattatcaccagtaatactgatgatagtataaataaatgatatgataataaatataaacagtctatacgcgtaggaaactttaacttagctcacctgatggaggtttcgtcagatgggccgaagttgagcctggcgagttggagtaggccctgagtggcgttcacctgcgggtagagcttgttcataagaggcctgaggtccaacccggagatgaacggtgtcccggcgccggtgttcaccaggcagacttgcacggagtcgtcgggcacgacgacgatggcctcccggttcaccggctggatcgggtccgtgatgttcaccaccgtccagaagttgacgccgatgtggaggtcaaacgacacgggcagcttgttgaggccgtcgtagttgccgtacatgaaggtggcgcggatgagatacttgaggccggccacgagcgaccggagcgtgtagcagttgcgcgcgccgtcggggaagctgcgcacgttgtagtagcgcgccgtgaccgccggcttgatgtactccggcgagacgttgtagtgcttgccgccgtcgg

SEQ ID NO: 58586 - DNA, 2660 bp, Oryza sativa
gtactacgtacctttgctgtcaggctgggcacgagcttggagtacgccggcggtggcggtggcgaggcagagaagaaacaacgacgaccgtgccgccattgttgccggtgatgaacgacgctccattgcacatgcagccatgcatgcaggtagcaaagctgctactctctagggacgtgctccatctatttgtaatccagcattccagctagtaaacaagtgaccaagctaataatctcactgtcacaagctaataataactagccaattgatcatcacaaaactcaatcttgattaatttaaccacgtcactacgtcagcgcatctatccagattccagtaacaaagagcgcctcgctttgtgggtcatatagatattcttccactgacgagtggggctattcagaatttacactggccacctctttgtgggcccggcatgtcaatgaccctgagggaagaggcgagtgtatcacatgggccgggagttgacttgtagcccgctggtcaactgctttgctgggcgaaggacttggaggcccgagatcggtggccacggcccgtcgacttgaccttattttccgcgccggaaactatgagcaacaagattattatgcacttgcccactacgtaaaagaatttgttctctctgtcagagaatgcatctgaatctgatctggcagttttgcacaagagacaggcagcgcaagaagatatattttgcctctgacggactgcggctaattagtactaaacataattaggtacctaaaagttttagtaggagtatctacacgactctttggattaaatgatttggtgttttctaaatctccaattaaaacttgcatgcaggtactctagaacaacacaattcagttttaggctcagctgtaacggcgttaaaagaaccaggacaatattcatctcgcataccggaaactggaaacaccggttatgcaagtattcgtcaatcatgcatgagatttagtaataggattgctatgtaagtaatatcttttcaaccaatagggctccaaagaaacatttcaagatcttcatcctgctgtgcctttggtgtctctggcttcacagacacgacgtggtgttccgcaatgctcaaccatcactgctttcagccctgtcaaaatgccaataggaagttaacctctgggcggttcgctttggtccgaaagaccgtgatattattctggcttggaaaaatgtaatttcatcctctgttcatgctctaaattagttgtaatctggactgtaatccatcttgtactcaagtgctattgcttattgacagtttgaatgaaattcaggtggggaatctctcccctccagtgacttggtaaaaaaaaatattttcaaccaatggcaattgtttcttgatttgttcttatctaatgtgcagccaagtcttggcggagctggcggcacaagaaaggagcacatccaaggctacggaagtcattaagggtgtgtttggtttctcgtatgtccccagcctggccgtatccctcatccaggatgccctcagcctggctagggtaatgcaattggttgtgtttggttacttgcatgggtttatcctggatgatatgagatgttgtttgggaggagctgcgggagggaaggtgaggcaaacgagcacacccgctcagcaacgagcactcccgccggctacgagagttcgcagcagagggagcacccacgacggtgcacaggagccccaaaccctagcttcttctcctggggagtgaaatgaggaggggatgtggccgtgcggggaggtaaccctcgcctgcaacgaggggttgtgtgggtgcagttgcgctgcaccggatcagcctggatgcgcagcgatgctcccccctcgcgtttctgctcaacttggcccagacggcgattttgaatccgcctagcctgactcgcgggccggtccagccaaccaaacaagttggattttgctggcttgatgcgatgcaggtgcggtgcacccattcaaatacgccctaattgatgaaggtggaggcgcggggaaggagcaactacaagtggtcactagcggaggcggccatgtggtcgccggcagagatggctgagtagggatggagcaacccctcacggggaggaagcaacggcaagcagctggagtctgtggacagcagaaaaagtaaatagtagaaaatccttttatcaggaatttttgtctaacaaaacgaccttagaaactctaactaggaatgaggctactgagtagcagtaatgagcaaaatattaacctcttccgtgttatgcttgctcctgaattcttgaagtcatttatggcttcttggagtgcgtgatgagtcggcagcaaattattcgcgggcttgatctctctcctctcacccccatcgtcatcggctcacatcattttattacacttactcttatgagtgaatacaatggatgtgacccttgttcatgttacatgatttccattgcttgctagtccactaagtgacatggattccatttgatatctcatcttacattatcaagcaaagtacatttattgtgggaaatcataaaatttggattctaaattcttgataactatattccaagataaaaaaaattattaggtgtatattgacttttctcttctt

SEQ ID NO: 58587 - DNA, 4402 bp, Oryza sativa
agtaaccaatcatagagacaagattcttgtgatgaatccgggttaaaatttgagcctaacaagtgaaattaaccaattatatcccactagcaacaacttggtgtaagtataggcaaagcaaaatatcaactgcagctgaagaaattttacctccgcgaggaactccttagcaccttgattggaagattcagaccgcaatttcactgccacttgagtgccatcctccaagaagccgtcgtaaacgtacccaaaccctccacggccaagcacccgctggaagttgttcgttatcttctcaagttcattgtacgtaaatcgacgattcttaagttgtagtgatgaactatgcccgtatccgccatttgacgacacattgctcactgtctcattttgtggcttcacagaattgctcattgctgctaaaatatgtgaataagcatcactagtgttaaaaggatgaacaagtagatggacaattactgtgtttataacaaacctcaccttgctttttccgtctcaacaggcaacaaagtagtactgccactgatattatcaccacaaccagaactataactattggaataactatgtagatagctagcttgctcttcttttttgctggctggcatgaatcgccattagtgcagaggtttggattatttccatatctatcaatgaaataaatatgctgagtcaaatataatttattttctaaaattgacctggggttttggcaacttgaaaatagaggtgttatggtccttaagaggtactccctccgtcccatacaaaataaacctagtatatgatgtggcacatctctgtctagaactccagattcgttgtgctatgatgcgtcatatttcgtactaagtttgtcttttatgagacaggggcagtaccaaattttgttatcaacttggtaccttctcaagtgttgtaaaagttctctttaattagaagatattgatgtgtatacttaccttagatttagagagccatcttgaattctcttgagaagaccagacgggatcgatccactgagttgatttcctgtcaaatctctaaaggatgccatatcggttagaaatgatgctaagtaaacaatacatgcagaatttggtaaacttgtcaagttactacaaacttacagaaatgtcaatgaaggtaactgtgaaagggcgtctggaattggacctgtcaatttattatttgacaaatccctacaagatattggacaagagatttttcaaatttaacacgaaattccacaaataattttaacaagtgaacatcgtgaactcggaacttacaagttttgaatagccttaagattcccgaaataggacgatacctcaccgctcaaaccactggaggacaggtttctgcaaaagacagtatgatcagatgacccagttgcaatttgcaattaataatctccaacttaaattttttcccccttttattttttttcatgaccacaaatccttactagctcgatacacatggactgaattacttacaggccaatgattcttgcagggttagaaatggcatagctgcaggtcaacttgtcccacgcaagcatcttcggaacacatgggtcacccatccagttcttcaccacctgatacttctccttgatcgccgtgattgcagccactgccaagtgcacacatattaattttcacaaacacgcatgacatgcttgataattaatcttacatgtgtctgcaaccaatgtgcacgcacgcacgtaccgtcctctgggtcagtgccaatggtggcagtggggatgacggagaacacctcgacggcgttgatgagcggcggcagcgtcgagttggcggtggcgttgatggagatgttgtactgcgggtaccgtaggaatgggttccggttgaaggtggcgtcgttgtagaggtactccggcttgaaggcggtcagggaccacggcttgccgttgaggttgatgtagaactcgcgcacggcgttgccggggaggagctgcagctcggagaagtggaagatggcgatgtacccgggcgtcgggtcgttgggcagcggcacggggtcccaggagaactcgatgttcctggaggcgttccgcggcgtgatcgccgtctgcatcaccgccgtcggcgtctcgtacatgtcgttgtctagatcctgcactttcttcgtcgatgatatctggctccatttggtcgagtccacccacgggaaccatatcctgtcgtgcggatcatccgggtacctgcagcaatgcagctcgatcaatcgatcagctaagatcttaatttttttttagataatggaaatggttaacgtaagatatgaatttaaattgaggcttggatttaccttatgacgtcggtgtaatcggtcgggccgaagttgagccggccgaggaggacaaggccctgcgtggcgttcgactgcgggtagagcgtgttcttgagaggcctcaggtccaacccggagatgaacggcgtcccggcgccggtgttcaccaggcagacctgcacgaagtcatccggcacgacgacgatggcctccacgatcaccgcgtcgccggggcccgtgatgttcaccatcgtccagtagttgacgccgacgtagagatcaaacacgggtagcttgttgaggccgtcgtagttgccgtaaaagaaggtggtgcggaaaaggtacttgagcccggcgacgagtgaccggagcgtgtagcagttgcgcttgccgtccgggaagctgcgcagggtgtggtagcgcttggcgagccccggcgtgatgtactccgccgagatgttgtggcacgcgccgccgtcggtgaagccgtcgtccgccgcgtaggatatcttggtcttgtcgtccacgaagcccgtcttccccgggaggccacagtctacgctgatgaaacctgcagccaagcatattacacacgctagcacattgatttcattgtgaagcagcactacctagttgcggatcaaaacttgaaagacaggacatggtggaatgtaccgttgctgtcaggttgggcacgagcttggagcactccggcggtggcgacggcgacgaagcagaggagaagcaaccacgaccgtgccgccattgttcccggcgttgaacgctccattgcacatgcaggcagcagcgagctaactgaactactgaagcataataatagggacgtacgtgctctttttatatccagcgttaatctgcccagtaaataagtatcaaatttaacattcttaatatcacttactacaactagccttttatcacaccatcgaggttagtttaaccacgtcagcactcagcacatctgtccagtcgtcgcttgccaattgtcgagcgccgtagtcgacgcgtcgcatatgtatggactgtttcctctgacgggtgggcctattctgaatttaccaaggccagtagggcagtaggccacctctttgtcaatgcctcgaccctctatggccctggaattttttttacccaaataaaatgaccctgcaactaactggggaattgacgagcaaatcacatattcacatgggttggagttgacttcagtgcagctgggcgcatgattggccagtggactcttgactttttcgccgcgccggaaactgcgaccagcattctgtgtgggcagttcgtgcagatcaaatcattggccatgatttcatgagagctcgttctgcattttgcgtactgcgtactggtaattgttttcttattatcatcaacgattttgccagcttggttgttgatcttgtggctcgtcccagaattcgtctgaatcttatccgggacatctggcagttcggcacgggactgacgggagacacgcagcatatgatgatattctctgacaaactcctgatctgctgtttgtgcgcagaatacttagtagtaagtggtatagtattccagtaaccaagcaggcctaatttgggtaccacaacataaacgcattgcactgcagtgacagagacagaaaaggtcaatatacgatcagctgacgaaacatatcttcagatcagcagcatatacaagacacaacacgagtgttgcttatgagaaatagcttcatcaatagcgcttttcttattacgcttgtagttaccagcaatccaggagagtatccgtggattcatacaggtgatattatgcatattaaatcaaaactgcgtagcgtggcccaggtttctcaacgggaatagcaacagcttctatatagaactacagattggattcatctcgctgttcgaggacgatgacgcagactggtcgaaagggtttgccacatgatggagttcatatctggctgttcgacgaagatgatgcagactggtcgaaagagtttgccacatgatggctggggctgcaggaatta

SEQ ID NO: 58588 - DNA, 1009 bp, Oryza sativa
cagtagacattgtctgatgcattgcttggaatagctcggatcatgtaggtaggatctgcaaataataatagggaacttcacaacttagtacaatagagaccagtaataagatgtgtaacaaccttatcctgtgtgaagcaaacatagttacctatatatttaatagtcatctccatctttttgctcttgaagtggtcctacaatagaagttatgaatagtgagtagaagaaaaagatgcatgcaagaagtgagtaaaaggagtgatacttgaaagtcaaagtgaactgtatggcaaaagtcatcacagttttcagtgggaattgcttagtgttttagttacctatattaacaagagcagcagacctgaattcagaagcaaaattaagtgttttgtgtacctttatcttgtgagtcagccaaagaccaatatcaagcagtagcttatttcctgatgcatcttgctgctcagaagtagataaacttttggctataagatcctgccctgctccctcagcaacaacaataaccatgtgcttgttctctttcagccttctctctacatattgaagcaacccaccttcaccatccatataaaatggggactctggaattaagcagcagtcctgtggagatttgagatccaaaaaataaataagtacaactcttaggtagacctcggaaaaaaaaaactactcttaggtagaagtagatttgtggggtaaaccagaaaagtaggaatctcactactgtatgaagaggggggataaaatatacaggaattagacagaatggttgcatctgcttaccacatctcgacttgcaagagtagcatacattgcaatgaaccctgcaagatgaatataacagtttaagggcaatagactgaaatacatactagagaacagatagcagagtaatcaagcattcaagcttgaaatacagaaaaatcaagagatcttctgcatgagtacaatcacaggcaaaaggccaaaatgggctgcaggaatt

SEQ ID NO: 58589 - DNA, 3117 bp, Oryza sativa
gccaccaatatgaaaacaatgaggtaacgataaaataatatttaaatagatataccgtatgctactgcaatgcattgatgaataggatctattatcacattctttcagcaaacagcatacatagcacttgtacggttgtaccacagtggtaaattaccttgaagatctcatatgcacccttctgtgttccatctcctccaatgatatagacctgggtaatgtacataagcacatgagacaatgaccaatcagaagagctatatcacataggtgcaaacaaccgcatttacctgattaattccacgatcctgaatgttgtcaacaatcttttttgtatcatggccacctcgtgatgtgccaagaactgtcccacccctcttgtggatgtcatcgacactctttggcgtcagagtaaggtaattgctagaatagaagcccttgtatccattctatgataggtaatataaggtattaagaggtagaagatctggaaatataatgagaactgaacgcagtaatgattcatgtttatagttgccatggcaagcccttgtcagaacacatatccattgttctaaacttataatacaagtatacaaatttataattgcattttactaaaacaatccaaagcagcttattcaatttgccactattttagtagaataatactataaggtttgaatatttatggaaatggacattatgcaatacaaaatgattgataagcagtgataagaatctgaagatcttatggtaagctggcatatcctttctggaccaaagaaaaattagaaagatggatcaagcatgtctggaaaatgcaagagtagtatttaactagagtatttagggcctattcactttgatgccattttcaaccttaccaaattttagcaactggcgggatttcttatatagttaccaaaatttggcagtaaactaaatgtagccacttttttggcaactttaccaaaatttggtaaggttgaaaatagcatcaaagtgaacaggtccttaacatgcgcaagctgtctttctcagtgaaaaaatatgatactgtaagggcctgatcactttgatgctatttttaaccatactattttttggcaaagttaccaaaattttggctacgtttagtttgttgccaaattttagtaagtgcatatgaaatgttgccaaaattttggctaccaaaatttaacaatgccaaaacttggtaaggttgaaaatggtagcaaagtgaacaagcccttaactatctattgaagtattatgtaaccatttagagaagggcccacacctgtataccatagattttgctgacattatacatgtgcgccaaaccacagacgagctctctgatgacagtgttaagaccagggcaaaggcctccacaagttacaatgcatgctttcacttcatctgactcaaaataaacctaaaggttcaagtccaaatgtttctgttagcccacgcgcaagtgatgagtttcaatagttaaaagagggggcagcatatcataccttctgacgaggtccagcacgacggaagtgaaccccccgccggctgttcttctgaacgaccacctgtaagcacagaaatagctacctgtaaattcaccatcgactacaacatcacagtgtaaaccataattaacactgctttaccttttggggtacagtgtcatcttcattaacaaaatattgcctgataacgataagaacaaaagtttcaggattacacatggcacaaattacaagctcagatattagaagaagaaaaaaagtggaagatcaaagccttacttgacagttgaataggctggatgatcttgtagtggattgggataagtctgcacatatgaacaaaatagcaaatcatcagctcaattcacatggaccatggtttcacctttccagaaacaattcaatccagcacagtgaattggctataactaactcatgctttggcagtgataagcaaccagccaatagtgacagttcttccagtggagatatcctccaatctactcaatcaaatttcctatcccaaaagcagagaccaaaaagcccaaagcaacaacttattctgttactacataacataaagcgtcaatagcattgcagcgaaattttgacaacttaattgctctgttctatcatgccccctttcgctcctaacagactaattggctcactgcatgtccaagctcaaattcgacagtctaaaatcagcacagtatccaaaatggatttccaaaccagaaaatctgatagaaaaaaatcccgcaaacatcgcaaatgacagcccccaatcagggatccccacccagatcacttcgctattcgagtatacttagctagagctgcacttcacacagtggcacagttcaacaacgcaaaggccatcacaaaccggaacgatcggagcatcaccgcagcagcagcttgcgaatcgaagcaacgggaagggagtgtcgggagggggccactcacgggggcatcggggaggtggtcgacgaggtgcggcacgtcgtcgaggacgtagccgaagtccccctcggagatcttcacgtaggcggcgtcggcgaggctgacggaggaggcgttgcggagggcgcggaggttggggtaggagtcgcgggagatccgcacgcacgtcgcggagaacggcagcgccgccttcatcgcgtgctccggcgccgcggggggaggcccgctccgcgcccacggatcctcgtcctcctcctcctccagccggcgctgctcctcgtcgtcgtcgtccggcggaaggatgatgtgggaggacgccatgagaagagcaagtggtcgggatcggaggaactcgctttcgcttcgtttcgcggcgggtttggggaggcgtaatcgaggtttagccttttgcgggcgagaagcgaacgaggtcgtctgtttttcctggggtttaataatggcgctcgatgtgtgagtgagcggcggtggtggtggtggggtcggagcgtcagcgaggggtccggtgcgggccgtgcggcggcgctggttttgtgagccgcgcgtggcggtttttcggaggttgggctaagtttgacgccgtggaaacgtgtgggctgcagga

SEQ ID NO: 58590 - DNA, 3865 bp, Oryza sativa
ccgattcgcatggatgcacatcatgcgctgccagtgccatcccgtgcgagatggcctttaggtctatctatttacctgtttctttaggccttcatttaatccctctacaagagaattgagttaaatttaaagagagtatcttaggaaaagaaaaaaaatacggtatcggtatgtcatacgtgaaaatgatattttagctgtgattgtgaatcacgttctggtgtgcttcgaatttgcacccggtgtatgcatatcttaggaaaagaaaaattagctctacggatcaaccacctggaatcaggcaggataaattcagtaaaatcaaatcccagtgccgtcgcccacaggctgacaggcatacgtatgctggttttaggaagagggcacggtcggccggccccataccgcatcgccgcccgccatgtcgtccacgtccagaagcaaagccgagtcaattcccggcgtcgcgtaactggcttgcgccgcaggaaacgaaagctgcagatcccatgtagacagatcatttattgacctttgcttacgaaacagcacaataggcggcggatgaggggattataaactcagagtttgttttcatcttgtttgcattctcaaattccaaaacgttactaccaaatatacatacagtttttcatttccgaggggaaatcaaatttgtgttccgctattaatccgggaagttggctgactaagctccatacgcaagtacgcaacacacagactgacaaatagaaatactctttttactcgtatatgtttacagcttgttggtacaaatgggcaaacacgctaataaaaaaaacacctgacaccgatgaataggcaaatggcttaaccatgaggccataacatctgattctatattaaaatgtaaaacaggaaggacgatattggcgtgcgtctgaacaaaaacgcagcatgccactgaacaaaacgcagcatgccgccgaatgatttaggggccgcggaattgtggcagcatgatcacatgcttagttgagaacatgaatagggagggtagttgatcatgcacccctcatctgtccagcaaaaattgtgtatgggctctatttattccagtcgatggccatttggccactgcaaagctgcggcttgaaattccagaacaacccacgcaggtccaggtgctgaatgctcacttggaatggaacttgcgcctgacagattcgtagctaggcacatgaataactgcaacacgagcgtttcaattagtcagtgctcagactctcagagcttgcatagggccatgctttaacttccaagtttcgacataccatcaccccatgatgccaatgtaagcggcgaagaaataatcttctttgcagttgaagaaatgtcatttaaagtgatctcctcaacagttttcaggaagtactcaataggtttcctgcacaacacaaagcactccaagataaacaaggttctctggcaaatggaagtgactatctaaattaataccctatgcaattgctggattacttagaaaaaatgctagcttaacagatttagcactgctgcatgcgtcaaatgtatgaacctctgcctcatggtactaaaacttctggctcacttctaccatgtatgtgcaccttttctagatgcaacggcatggtgatgacaataagtttatagcaccaatgggcacgcagaagaaactatagaaataaatcctgaatatatgcttggacgtgctggcagtctgacacccaaaatactttgggtgataccataaaaaagcatctaccacaccataaccacagcatcactttggaaaaggaacaccacaaccacagtaagtgtgtccagaacacagtattataggtgacttgtcaaactttgggacatgattgcaggaaaaaaccacaagacaactttagttgcctatgtaatatggtcaacatatattgcccaaccagcttggaaacataataatttacgcaagcgtacatagattgtgatagttcatggtgatgactcattattttacgcacattagtaaaaagatttgcattccatgcatataaacatgacatggaaatatgctatttaattaggaacatagggattaataggaaattgactccattaatgtactagcgattacttataagcatacctttcaccataagtcagtacctgtcttccaatatcttcagaggccacgatctgcgataaggaggaagtacaattaaaaaaacatttcagggaagaagcatgaaattcatgcgattggaacttgatcaggagtaagaacaacatactcttgattccaagtccatcagacttgaagacttggtagcctctttagcacgatcaagttgttcttgtgtaactgaacaaagtaaaagacagggaaaggacaacacataatgaccagtctaatctgaaaatagattgtaactttgaggtaaaaaattaaagaaaccttttccaggagttgcaacttcatggagttcccttgctgcaaatccacagcacttgatacaaaatctgggttctggtaaattaacatgacagtcaaaagcaaagtggaatgtatgaaaatccatgataaatgcagaaacttctatagaagcttgagtaaatcattgagcctttgacttgtatttcaatctgactgttcggatggttataattaaagaccagggcataattactggcctgaaatgtgcatttattagttactaccctcttgaaacatttgaaaccacaaaattgtacacgagatgaaatgagcattgatgtacataggaagaaactaaatactcagtttcagtgagtgctttctgcatttcttactgaggtacaatataacttcggttttagttactactacttactagcataagccaccaactccttattttaaacagtaagataaaattacagttgtttgtataaggcattaatccagaattcaggtaggacaaatgtaatggtgtggtaagagggacagacattacttagaatagaaagggtattatatttacagtagtttgagaatgatattcaaaaaaaaaagggaaagaattcacaagcagatttgattctgttcattgcttgaatatagaagggaaaacatatcattggttatgctccaaaagagacttacagtggttgcatgtattccaaaaaggccagaattgttgtaaatactgctgaaagcagagaatgattcgatctgtccataattgttcaagacacggagatctgtcggtacagaatcacagctgatgttaagacactttaccaaggtatatgcttattgatgctctgatatgcataatggttaaaagagaagcattaagcttacacaaccaagaatgcattcctttcccagggccaccggtcgagaaggaccctcctccacccatgagcacctacaatttatattaatcttatgtttcagtacaatagatttgaataatagagcttgcaacgcaataaaatatgaaataatccatcaattcctatatagtacagaatcaacagaccatataggttagccataaataattggatcacttcaacatattgttaggcatacctgaagcacagtcacaatcattgcagttttctcttgacgccagccacctggaacctcaaaggcaagtgcaatgtgtgtactctaacaaaaaatacattaggaacaagaaaagtaactgtgaagacagacttgagcccttgagaatgataatagaagaggccaactcactgtagaatctgcttggcaatgataatcccctcctacatacactgattttggctcttcaggacgtttcacactgggaaggtctgatagaagtggttctgcgactgaaac

SEQ ID NO: 58591 - DNA, 1123 bp, Oryza sativa
accgtgggtagtactcagtcttgctctcttttcccccacaccagagttgaagtccttctcagttgaagatgtctcgaagaggttggtttcgtcgctgccgtcaaggattgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacacaccagcacctccacctccacctccattaggggcagcagcagcacctacacctgcacctccccttccccttccccttccccttgtagttccacttgcactagcactaagtaatgcaaaaaattagcaatgacaaaataaacaaaatcagcattggattagttaaaaacaaggaaaaatgctagtagcaatgaatgattcacactgatgtgggtgcatcacttgggtcattgatcccctctcctgttccactttgtgaagatgagagcttcctcttttgacttgctgtgagacctccctggcaatgcttcgctgtatggccaagctcatgacattcactgcattttttccttttactagtgctagcctcatcagaagctcttatcctagccactcttggtcttccaggtttccttctcaacctaggcttcttgattttatagcctagatcaacatgtgcccactcatccttagatgccattggattgaactgtcctgcataagccattttcaacatctctatagagaagcacttatccacaaaatcatccatttgtacctccctattaagctttgcaatgaaagccaaagcatgatcacaaggctttccactcacttgccaagccctacaagtacatgtcctttccttcaaatttactgcatgtgtaatggtgcccacagttacttcaacagttccagacccacatatcaatacctcatggtttttgagggtcttgctttttgcattcagagtgttagtaatagatgggattatcctttcatccattttacagggctgcagga

SEQ ID NO: 58592 - DNA, 1525 bp, Oryza sativa
tgggcgaagctgcaggaggcgcggttgcactcgccttgcctccacagcgcgcacagcttcgtcttgtacgccgggccgcggcggggaggacccatcatctccctcatctctctttcaccaacccaacccttctcccgcggcggcggcggcggcggcgaggaggaggaggagacgagacgtggcggcggccagtggggagacgagaagagcaaagcacgagtgccgcacggcgagttcgggagacgggacgacgacgacgacgacgacgaaatgggcctcatagcaaagtccggcccatgtggcccggcaaatcaggcccatgttctctgcgcaccattagcggcccaaccaaacaagcccaaaccaatgataatattccttccgtaccaaattataggtggtctttttttttttacacaatcttcaattgcatacttgaaccattaatttattctatgctatattcccgatgaatgcttcaaaatatgaatctagtaagataacgtgtataatatttagcactgttaatacgacgattaggggcaattgttattagtcaaacatttaccgagttatttttttcttgtaaaagaacaccctataaactgtgacaaggagtaataagtttccgggcaggagtagagaatgaagagtacatacgatacatgagctgatactgctagcagacaggagtacatttttttcatactacacatcatccagatccagttattgcaggaaggcatctcaacaccacgaacacagcattccatgcgagataggactggcacgattcaggaaggtcgtatacatcaggaggattcagggaggtcgtcacatcaggaagaagggcgagccgattccgaataagggagagttgcagactccacgcatgttgaagcctcggagacgctccaggttcatcacgtcggagtgatccacgaacagattcacctacattcacaacgcaacacgttagatacacctggaaatgcctcatgaacgagtctaagcttcttgcttgcaaaatggtctgtcagcatagcattgtaataagcatagcattgtgcacagcttcagggtctcagggaagaattgaagattcgtttacccgtggcccgtatcttctgacaaccactcggaggtgttggggttggaagcctcgaacatggtcttctcgagcccgagccggcctacaatcttggcgacgatgtctgcccgtagagagtcagcgcgctggcaaatgtcgtcggcatcgatcatgatcatgtctgcccctgcttccaagcacctctcggccctccttatcaacaggtcaacatcctcgactctttctgcaccacatcaaagtgaggaaggcatcataggaaaatgtagacagtacaatcacagagccaacagcatagccaaataaacatacggtgatagtattaaattgctttgtaactaaattccccaaggaaaaactgatgttgacaaatgtatgttgagcaacttttcccttaatgctgttttcttgcgtttg

SEQ ID NO: 58593 - DNA, 974 bp, Oryza sativa
agcaggacatgtaatttcttttgactatgaatcctggagccaaaatggccaatctgatcagctcatgccgtgccaactgagcacccacgttgcatcaccgcttactgaacggtatcctaggacttgctaacggccatgcgtggttggatcatgccattatgcggtgacaaatgaacaaaaccctgccgcatttcagtgccggttgtcgatcaatcaggccatagcttagcccattggcacgaactgaactgttaccgatcagctcaaactttttttaatccccatagcccagtattattactgtattttgttcaaagattagaccagagtgtgcattgtacgcagtgccaaagattctcctaagccgcagacccatttacgatccgttcgtccgtttctggtccccttggaagtagcaaaacgtctcaagactgaagagtgagcccatgtcactggcatagtccatgcataagaccaaagagcaatttcagaggccagccagtcccaattgtttttacctaccagtttactccaagataatgccggcctctagctagctgcatgtgccaatgagacccgttcagtttgaactttgcatccatggagacagtaatactctctggccagctgaaggtagaagaagaagaaggcaatgatgaggaatgaatgacattagcagttacagacttacagttagcagtgcacagtcattgcagtattcaggttcttccccctgttcatcttgtagataatttctttcttgaatatacagtgattagtactatctgctttagttttggatcctttttctctagatggaatcatggaatgtgtgttgcgtgtcttgttaaaaatggagtggtttgattggcagcaatcggattgtccggcgaggaaggggagtcgccggagaaggggagatgccgacggtgtgggcggcgctcaagaagtcgctcaactggggctgcaggaat

SEQ ID NO: 58594 - DNA, 1000 bp, Oryza sativa
attcctgcagcccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttacacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggtttcggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcat

SEQ ID NO: 58595 - DNA, 1965 bp, Oryza sativa
gcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaagga

SEQ ID NO: 58596 - DNA, 1447 bp, Oryza sativa
aagaaggttttgtgctagctggagatcatcgcatactactcgatacatctgccaaaattaaattaagtttttttttaataaaatttggtccaatttcaccagtagtgaatggtttcgaaactattcgggagcggttcttttgatagttcagttttataaaccttggctatcccacatcatcctttaattaaactgtatattccttccaaaacaaagatgcaaattaatcatataaggcagggtaaaggctatgggcgttcatatgaatgaacacatgtttacgagtatgtgtttgcaccgtgttttgcaaaaaaaactaattaacataggtatttctcgacttggaaaccaatatatatatgagcagatcaagcagcagtaggtacacttaatcctggataaaaacaagagagaaaagaaaaaagagatccactaataaaacaaaaaaaaatcaaagaagaagaagatatcaagagaacactctatttaagtaaaaatttaagacatcatctgcatatccatccatccgtccgtccatccgccatccaacggacagcagctaccgaagtatttatatcgtagtacttaattaggcggacgcggcggcgccgcctccgccgccggtggcgagctcgccgccgacgcggcgctcgacgagggcggcgcggagcgggttcttcatgacgacggtgaaggcgaaggtctcggtggggtcgggggggccctcgccggcgggcgggacccagcggaactcgcggaccatgttggcgagcatgagctggatgtggaggacgccgagggtggcggcggggcagatgcggcggccggcgccgaacggcatcatgcggagggcgcgggtggcggtgatgtcggtgtcgaagccctcgccgccctcgaggaaccgctcggggcgccacgcctccgggtccggccacgtcgccgggttctccgtcacccacgccgtgtagaactccacgctggcgtccgccggcacgcggtacccgccgagctccgtgtccctcgtcgccgcgtgcgacagcacgaagtggctcggcgggtgtcgccggaatgtctccttcaccaccgcctgcacatgcgcacgccggcgatcgagcgccgcgaatccatccatttcggttagcaattcagcatatccccaattccccatcacccgtatcttcttttttttttcatttttttttcattttattatacaatgaaatgaagcgaactgcttctctgtctcacaagaaaaacaaattataggtatgagtttggacaggcgtataaccagattcaaaactacgatacaacttttttttttaagaatggttttactcccgttgtttcataaaaaaacaaaactaatatatgatgtgatacattatagttaatacttatatagataccaagagattagttctcaacaattaatactacacgttat

SEQ ID NO: 58597 - DNA, 861 bp, Oryza sativa
gaacaccgccgccaccacatcgccgccagcaccgccgccgacaccaccagcagcacgtcgttcatgtccaccatcttcgacctcgccgccgccgtcgaacactcgatcgatcgatcactctcagcttcttcacctcgtagcttggtatagctcgccggagtggaggaagagtgggtgggtgggagagatatatagcggcggaggcatgtacacagtggggtggggggagtaaatgcggagccatctaccatctgaaagggagacatgaatgctcgctccagtgtgacattaatggcgagctcgtgaaagctcagctctctgccctaaccctaaccctagccgtggtagtggaaaatggaagaaaaaccagcggcttggcccgtgatgagctaacctggctgtccaccatggccatggccgctgctgttttttttttttcttcagccgttagccatttgcttcccgcgctttaattcccgcgttcggttgggaagacgacccacacactcatcactcggagtagtactctactgacgcgtttgcaaagtagcaaactggcggctgcacacggtttttcgtttatgcacagtaaaagcatctccaacaatcacttcaaatttgactctccaaatatcgggcctgttcattttaatgttattttcaaccttaccaaattttggtaagttgccaaaaaaatggctacatttagtttgctgccaaattttggtaactatataagaaacgtaccaaaattttggcaactatatcaaaatttggtaatgtttttttttatcaatgtgaacaggcccatctatttggtcaactctccatttaatttagcaagttaaactctcttttact

SEQ ID NO: 58598 - DNA, 1192 bp, Oryza sativa
tcctgcagcccagctaggattgatctagcttcgatcggaacgtacaaaaaaaatcccaattcacgaatacgagacaccaaaaccacatgaagatcaaatgggagattatagttccattctcttcggatcaccactaggcgcaattttcgggggaatctgattttcgtacaaacatcataaaaagaattcgcacatttcctaccatcccatcaaaaggtcagtcggtcctaatcagagcacggagataaattcccacggttacgcgcgtcactactagatttgttcccgaacgattcgcatcaatacgagacctttcccaattccaaactttttagatcacaaagttccaaacccataatactaaaaacgaaaggaaacataatacgaaaaacgaaaggaatcagacatcagatcggaatcgaggcgcttacccggtggggaggttgtcgacgtaggtgatgagcatcttaaccatggcgtggctgtccccgcgcaggcctcgctccatctcggtgaccatggcgtccgagatgccccgcagcagcgccgtcggggtcgacagcgcgtgctccacgtcctcgatcaccgccgccaccttcctcttcctctccgccgcggctccctccaccagctccaggtccctcctcctccgcctccgcgccagcaccaccgccaccccgaccgccgcggccaccaccaccgccgtccccaccgccgccgccttccccatcaccgctgctccgccttcccttcctccgatcgatccaggtgcccgagacctccaccgaattccgcttctggatccgaggctatggcgctctgcgagatcctctcttcccccctcctctctccggccgcgtaggagaaaggaggacgagagccactgacttgggcgttttaaccggtagcctcgagtacccttcgcctttgcgccataagcggatccgcactcaggatttgtacggctcagatccgctcttgtttgggaatggacggcctggattgggtgtttgtcgtaagtagatctggggtggttggcttgacaattgtgcgattggtttttggtcttttggttataaattatcttttgaggtgagtgatttttctaaagataaaagataatttataacggatttttgggaggccaacacggacaagtgcggtgcggcgtgatccaattaacaagaaaaca

SEQ ID NO: 58599 - DNA, 2332 bp, Oryza sativa
ttgctatagggcaatcttttagcctcgtaccccacgcatccccgcatcattgcgcgaatagagcttggtgatgatatggggacacgataccaggtgcgtcgttgaaatgtcagctcgttaagtactgatgatagtccttcactggagaaagtgatgttcaaattcagtggtcttagactttgggtaagatcatgcaaagggagaagcttcaacaataatcgaatgccatttttcttgttgcaacaacaatctgactaagacagaagctgtagccttaaaagaaaattttcaacaacatgtctacaccttttgagcggcagaaattgtgtgctttgttggccaagagtgacagccatggcggccaaccgtgaagctacgcagaaataggagcaaggaaacagaggaagaagaaaggaactggggggacgattttggatcgtcggatgataacgaacggtggatagagcagaactgcacgcctgtgactttgcaacccaaagtcagaggatccgcttccccagatgagccacgcccatgcgcacgcggcggagacgcaacggccaacggctcgtgcaacggcggatgctcgcggttttggggcggtgaaactcagggaaacccgctgagccgtagtacaaattcgacacgcaccggtgtcgtacaaatccgagagacacgatggtttccgcgcaagatgcacttccgcacgggcgcgctgccgaggatctcaattctaaaccgtatccagatgaattttactctgcttgttaccctatctatgtctgactaggttggatatacttatccatataaaggcgaaatgctatacgtatgacttgagcatctgacttctggacgactgcgtagtacacaacgtcagtaacaaatagaatatcttacaaagcctcacaccgtcacgcatcgcattgttcttataaaaggtaagtggaacccgttcaatattagatttgaagtcaatatccccaagccaataattcatcataactaaagtttaagttgcttttagaaaatttaggagtaactagcgacattattgactttcacatatactcggcaaagaagaaaaaaaaagatgatgtctcaaaatcaggttatctttaacctataactcataatatatgtggtagtaattactccctccctctcataataacttcgttttagacccttccattccatttgccctataataagtttatttttttaaagacattattacgtcagagtttataaaaatagagtataaatatattttgagtatataaagagagaaatgattacattgaaatttgataaaacgggagtatcatagacttttggggttttgtattgatatgtatgggatagataaaaaatgaaattattttagaacgggggaatatataaggctaaagggacttatattttggatcatatactatataagttactctcatgtactaccattaatgctccgttagcattggcgtccatcatatgttagagtcccagcttggttgaggcagggctgtgccgtcaaatttgtatgccctgtacaatgctctaagtgagacctaaatcaagtaccaaatatagctaaaataagggataatttcgtttttgcccccattttcatctctaatattgattttgcccctactttttggggttttcgtttttgcccccactttttttttgaactgaaagagatgtttgcccctgttttggatggaggttagtgggactgaatttatggaagaaaataaagaatttttgatttagtgaactacctttttacccctgtgaaatgtttcccaggagtgaaccgaggctgcagcaggttcatggaccaaccccgcgcttggcccctgagggccaaggagaagacgttcgccatgacccggtcgccaccctccgccgcctctatgatcgccgtgcagatctggagggactcggaggggtcggcgccatcatcgtacttctcggtgaggcagggctggagctttgggggtcctcggacattccgaagactcgccacaaagacatggtagccaagcttacctggtggggatgtggggggccttgccccctgcctggggtggcgcgacactcctgaggatgctgcgccttcccccgtagcggcggtgcgacactcaccacgccggcgctcgaaagaacctcaaaaatcacaacacgtcccctacctggcgtgccagaggtgtcggagaatgaactcctccaccagggaaccgtgaggcccccctttgtgagttcggccgggggcagcgggtgagattcgagggcttggtgagcggagctgtgtggtcttgat

SEQ ID NO: 58600 - DNA, 950 bp, Oryza sativa
cgtaggtatcatccttcagtgaggaatagggcagccataagtgagatagctactaatgagagagccactattgagataggcacaaatgagatagccacaaatgagagagccacaaatgtgatagccactaatgagagagccacaaatgtgacagccactaatgagagagccaagaaatccaaaaaaaggggtccatgtgatgaggaggcagtcggagttgttgatgagggcatatactctgacaccgaatcacttgtggcacagagtgatagcagctatgactctgacttggcggaatcatttgattctgaatttgactgctctgaccctgagtttgatcctgatcaagaaatagttgatgaggatgacgacgatgatgtccctgtctttgcatatgatgttcatgatccatgtattgatgttggtgtggtgttcccagatgtgaatcaatgcaagtcagcagttacacatcattgtatcttgaatgatcatgcttttgacattatcaagaaagacaagaaaagatttagagccaaatgcaagagtgcggatcaaggttgcaagtggctgtttttgcatctactagtcccaagtacattggatgtaaggtaagttcagatttgtatttttttagttcttttctgcattaagtaatttcagccttgtccttacttaacatgaattttgtctatgcactctatggctgcaggttaagataagtggaccaaagcacacttgtggttcttttaataattgcggtgaaacaatggcttcaaataaatgggtagctgaccgagtagttgagttgctgcgggatgacccctcattaggacctaagaaactgaaggaagagctgaagaagaaatactcagtgaatataccttatttaagggttttcggaggcaaggagagagcacttgacatgataaatgtgaggtgggatgacagct

SEQ ID NO: 58601 - DNA, 1521 bp, Oryza sativa
gatggcgagacccaaagcatccatattctgtcgtgtggatcgtcggggtacctggccattaatcggttgtgttccgtttgatcaattcattgtaccctcttggattgactatttatcatctttctttttcaactgtgtgtgcccaatggtaaagatcaaagatgtaaaccatttctattatctagaaaaaaacttggatgaatcttttaattactcacctgatgaactcggtagtactaattgggccaaagttccatctgccgaacaaggacaggccccgcttgtcgttcgcctgcgggtagagcttcttctcgagaggcctgaggtccagcccggagatgaacggtgtcccggtgccggtgttcacgaggcaaacctgcacgaagtcgtccggcacgacgacgatggcctccaggagcgtcgcgccggaggggtccgagatgttgaccatcatccagaagttgacgccgatgtagacgtcgaagattggcagcttgctgaggccgtcgtagttgccgtacatgaaggtggcgcggatgaggtacttgaggccggccacgagcgaccggagcgtgtagcagttgcgcgcgccgtcggggaagctgcgcacgttgtggtagcgcgccgagagcgccggcgtgatgtactccgccgagatgttgtggaacgagccgccgtcggtgaagccgtcgtccgccgcgtaggatatcttggtcttgtcgtccacgtagctcgggttccccggaggccgcagtctacgctaatgaaacctggagttcacttgtcgtagagtcagcaaggggtccggtgcgggccgtgggcccgattcctttcactgtgaagcgctacttaatgcccgatgaaaatttgtgtttgtacctttgctatcaggctgggcacgagcttggagcacgccggcggtggcggcggcgacgaggcatagtagaattaaccacgaccatgccgccattgttcccggcgttgaacgccccattgcacatgcaggcggtgagctactagaactgtaatctctatgtgaccgtgctctagctatttatagctagccttttttttttcgggctatgttcgttggtgggtattgggaacccatctcccacgtactaaaaacgaaacggtctaacgtaggattaattaagtattgtttttttaaaaaaaatggatcaatatgattttttaaataactttcgtacataattttttttttgaaaaaacataccgtttagcagtttgaaaagcgtatgtgtgtgcagaaaatgagatggagggagttgggaacctaattgaaacgaacgcaaccttaggctgtgtttgagggagaggtgattgagaagattgggaagatacgtaaagcgatgtgagccattaacgcatgattaattgagtattaactattttaaatttcaaaaatagactaatataattttttaaagcaactttcatatagaatttttttgcaaaacatataccgtttagtagtttgggaagcgtgcgcgcggaaaa

SEQ ID NO: 58602 - DNA, 724 bp, Oryza sativa
ttgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtgatcatggtagcatgggagtcctgcacattttctgaactgcactttttgtatgcccaaatgagttgatgcttttctagattcagatttcagagtcttgtaaatttctatacagttgccaacatttttttgtatccaatgacatgcttggcttgttaaccagctactagaatggttcagctacattcgctcatacaaatgattttgtaatgttgttgctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaacaagcttagcaattttttttttgaaacaacccgcagcgatgtttctattgatataggggctgcaggaat

SEQ ID NO: 58603 - DNA, 702 bp, Oryza sativa
tgaaaagagaaccacaccagaagcttttcagctgcttcacagatcttgtctacctttgcttcagataatcccttgattcctgtcaggctctacaagatggatccatatattgaaacaatatcagataattatattgtaagacagaaatgggacaattgaaagaatataatcgtcataaaccagaaatagaacaagtgggagatagcatgaagatttgggaacccaattttgcaaccttctttgtatgcatcatgaggccattgcaagtgtagataccagcatcctgcagcttcttcacatctccagagtttatcccttgcgagattactgtggacaagtgcacgagagatggataataatgcagagattatgctcaattgctcatagttcgaattcatggatatgaatgaataatttgcaggaagaaccatatgaagaatgaaacccagggagaagtcaggatcacaccaaaacaacttactaatattgaactcgctagaattagggagccaccagaaatcgtaaaagtacaagagggactcaagcttaaaccctaaaccctccaagtacacaactggttcaactaatatacactcaagttcaccaaaacacaactggttcaactaatgggcagaaccccacatgtttgaactagccgggggcgaattccgacgagttccaccaaacgcgggctgcaggaat

SEQ ID NO: 58604 - DNA, 945 bp, Oryza sativa
tgccacacggacatgacgtggcatcattttaactgacaaatgcgacccatttaaaatatttcctttttttccttctcttttttccctttcttctcctttctataagaagaaaggaaaaaaaagaagaatgagaagaaaacgaaaaagaaaataagaaaaaaaaagacacgtcacgtcaatgtggcatgccacatcagcgtcacataggatcttagaggggatgtgtcaatttaggacctagatgatacactttgacaagttctgggatttggatatacattttgagagtttagggatttatatgacacaaccctataagtttaagaaccgccaatacattttactcatttgacccgcttgtttagttccaaagtttttcttcaaacttccaacttttccatcacatcaaaactttcctacacacataatcttccaacttttctatcacatcattccaatttcaaccaaacttccaattttggtgtgaactaaacacagcctaagagtcatttgaatagtagaaactgaaaaccataggaatggaaaaaacacatgttctaacaagaattcaagtgcaaaaaaagagaattttaaaacacataaaaaaacacattaatgtccttttcattagaccgcaggagaaacgcatgaatcagatgagagtgatagactcaaaggaagattttcaataagttaaaactcttgctaaattttctctaaaatctctataggatcattcatttcataggaattccaaaggataggatatgatccaatgctttattgtaaaggttttcataggaatttttctatagtattaaaatctttcaaaattatcctttgtttttcctataaattaaagtgatcctaaattaagttgtttcgggctcgtcagctggaacgcaaaaatttcacacgacaatgttttatttcgatgacatttga

SEQ ID NO: 58605 - DNA, 1212 bp, Oryza sativa
tcctttgtgaattcctgtcctacaattctgaagttacaatggtatgacaggaagatctcgatatatggcatctcatcaacaattgcagcaacaccaccatctttgggtccacgattaagggcatcagcgtactcgtcgattgtgtttagcggtaccaagtgagattcaggaacattgagctcttcaatcaggtaatttctagtaaactttccagcctggtatccaataggtaaagcacttgaaagcaaactgtcaagcccagttattccagttgcaagctgttggactgtgagaatcgacgtcagactagcagtataacttgaattgatgatcagcacgacaaacagccatatgatcagcacaaaccgcccaagcgcacttacagtgttctgtcctgaagagagttggatgatatataagtccattgaaatgggaaaacatggaatagtttaacacgatgtcataaaatgcatcaaatggacttactgtgtgcaaaaaacattgttgagaaactaaacctgaaaaggaagaaaaaaaataatctgttactttcttactattaatatttacacaaattaacaagataaaaatattaaactatttgttgctcacgaataaaaaaaaagtaataaaggtgtttttttttttgcctccattgaataaggtttcacaaatgctcccagtctgagttctggttccagaaagatatgctgacctatgatataaccaaattcttttctttttaacaaaaaatagacatatccttaagaggagcaacggaaacgtaccaaaatattgttatcatctgccgtcttggagagcctcgaaactcctcattggtccgatgttcaagaatccaaacaactattccgacaaaaataaaaagaacacctgttacacaccacatttctaatgtgaagggtttaaggaaagcccaggcacttgaacttgcttctttcaccggcactactatcacaagccctgactcaatataaggctgtgagaattctgcaatctttgtcctgtttctcacaatagcaaagtcgcctacagcagcatcaagggactacaagaaaataaatacaaatcagaggaataaaatcaaacttttagaagaagaaagagcaaagaccaaggacatacattggcagcaaccatgttaataatgtcatcacagttaggattctttaaaccatccccaattactatgaa

SEQ ID NO: 58606 - DNA, 895 bp, Oryza sativa
aaaatgccatttggactgcgccggctttgttagtgccagatcagtgccttaatttctgtggtgaacttaattagtagccgcaatcttggtttgcagctcgggatccagctcaagaacaaaagaaattaaacatggtacttaattactactgatcgattgacagtgacactccttttagttgtgacaaaagtttggttggtagctgattggtctgccaatgattgacaacaagaacaattgtccatttgactcctagtgtgagtcccactaacctttttaccataaaatttctataaacctcaactcattcaaatttttaagaaaacatgtttcattttgtccttgaacagtgcattctaatacatggccacaaaatttgagtttttttaggaaaaaaacagtcaaaattgtcagatcaagtttgatactaatatatgcagctacaattaggtagtggattaagtagtaattaaaccagaagagtagaagtaataataatttggttggttaataaataaataaatattacctgcaagtagggcatggcctcgacgtcggcctcggtgatgcgcgcggtggtgccgaccttggagacgacctcgccgtagagcttgtcctggacgccggcgtcgaggacgaggtgcatcatggcccactccagcgcggtggcgctggtgtccgtgccggcgctcatcacctcggagcagagcgtcaccagctcgtcctcgccgagcctcttcccccgccccggcggctccaggtcgaacagcgagtccacgtacgcctcgccgggcgcgctcaccatctccacgccgccgaccaccgtgttcccgtcggcgttcctctcgccgccgcccctgatgaactcccggcgcgcgcgcaccagcggcgccag

SEQ ID NO: 58607 - DNA, 889 bp, Oryza sativa
gatcgatcagacaaagctgggttgctgggtatttgtagtggtgatacagaaattcagaattaatgaattggagacttggtaataataagcctagtcagaggctttgtctgaatgcaatggacgtgtcactttacaaggagttagcacttgccacaggttgtcactttgattattactaattgggtatttcattggcataatatgtgttgtacaggtgatggtctgacagagtgacaagtgctcatgaaaattcacagtttaatgcttcgatttggatacgtatccaacgtcattttcagatgagggatgactcgagaagtcgagatgttaacccacacacatggcgaggcttgaggcgacgacaccatgcgttggtcggcagtagtagaaggattcagaaaagaattctctgcataggcggcgagcagctaatcttatctatgcacagagagagattcagagaagaatttgagttcatcttgtagttcagaaaggacaatcattcatgtcatagaaaaatttcagaagcctcctggatcgaatatagtaggtgtgttggaacattgtgagaggaatctctgaacaaacagcagtagtaacattcagtaaaaaaaaaaattctgagaatttgatttggtaggggctcttgcgtcctcctagaatgctcaaagatgctgtaaaaagtttcaggattggtcaagaaggcagggagcatggagccaccaaatatgacaatttttttcaggaatagacaaaagacttgcgcatccacaaaatctgacaatgtcttcagagaataattgttcagactaggtggaacatttttgtttattcaccattttcaggtccggtcaacttttcaaacttcagaaatagccaaaactcaaaa

SEQ ID NO: 58608 - DNA, 710 bp, Oryza sativa
ctagttatgctttcttgcatgagcaaaggtttcagacatcattagcgtcccgtcccgactgaaaacttcatgaagagcaaacactgaaaaaggagcgcataagtggacagaaggaagagatcgagggagatacttgccttgagatgcccaggatgtcttccttgactgtgcaaaggagcccatggagcctgctgacaactcttccaatcctctgaattcactcatctagtaaaattgccataaaaaatcacaaccagagaataggaaaatgtatagatcattgcaaagaagattacttggagaaaccttccagctatgagatatgagatccttacccagcttgggcatgaatcactagtgcccacgcctatgtgagacacatgcctgacgtctgtagggcacccgatttccatctcttgttgcttctgcagtgctggataaccgaaagggagcaatggtcatactggtatataaccaatggtatagaaactgtgcattgctattgtggttcagctaattcatcaaaaactgaaaatagaggtagatgcagcaaagataaacaatctgcttcgcttaccgaatatttgagagattatcttcaaacctttgaatatccccttcatctttatctccattggtgaggtgcctcagtactccaaacaaagaaagaacataagtgtcctgaaggaaatactcacgaactagtgtat

SEQ ID NO: 58609 - DNA, 1104 bp, Oryza sativa
ttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcaaaagttttttttctgagtatgttttattgcttgcttgctttgatattgtttctgagtatattttgccgtcccaactgtgcatggtcagaagtgaagaatcggcagggatttcatattggagcattctgcaatcagagcaaatggaccacggagaatggaatgtgtttgtcaataagtaaaattgtactaaagtaaattgtggcaaatctgtatgttgatttgtactatgtactggtatcttgctctaaaacattgttaagttttaccagcatctttgcccaaattgaattcgtcaattcttctctggcgtcttagacggaatttggactataaacaacaatttgctctgctggttaaatttcgtacttcgtagcctaagaaggatgcttagttcgtgggcctgcttaacgatataggtggtgttattaagagttccacgcattatcacaaatttgaaaaatagattaatc

SEQ ID NO: 58610 - DNA, 1171 bp, Oryza sativa
taaatctttcatggcaaatgattctatctgcatgttttccagttcagagcggaaaggctaatgggcgggtgatcgctcccccacccgcccagcgaaaagttagaaaaatttatgtatagaaatattatatataaaaaatttgaattcaaattcaaatttgaatcgggtatgtaaacttttgacttataaactttgggtctataaattttagatgtatagaaatactatatatagaaaatatttgaattcaaattcaaatttgaataagatataattcaaattcaaatttgaatcgggtatataaactttagatctataaacttttaggtgtataaactttagatgcatagaaatactatatatgaaaaatatttcaattcaaattcaaatttgaatcggatatttgaattcaaattcaaatttaaaatgggtatataaacttttgacttataaactttaggtctataaactttagatctatataaactttaggtgtataaactttagatgtatagaaatactatatataaaaaaatatttgaattcaaattcaaatttgaatcggatatataaacttttgacttataaacttttggtctctaaacgttagatgtgtaaactttaggtgtataaatttactaaaataggaaagtaacgcggtgccaaaaaagaaaaccaggttgagggagggaggggggaggtggagagcgaatctgatcgctaccctatctccacggcgatccatagcccatcaggggtacccagttcagagaacaagtcaagcgcctatgggccgtggccagtggccaccgatctcgggcctcgagtcgtgccccagccaagcagttgaccagctgccatccaagtcaactacgtgcccatgtgatctgctcgtctttgctctcttcccgggcttgcagccttgctgacttgcagggtcattgacatgccggtcctacaaagaggtggccagtaaaatgtcagaaaaggcccactcgtcagtgacagtccacatatatgtgtgaagacggcgcttggcaagctatgttactagacagatgtgctgacgtggttaaactaatcacgatggagtctttgtgatgatcattaggctataatagtagtactagctggagtaagtgatagtaataagattattagcttgattact

SEQ ID NO: 58611 - DNA, 7654 bp, Oryza sativa
ggcacagatggtcaggatggtatgtagatagacagccggtagaatacataagagtaaaacgtacggtgtgatggtttgtgcgtgttactgatcgaaaacatgggtgcacttgacagcttccgccatgatggtgatcaaggaaaagtatcaggtgaagaagaactggatgggtgatccgtgcgttccaaagacgcttgcgtgggataagttgacatgcagctatgacagctccaaacctgcaagaatcacagacatgtaagtaattcagtccacatgtactccctccgtccaaaaaaaaccaactagacacggatatgacactacatagtacaacgaatctggacatgagcatgtccagattcgttgtactatgttgtgtcacatccgtgtttaagtgggtttttttttaggacggagggagtactgaatattggacttgcataatggaattatggaagtatggaactcgcggtcatctgatcatattccttttgcagaaatctgtcatccggtggtttaagtggtgagatatcgtccgcttttgcgaatctcaaggctcttcaaaacttgtatgttatgaggttcagaatgttaatttgttgaccgtttgtggaattttgcgttaaaagacttgcttcatatcttgcagggatctgtcaaacaacaatttgacaggttcgattccagatgcactttcacagttgccttcgttggcagtattgtaagtttggcaactcctgtcaaattttactttattgcctagcatcatttgtaactgacatatgtatataatttatgggcatatggcttctttagagatttgacaggaaatcaactcaatggttcaattccatctggacttctcaaaagaattcaagatggtaccctaaatataaagtaattaagtacacccccactcttctcttagtaatctttgaatgtccaaattcagtcaatttgacaaaatagactgatttggctaaacatcttcattccatcaacagatacggaaataacccaaacctctgcaccaacgacaattcatgtcagccagcaaaacacaagagcaagcttgccatctatgtagctgttcctgtagttctggttttggtgatagtatcagtcacaatactgctcttttgccttctgggacgaaaaaagaagcaaggtgaggcttgttacaaacatagcaattatcaactctatttctctgtccttgaacatttctgatgctagtagttccattcttcgcttatgaaggatcaatgaacacttccgtaaagccgcagaatgagacagcgagctatgtgccgacaaatggcagccatgggcatggctcatcaatgcagcttgagaaccgacggtttacttacaatgatttagagaagataacaaacaactttcagcgagtgctcggcgaaggagggtttgggaaggtctacgatggcttcttggaagatggcactcaagtggcagtcaaattaaggtctgaatcttccaaccaaggggataaggaatttctcgcagaggtagaatttcttcggttgaatttgatcttgctacataaagattctactaagaaaagtatgattaattagtcaagttttgcttgtctaggctcagattttaactcggattcaccacaagagccttgtatctatgatcggttattgcaaggatgggaaatacatggcacttgtctatgagtacatgtcagaaggaacccttcgagaacatatttcaggtatgtacttaagttgttgttcccgatcaattcgcagggtacattgtaaaacttcatctagtggctcatttgatagtcctcatgatatctcccccttctgtgttctcttcctatttgcaggtaaaagaaacaacgggagatacttaacctggagagagaggcttcgaatcgcgctggaatccgctcaaggtaactactttaaaattgtaatactgtttcgtgaggtttgattttacattttctctagaaggttgatcagtaattaaatttcctggttaatggtcagggctagagtacctacacaagtggtgcaatccgcctcttattcacagagatgtgaaggctaccaacattctattgaatgcgaagctagaggctaagattgctgattttggcttatccaagacgttcaatcttgagaatggcacacatgtatctacgaacacgcttgttggcacacctggatacgtggatccagagtatgttaatccatatgtatttcttgatgttgttatttagtgttttatgtgagaaacacaaagtttaaggcttgtggaactaattgaatgtgcaggtaccaggcaacaatgcaaccaacgaccaagagtgacgtctatagctttggtgttgtcctattggagctggtcacagggaagccggctgtcctacgtgatccagagcccataagtatcattcattgggcgcaacagcgcctagcacagggtaatattgagggagtggtggatgcacgtatgcatggtgaccatgatgtaaatggtgtatggaaggctacggacatcgcactcaagtgtaccacacaagtatcggcacaacggcccactatgaccgatgtggtggcacaactgcaagagtgcctcgagctcgaggaggggcgttgtgccatcagcaatgcgaacaacaatttctataccgacaataacagcaactctaactcaagttatgacatgtatgccactgaccactctattgatgtaagtcagaacagcgctgcatttgagacggagcgtaattttggaaggatgccatcaacggccaccggtccagctgcacgataaatcattttgcccatctgatctgaatgctgtcattttctgggaaagatcttcatggaagttttaacaatgttgttttaccaaagtaaatgcaaatgtacaaattaatttcaaaaactcaagatcctcagtataaaccctttcggttatgaactcagaattcatatacttgtctcttctttgagtggcattattgtcctgtactattctttaggaagagaaacaccaatttatctgttcattcatgatgttttgtagtaaccagaatccacattttctattttttctaaatgctctttgctttgatgttggaaataaactcataagcctagtgttgggatgccaaaatttatggaatctgcatagcttagtaggctagcataccacaatttgcatgcattttttttcctgaagggtttagtttcgatggaactgaagctaactttattcgccaagatggactataatctagtgactttactcatcttctattggtagtctaccacctgtctatttgcggtacatttagctgttattaaaaaaaattcctttgggtggatttcaggtggatggagtcacacattgtataccttcctaagaccttgttcggtaatccccatgagatatggattaaaagagattgatgaggaataattccacatgtattgaggtgtgccccccctcaatccccttgttggtgggattaaccgaataaggcctaagggagaacacaaaagtaagatccatttgacagaactctatgtgcatgtacttgaagtgaaaatgctaatattttccttcaatagagttataaaaggatgaatgctcaattattgaacaagaactttctagccagcctttgacttctttaaggagcccatcccttactagggttggtatgcttccagatccagtcgtggggaactccatgacgagtggagtagtggtcccatgtgcgagaggggtcggagggggatctagcccttttgagttctgactagtgtgatggtcgagctatgctaggtcgtgagatgtcgttgtgcagaggtgaagtgttgaaggtggcccgggggggggggagggggtggctgacaaagaggcgtatggtggtgcgatgtcacgcccagaaatttagcccaaatttccagactattttgtgtattaaatccctgtccaggaccagccagggtacacaaaacgacaagtaataaacagttccaaacgtaaataacgcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcgaaacagtaaaacagttgagtaattaaagtaatattgaatctccactgatcaacgctacaccacgttgaacaggcccaaccaacccacctgaactacagtgcattgggtcgatttattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagttgcattttagttggataattacgaccatgaagcatggccagatgtctcgagcacgcagctcatcaagatactagaatgtctaatactgcaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattaggatcaaaatgctcaaggggaatgtgtgacttgccttgcttctccactttgatctcccgaactcttttcctcgcgaccgcggacttccgaaacgacggaaactacacgctggcacgcaaaacgaggaaaaactctaataaaaaccaaagaaacagtacataaaaagtaaacaaacatgtagagctcaattttagatgaattttgcaatttgaatggctcaattcggagttcgaatgaattagatatgaattttagaagttttgagccatttaaatgaatttctagaattaaactcgatttattgcgcaattattatttatttttacaaaggaaatggtccttgctgacgtcagcaaggggcggccggcgccgacacgcgggccccacacgtcagcgagtcaaagggggagggcacacggtggaccgcgtccaccgcgacctcgggcgcgcgtccaccacgtggacggcccagatcggccaaggccgatcggacggcttggggacagccgggtggcgcggcccggccagcgctcacacaaagcgggcggcggcggcggccgggaccgaagcgacggcggcacacgggctgggcggccaccggcggcggcacacggcgcgcgcaagcacgggaggcggccggccaaggggagaaagagggaggggagaggagtgctcaccgagggcggcgacggcgagacgaccacggagaggcgaccggcggcggaaaggatggcggcggtcggcacgggaggcgacgagaacggcgttccgatgacgcccgaccacggcggagccacggccgagggacggtgggatgcagcgaatgcggtggaggcggtggcgcggcgtgaggtagatggggatggcggcaagaggcggccgacggagggaggcgagatggcggcagcgcgagagaggtggtgcgcgaggcggcgattttccggaggcggagaggggagatggagtaggggccggggtagagcttggcacggcgttgccgacggcgcaagcggcgaggtgcggcgacgactaacgtggcggcagcggccggctgaaggcggtgtgtggcggtagtggctcggcctcgcgatgggaaggtggttccggcggtggaggagggagatggagtggatgccggggtgcggtggggtgctgtgatgctataggtggcggcggcacagcgcggcagcgacgggagcggcggtggcgggcggctggagatcgctggcgagcggcggcgaaggggatcggcgtggagagctcggtagagggcgcggcggcttggggaaaatgggggaaatggatgaggggaggccggggattgtttttataggggaggggaggcgggatcgaggccggacgtggcggaatcggccggcgaagtggggcgccgacgtggggtggtggaggggttaaccggcgccgattttcgcggggagagtgggggaaatggtggaggacgtggaggggatcgtgcccacgtcgttggatgcgagctcgggtgcgggagggcgccggattttgcggcgacgtggacggctatggcggttggcgtcggccggcgagaggtaggaggaggagctgacgggtgggaccgccggtcccacctgtcggcgaagggagagaaggagggacgcaaaacagacttttgcgagcgggccaaggaagaagggagccggcccgagagagggaggaggcgcgcgggccgcgggagaggaaggagggggaggaatttgggccgaaaatggcccaaagagatgaaggaggattttatttgttctctttttattttaattgattaaatgatcttcgtgactttaaaactatttctcgagctccgaaaattcacggaaaattccggagagtacattagggcacaaagaatattacaaaatattcccggccaatgatttttaagggaaaattttaattctcccattattttacttgattaaattgatttaacttttatttaatttctagaaaatgcattatttaatgatttttaaacccgaacgaaaatcggggcgttacatgcgacagggcacattgttggtgcaggttggatagcgggagaacatggggttacgatgttagggtggtcgcaatgccttaatttgggtgcctcatttcccccatggggcattgctgagaaacatccatctctcccttcatggtgggatcctccaggtaaaaatcttgtctaggtcttgggtgggcgggtgggcgggcgggcgggcgacgtggcgacgtcacgaccttcatggaagcatatattgtctaggagatcacattttctatctttctagtctccaatcgatttggtctacgatggtactctaggatgtcttcaggttatgcgggctgcaggaat

SEQ ID NO: 58612 - DNA, 926 bp, Oryza sativa
tcctgcagcccctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttg

SEQ ID NO: 58613 - DNA, 1018 bp, Oryza sativa
aattcctgcagcccgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccataactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcc

SEQ ID NO: 58614 - DNA, 2898 bp, Oryza sativa
cggcgacgcggacccgtcgctggacgcggagtacgcggcgaacctgcggcggagcaagtgcgcggcgccgtcggacaacacgacgatcgtggagatggacccgggcagcttcctcaccttcgacctgggctactaccgcggcctcctcaggcgccgcggtctcttccagtccgacgccgccctcgtcaccgacgccgccgcggaggccaacatcgccagcgtggtgtccagcccgccggaggtgttcttccaggtgttcgcgaggtccatggcgaagctgggcatggtcggcgtcaagaccggctccgagggcgagatcaggaagcactgcgccctcgtcaacgacatccactactagtattatcactagctcatcgatcttcagctcctcggtgcttgataaatttcagtagaaatatatatacatgtaacttaattcgatcgtcatcctgtttattctctctctctatgtaattttgtttccaaattgtaactgttttattttggagcaactgtaactatttctgtatgtgcccatgaatatatttcaattatagaaaataattcactttttagtcatagatatttaatgtttaggataatattcagattaattatcattaatattatattaaaataaattttaaaatgttttgatatatttacgattttacttttctactagacaaatttacgtatattgattttttaaactagaatttgagatcctactactagttaaagtttaaaaaattaactaagttttattattctaaagttaaattgctcccctctttctctctctctcttaatatctgacaccattacattttcaacgtactaatcattcatcttacttaaaataatataataaattgtcttattaaaattatataattattaattatcttgttatgaattgtacgtttaaacattgaagataatcttagcataacttatatattcttgtatttattttacataatttaaataataaaaagtaaaacgtatatttaaaattcgacgccatacaatactgaaaatcaaaggagtatttatgaccatataatcgtatttgcacgtggtcctccttgtcggcggctcggtggctgtcgccgtccacgcgctgccttctcgacagggcggtactccacccggtaggtaggcacccgtacggagctcggctaatccagctgaccattcaataattttagatatttaaatataaacttttgtagtgaggctgtgatcagttgttttggcaaaaaaaaaaaatgtatacgacacatatttaaagtattaaacgtaaactataaacaaaacaaattacagattccgcctgtaaactgcgagacaaatatattaagcctaattaatatgttattactaaatgtttactgtagcaccacattattaaattatggtgtaattaggctcaaaagatttgtctcgcaatttgcatgcaaactgtgcaattggtttttttttgtccacatttaatgttacatgcatgtgtccaaacatttgatgtgacggaaaagttggaagtttgaaggaactaaacacagcctgattctctgaaactaataacagctttcaaatggtctcctaaattcaactttaaccattacttcttaaaccaactaaaaatataatattgtgcaattattttgtaagaaaaaattgtggctttcatgcatccaatttaagcaatttactatattatggtagctaacgtttaaagtttttatcagataaacaaaacaccatatttcactttgggccacattttatcacctatatttcgctttggatcacatttcaactaatgttttattttggatcaagtaattttacctccatgatgtttggaccatcctgataacttttttatccaactatatccaatttattatataaaaatagattaaaggatgatccaaagcacatatcaatagtaaaatgtgaagcaaagtgaaatttactcaaaacgaaagttcactctgtgaagtgtcaaattatcaaatccctcctcctattcgttgtgttgtaagaccagtttaaaacaattgatgaagtggagaattaccaaattccccctaatctctgtctccccctccctcacggcctcacctcttctccctccaaattctccatccccggatccccctctcctcctcctcctccgccgctcgtcggagccggaggcgcggcggccttctcccgcgcccttcgtctcctcacacccgcggcggccggcgagaaggcccagaggcaaaggcgtgaagcggcctcctcccccggcgcggcaccctcggacgcacggcggccggtgagcaggagcaggttcggagggggcgacgcggccgggctccttccaccggccagcatcctggctcgagtcgaattttgaaggtattgattactctcgtagcctccctccctccacctctccgcgatttcatgagccagtgtagattggggttgcagatcccctggagtttgacctccaaatccaccggggtggatttcagctgatgatttctatggatggcggattaagcaagtcactttgttccccatctactcggggtggccacatcatttcaatcctatactgctttgcgacatgtcaatctgtatcttattagctttcctgggctatcagtagttgacaaccagaacttgattggagaagaaacatcttgtgtgaaatacatatgacactgggaacatcatcatatgatagttatgtattacttacttttcagaaacttggggcaccagtatttaccgcaattgattgaatactagtactcccgacggcaaatataaggaaagggtgggagtatattattagcagatcaacagcgaaaattataaaatacggcacaagca

SEQ ID NO: 58615 - DNA, 701 bp, Oryza sativa
tcaccttgatacggaaaaagctgcctgatgagaaagaaggtcaaggcgaagtgagcatggctcagtttcttggattccttggactgtttaacatgttatttttctttccttttgcattgttcttgaatttcaccaagctggagccattccacaggctgacatgggagcaagttggtcttattgttggaaaaggtaggtttgcagtttacgcatgaccataatgtgagctataataatgcattgtgtttgtgtgtgtaaacctttgcgttgttttaaatataacattgtaggaagtcataacggaataacttcgtaaaagatcataaaagctcaaactatccatggactagcactaacatcaagctgttgtgttctttacaggtttgttagataatgttttgagtgactacttgtgggcaaaagcaatccttctcacaacaacaacagtagccacggctggtctcacgatccaagttccaattgctgccattgtggatacactaacaggtcatgctcctcatctattggactacatcggagctgctgctgtgttggtcggttttgctggcatcaacatacctgtaggcactccacagggttctcagcaagagcaggaaactcctatcgtcagtatggttgatgatccagtccatttaccaagtgatagaaatgctactagcatggttgagggctgcaggaat

SEQ ID NO: 58616 - DNA, 1130 bp, Oryza sativa
aattcctgcaccccagcaagcggagataaatactacctaaggatgctactgaacacagtgaaaggacccagaacattcgaagaaatcagaactgtagatggagttgtacacccatcattcaaatcagcttgcgaagcattaggatttcttgacgatgacagggagtgggttgaatgcatccgagaggcatccaactacgcatcagggaaccaactacgacatcttttcacaacaattttatgtcactgtgaggtaactgatccgaagagaatatgggaaagctgttgggaggatctaagtgaagacatgaatacaaacagagaaaaaatctcaactatcctacgcttcgcctaacagagcaacaaaaaaagggacatgctctgatagaaatagaaaagctgatgagacaagctggaaaaacacttgaggaataccctgatatagagctaccaaaatgtgctgaactacgggaacttggaaacagacttctgaatgaagaaatgagctatgacaaagacaagcagaaagaggaacatgatagcatatttggtaaacttaatgcagaacaaaaggtagcatttgattcaataatagagtcaaccaacaaggggttgggaaaactaatgtttgtcgatggctacggtggaacaggaaagacttacctgtggagagctatcacaaccaaactacgttcagaaggaaagatagtactcacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaatttgcttcgaggcgctagacagaagtctaagggacatactaaggtccaagggtgaagataacagcacaaagccattcggcggtatgactgtggttctaggaggagacttccgccagattcttcctgttgtgcgaaagggaagacgcacgcaaatagtaaatgcatcaataaaacggtcctacctatggcagcacttccacatcttcaaacttacaaggaacatgcgcctg

SEQ ID NO: 58617 - DNA, 16154 bp, Oryza sativa
acccacccactgagctaggagataattcaaggaggatgttgaggtgaggacggaacatgggaggtggatatggacatggcgctgcaagcctgcaacagccactggagggagggagacaggaaactacaggagacccacgccgtccccgccacccgctgctctccgcccgcggaccacgccatccccgcctcctaccatatgaagttttgtgaaggtctggtatggtaattatatataaaattatcaaagttacaagctttttttactacaattagttaactacgaaagctcaattatacagagtcatacagacacccttcatgatggcccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcccgttgtacagcccaatcgcgagtgaagcggttggcgatgcagtagctcggcggcgcaaccagctcggcctcgcactccacaaccttgcgggagcgcacgtcagatcgagacctccgtccccgccacccacgtcgccgtccccccgtccacaccgcctgcagctctccgctagcgctctctgcccgcaacccacgccatccccgccgcccgtcgccgtccccgccatctacgccagcaacccacgccatccccgccgtctgtcgccgtccccgccgcctacgccgccaacccaagccatccctgccgcctgcgccgccgtcccccctgcccaaagctctccgctcgcacctccggcccgcgccatccgccctcctcgtccgcccttcccctcagacctcatcctttccattttcccctcttctgtcactctctccttgctatccatacgtatactcgtatagcggaatagaaaagaagagcaaaaaaaattagctagagttacagagtattagttgcctactactaattagtattttagtcaaagcaaagtgatgcaaaatttgtttggttaagtgcagttttttttcacaaatgcataattatttcatctacatagattaacaaaatttaacaatcatctgtgtttttcctgtacttgcgagacgaaacttttaaaactaattgcgccatgatctaacaatgccgtgctacagtaaccatttgctaatgacggattatttacgcttaataaatttgtctcacagtttatatgcggattatgtaatttgttttgttaataatctatgtgttaataattcagataaccacttttctctatcctctattttacacatgcttctaaaaaatcctacgctaccacatgatttaaaatcttagacctattattttggaccattacattatatcttttcaaaataaaaaacatatataaaatataagaaaaaaaatatgaccattgtaactttaatcggtaaaacaattatttacatccgatagaccaatccttaaaaatacaaatccattccacctccctcccgtacataatcactcatctctccacaatatctgtacgtacatgcaagatatatatcttgcatataacggaattttaaaaaattaccatcgagacaatcgtcaagctactaatgcaaaggttgtttgattattatttgtgcagatgataatttgatctaactgggttaatacatttaaaattttttacactctatccaaacatccattatattccatactatattttaaacattcatttctatcatatttatataccattttcttttcttttctcaaaatcatttatataccattttctattcttttctaaaaatcctgtgttacaaaggaaaccctaaattctttctaataacaacaaaaattatgatagtttaaataatatgcccgcgcaactgcgcgggctaccttcctagttatagtaatgttgacaaaaatttcagcttgtttctaaggtgcagtgtcatattaattagtccagaattctagacccaggaaattagatagtaatttctattgctaaagtgctaaatgctgattgtcttgcaaagaaaaagttcatctggaaactgaacttgtgcatgctgagttcaccaattctgcaggcttttttgaaaaattgtgaatcaatgtccgaaatctgaaaactgatcctagaaaggtctatctctgaaccaagaacttcctgtgtgattcacagtagcggtcctcgtatgatcgtatcaatatccaatgtctgatgaaaaaggaaaatagtagtatcgagtagccgacacaacctcagtttcgtgttacaagtcactttagcttttgccacaagtcgaacttcctattaacagcattcatattaaaatacactaacattcacaacaataaaactatacaattggtcgatgttagatatgtttaacttaagacaaaagctaaagtgacttaaaatatggaaccgaaggaataatagcgagtaggaagacaaggaaattaatttgtgcagttcaagtcagaacgtagcaggcggagacgatggtttttacaggtgcaggtccagagagctcctggagattttattcaggtagtgcgccgggtaagggcacctgcttgcccccttgcaagttgtcaccgggagattttcggtcgcgtgtggcgacatggtctggcagcgaagattgcaaggaacccagattataatgactaaaaatctaccctattagctccgcctgcgtcgctcgccctaggcgacacgggcagcgacaacacgcgccgacagcccgcttcctccccctctcttccgccttgccgccgcccgagcagctgccggcaaagccacgcagcagcaaggatggtggcggcggggcctcttttcttctctcaaggagtacggcggggcaccggtgggacttgagcgactgaggcggcggcggcggtgccgccagatccgcgccgctccggccggatctggcgggatggcggctggcggcggggaaggtgatggcggcgggggtgatgatggcgtcggggatggcgagctgcgtctgttattgggggccgtcgacggcggggatggaggtggcggcgaggctggcgacggcgggccggatccaggcacgccggaggcggatccggccccccgtgggtggatccggccccccatatgggcggatctggcgcgggagctccacgtgcttggcggctggtggctggtggcggtcgcggcagctggtggcggtcccgacggctggtggcggcgtcggggctgtcgcggcggcggctttggctggcgacgtcgacagaggacatggcggctgcgtcagggtggttgctggcagcggctgcgttggcggtggcggcggttcgcgatggcggtggctggcgtcggcggctggtgacagcggccggcttgcggcggccatgactgaggaggcagcggcgacatcggcggatgtggcagtggaggcggggaaggagtctgtttggtggcggcgggcgacggcgcagctgttttgcggaggcggaggctggcgtcggtggcagcggtgacgtcggctgtagccgtgaaggtggtggcaacgtcggaggatgcgggtcgctggcaacagcaagtggaggcggggaaggagtcgggtgcgaggtgaggatggcgtcggcgaggtggctgggtgttcggcaacagcggctgcggtggtggtgaccgtgtctgcggccaccgaaggcatggcggcctcggacggctagccgagggcgtgggagacgactacatctagctggtgcagcatcgtttgggtggaggggtcggagaccagcttggcgcagagaagcgcagccgatggcagcggaggctggctcggcgcgagaggcgcgggcggcggagatggaggccggcttggcacggaaggcatggccgatggagggaggctggattggcgcgagaggcgcttccggtggaggaggccggcttgacgcagagtggcgtggccggcggtggaggaggcgacctaggtgtgaggaggagctgtcggtgggtgtggcgcggtcttcggcgcacgaaggctggccggcaggggacgccggtgcagaggtcccacatgtcggcaaagcttgtgtggtggtggagcatcagtgcgtcagccgtggattcacaggtggtgaacggtgggtgaaaacccagtccagccttggtcggactgacaacgatgtcctgagggagttgttgcgctgtctcacccctcaaggatgattgccgagcgaaagcccagtcttggctcttttaagtcttgacagacgacggcagcagtttttccgtcgcttctcttcttgaagacgttgttttggcatcctataggggcaatctcgcatgtgtccctttgttggtctagtggcggtcggtcacgcttagcagcggccggtccggtgttagccttctcctgggcttgttgttggcgatgtcgccgtgtgggtggtggtatatttggttgtaatcttgtaattttttcctgctctatcaatagaacttcgcaccgtctcgtgcgagtcgttcaaaaaaaaaaaactttctagcaaaggaaagagatctaagatagtagagagtccagcattggaagagtggagctagtatggagaggacaggctacctgcagtgatgaacggcgtcgatcaccaccggtcgccagacaaagtggggagcgagaggataaattagctagaggcatttcggtatgggcatatgtgaggaaaattgggttaccattttaatttggaagaaatttcgaaatgtcattctggcatcggcccctaagttggaaatagcattccacgaaatcaaattggaatttttacaacggcatttcggcgaagcctacttttgatgatggcatgtatccaaatttctcatgacgcgcagagtccacggatcggtcactagtgtgcaatgcgccgtagacaagtgtctaaccagaaccgaacatccggatcggggcaatggtggtgtcgaccggagcgggagctgatcggcgggaagaccgccggcagcgcacgggggtgtgtgccgtgcgcgcgcggctccccttctagcccaaaaaggaaaaaaaactagcagttttgggccccgaaatatccagcccaccaaaactatcaaggccgaaaccgaagcccacaatgatgaagggctcccggattcaccggtcgatcgcgtcgcgcgatccctcggcgaggccctgatcggcggcaggagcagagccatgatcgacgacgacgaggaggcagcgctatggtcgcgacgaaacacgccagtggagcaccccatccgccgcgcgtacgaccgcgtcgccgccgccctcagggagaagcgatccaacgagcggctcgcccgggagtgcctggaccactacaacgccctgcacccgggcgacgagcacgacctcgcacccggcggcgacgtgacgctgtcccgctcgcactgcagcaccggcgcctggacgcacggcaacttcgtggctcgccgccgccggcggcaatggcgccgctgcctcgccttcgtcctccccgccacgcggacgctcttcttcttcgagcacatgtccggcgacgactacctcggcgtcatcacgtgcatcccgatgccggacgagccggtcggcggcttcctcgccagaatccctgtcatccgccggtgggcgacccctcgccggagcggcaggtgggactgcgtctgcaagacgtgccgccgcggcctccgcgtgacgcaccactggctgaagaggaaggtgatcggcgagttcccgtgcgggcacatggtggcggagagcgtctgcaagatgtgctaccactactccgacgtcgtccatccgagcccgggcaagttcgcgcgcgggtacctggagcacgaagacgaatttggccactacggccgtaatggcttgagggattatccatgttaactaaccccagcgtgtttctcttcgcttgcaatgctcacattagaagatctacactaataaatacgtatgtaacagatatttttgtcacttacaggtaggagtagaaatttgacatgttgcagcaaacaattcgtcatgcatgttagagctgcacaatttcagattttgctatatatatttcagaatttgatgcttgtgttggataatttcgtaggtgaaggcgtccagcacgctgtcatgatgcgataatgcttctctttggacaatttcgtatgagtgaaggcgtccagcatgctgtcatgatggtattatgaactgcactgtaatattattagtccaaaattctagaccccaggaaattggatattaatttcctattaccaaagtgctaaatgctgaatgtcctgcagagaaagctaataatcaggaaaaatccgccgtccgcccattacttgccttgctcaactgggcttgagcacatcctgatcaattctacgggcttctagaaaaactgtgaagcgaggcttaaaatctgaattttgattctaggactagaaggtgtttctttcagaacgatgaattcttgttagtgacctgtcctcatatcaacatctgaagccttgtgaaatcgaggagtagcatctagcagatagtgccgttctagaatcttgatggttacaatccctgtctggatctcgcgtgcggttttctcaaaagtcaaaaacacaagctgttactctctggaagcgaatcaatcatatagtcttcgggtacacttggaccatacagtagcttgcatctctgtccacaacctttttactcaaaactcaaaaaagtcgttgaagtttcagtacagaaggaactgacagagtagtgccgaactcttaacgaaaaaccaaattcgctacatctgcagcgcaatttttcctttgcggacagtgtgctaagcggtgaattctgcaacacaacgagtttcagagtctacaatgtcctagcctactacaccaaaactcagactaatcatggacttactgccagaatagttagtactaatgtttagcaatataaaacgcaacaatgtgctggtaggtagtaggagttgtacagacagtgggcatcagagtgacatcctttatgtgtttttctgaagctagtctacgcacaagtccacagtcagcaaaggcgagccgggctctttgaaattttcttcagtttctgacgttgcacatgagacttcctgctcctttccttcgtggccactctcactcatcgctagccactggatcaccgaacgtgcggctgagatcgaagctgggatctctctgtgggagacgggtcaatgggctgcacagctgcatcatccagaagcatttcctgtcgctgccagcattgtcatcgagcacctatacggtgtgcattttcaggttaaaaaaaaaaacggagtatccaaagctatactcggtattctagaagtgaagaaaccggataaacttttcactgtggtatttatccatatataccgactatatactgtatgcacgtgtggtattgagtgcagtatcttatgctccctttcacttaccgtttcaggcctacgactagtcaacgaatgaccacaaagagtttaaagacaacccagaggcgccagagccacatcattatctaagacttttctgtttgactcaactttagaccagggatttgtgcacgagtacatctagatgtgacactgacatcgtgggcccaactcaccctgaacccgtgacctcgtgctgacgactcacattcccggcctcaggtggatgatccccctgtaaaatcagtggaaacaaaaagcttatcatcatttgctaattgcttccactttaaatttacttgccgtgcttgaccggttataatctcgactctcgtaatagttttctttttctttgaagactaataaatagtgtgatactagttctaatcggtttgaagatatactaaaagaaatggtttcaacagcgacaatacggccagtggagcaaaattagatgtttaaattattggtggccatgggtgatagcaataagatcgcgcgatctgcaacatcttccactcctctttgtcgcaagtgatcgacacctctgtgcttccgaatagtttgaccattcatccgacggcagagtaatgtgccggcacatgctacagtccaagccaacggagcatattgtcgtaccttgatcatgaaaagatcgcaaaactcccataaagaaaccatgtcacgagctgtgcaattcgtacacgttgctcagcttagtccttaacttaacttagtagtagctgcataaacaaaccatctagaacatatccctttcaaacaacgccaccatctgaccagcaaaaaccaaacaaaagatgagctaaaccaccaactggtgaactagtatcaaattataaaggaaagcatggctgaaacttccaagcaagcagcacccaaaaactaatcctaaattcctaacaaattcaatcatttaaccaaacaggataatggaggaagaaaagtctgcacgtgccgttcacactgcatataaatggcccacccatgtttctcacggtggagtccgcgatggctgcttgcctcaccgagtgaacgcacgcgctcgccggcggcgaccaagaaaccacgcgaagacatggcattcccgagcggcaaagcctactacctccacctcctcctgctcgcgatcctgccaagcctcgtcgcgcggcgcggcgcggcgcagcagggcggcgtcgacgagaagcagctcctgctccaggtcaagcgcgcgtggggggaccccgcggcgctcgcgtcgtggacggacgcggcgccgcactgccgctgggtgtacgtgtcctgcgacggcggcggcaccggccgcgtcacgtcgctgtccctccccaacgtcgcggtcgccggcgccgtccccgacgccatcggcgggctgacggcgctcacggtgctcaacctccagaacaccagcgtcggcggcgtgttcccggcgttcctctacaacctcaccgcgatcacctccatcgacctctcgatgaacagtatcggcggcgagctccccgccgacattgaccggctcggcaagaacctgacctacctcgccttgaacaacaacaacttcaccggcgtgataccggcggcggtgtcgaagctcaagaacctgaaggtgtttaccctcaactgcaaccagctcaccggcacgatcccggcggcgctcggcgagctcactagcctcgagacgctcaagctcgaggtgaatcagttcacccccggcgagctgccgggatcgttcaagaacttgacgagcctgaagacggtctggctggcgcagtgcaacctcaccggcgatttccccagctacgtcacagagatgatggagatggagtatctcgacctgtcccagaattcattcaccggaagcatacctcctgggatttggaacattccaaagctgcagtacttgttcctgtacaccaaccagctcaccggcgacgtcgtcgtcaatggcaagattggagcagcgagcttaatttatctcgacatatctgagaaccagctgactggaacgatcccagagagctttggaagtttgatgaacctaactaacttagccttgatgacgaacaacttctccggcgagataccggcgagccttgctcagcttccatcgctggtgataatgaagctgttcgagaacaatctcaccggtcagattccggcggagctcgggaagcactcgccatttctgagagacatcgaggtcgacaacaacgacctcaccgggccaataccggagggggtctgcgacaaccgccggttgtggatcatctccgccgccggcaaccggttgaacggctcaattccggcgagtcttgccacttgcccggcgctgctgagtctccagctccaggacaacgagctttccggcgaggtgccggcggcgctgtggacggagacgaggctgatcaccgtgctcctgcagaacaatggacacctcaccggaagcctgccggagaagctgtattggaatctgacgaggctttacatccacaacaaccgtttcagtggccggcttccggcgacggccaccaagctccagaagttcaacgccgagaacaacttgttctccggcgagatacctgacgggttcgccgccgggatgccattgctgcaggagctggacctgtcaaggaatcagctctccggggccatcccggtgagcatcgcgtcgctcagtggcttgtcgcagatgaacttcagcaggaaccagttcaccggcgatattccggcgggattgggctccatgccggtgctcaccctgctcgacctttcgtcgaacaagctctccggcggtattccgacgtcgctgggatcgctgaagattaaccagcttaacctgtcgtcaaatcagctcaccggcgagatcccggccgcgctcgccatctccgcctacgaccagagcttcctcggcaaccccggtctctgcgtatcggcggcgccggcgggtaacttcgcgggcctgcgctcgtgcgccgcgaaggcatccgacggcgtatcgccgggtctccggtcgggtctcctcgccgccggcgcggccctcgtcgtcttgatcggggcgctcgccttcttcgtcgtccgcgacatcaagaggcggaagcggctcgcgcggacagagccggcatggaagatgaccccattccagcccctcgacttcagcgaggcctcccttgtgcgcgggctcgccgacgagaacctcatcggcaagggcggcgcggggcgcgtgtaccgcgtcgcgtacgccagccggagcagcggcggcgccggcggcaccgtcgccgtgaagcgcatatggaccggcggcaagctggacaagaacctggagcgcgagttcgattcggaggtggacatcctcggccatgtccgccacaccaacatcgtgaagctcctctgctgcctctcccgcgcggagacgaagctcctcgtgtacgagtacatggagaacggcagcctcgacaagtggctccacgggaacaaattgctggccggtggcgcgacggcgagggcgccgtcggtccggcgagcgccgctggactggctggcgagggtcagggtggccgtcggcgcggcgaggggcctctgctacatgcaccacgagtgctcgccgccgatcgtgcaccgggacatcaagtccagcaacatcctgctcgacgctgagctcatggccaaggtcgccgacttcgggctcgcccggatgctggtccaggccgggacgccggacaccatgaccgccgtcgccggatcgttcggctacatggctcccggtaattcacctcaaccaacctcgctgctcgtctcacgattctcccttgatttcttctcttagcacagcgacttaccttgtgctgaccacgatcgtctcgtgcagagtgcgcgtacacgaggaaggtgaacgagaaggtcgacgtgtacagcttcggggtggtgctcctcgagctgatcaccggcagggaagcccacgacggcggcgagcacggctcgctggcggagtgggcgtggcggcacctgcaatcgggcaggagcatcgccgacgcggtggacaggtgcatcaccgactccgggtacggcgacgacgccgaggtcgtgttcaagctcggcatcatctgcaccggcgcgcagccggcgacgaggccgacaatgagggacgttctgcagattctggtgaggtgcgagcaggcgctccagaacaccgtggacgggaaggtggcggagtacgacggcgacggcgcgccgtttctgccgatcaggggtggcagccgccggaagcagctttcggacaccaaaggcatcgacgacggcaacggcagcttggacagcatagtatgagaacaatggtcaataagaagtataacctgatccaatggttaccatctaggagagatggcacgctagttaggagagcaggtagataccagacaaatacattcgccatccttcagttatttgcatgtaatgagtattgtaactttgtaaatgcatctataaaattttgggacagtgagagtgcagtcacatacatatatgagatcaaacaagagcaattagattatgtccccttctttattacgaagagaaaatacagagcaaaaaaatcttggttctcaacatcaattaagggggaaaagaatctgacagaacaggaatggaaattgcctgtgcctccatttccctgttagtctgctactgccatccaacgttttatgccattagaaaacctccaaactcattggcgctatactagctatatcccgctgcagaggcacttatgtttgccctcagaatagccaaaaaaagatggtaagatttcaaggggggagccaggagtattatgtggattttgaagggggaaatgagaacctacaaacggagtttgattcatcattcatcaagatcatccttaaagctagtcgatctcggcatactgggagtgcgaggctgcgagaagagcagctccaatgccagaaccatcgttggccagcttggtaaccaccgaagacgagacatcatccccaagaaggtctgttagagttgattctaagcaactgctgaacttcttgtaatgttcatagagcccaccatccaaggcaatgacagtcctaggcatcttactgccgtcttttggcatcttgtcccgacctagcttctttaggaccccatatatgccagcagcagccaagcgtgcagcacgctctgcaactatgtcacaaatgtgactggtaatgtatcttacttccagggaagtatctgggacctgaataaaagatcaaatcataaataagcaaccagtactcattgaacagtgttggatgttgcgtatccactttgggtcaagaaatttcataccccgacgatatcctttagcttagctccaacagttttaaggtcatgtgacgagtcatgatgcatggctgacatatccggtgtcctgtgatacaacaattgagatacttataaaaaattctaccagagttgcataagattgaggggttagaagcataaagaaaaactggtgagcaaaaaccaaaccaccctaattatccaagctagataacttctagttgcacacaattatgagaatcaaccagaaccagaagaaagtagtaatggataaaacaacaaagtgtatgtttgtcaccttccatggatttgctaactgatttagcatgataatttcaagatatacaaacaacttccccttccataatctatctgggtatattatcaacagtgcgaatattataatggaaacgatgccaacgtctttatatcatgtgcactcttatccaaggggtagtcacagaaatcgtgaaaaaaaaaacttgaccagcatgatagttaacaacaaagtaaaacggcttttgccatgacaaaaggaaggaatgaagatcaaaagagagatggtacagaaatataccttagtacaaacggttgctctagcttagatggaacaacatccccaaacaaagctgcatcatgagcaagcttcagcaagattcttcgcactatctctccaagatacatgccagaaatcaacttttcatatatctgttggaaaatacatacaagttaatgcggtccacctaaaaggctaaaactaaaaggagaggaaaatactggggatagaatacctgctctccaggattcaagctttcaaaatccattgctttatcgaattctgaaagaggaagcttatctgatttaaagctcccccattctgtgttgattacctagagaataccaaataattccacgtttacatatttttttaagtagggttaacattcaagagtgttggcattgatcatctataagacatagacaactaatgataatcccaagcataaggtattcacacactaaccatatttccggacctaggcagtaaaccggtccatttaggaattgcattagcattctcaacatatgctgcatttgtaccagtgcccaatattatagcagcaacaacactgttatccgcatacctcccaccagccaatgtgccgacagtgtcattaacctaacatcagtggtaaatcatgtaacaatgtttgcatcacatcatcagatgtgaataccccaaaagcagcatcaggatacaaatgattatcaatgcctcagataacggagctgagcatagatatagtgtggaagtaagaaattgacgaaattaatatatattaacttaccaatgctgcaattttcatatctaatccctgcctctccatggccttgcccaactcagatacaacatcttcgccaacctaattcaggagataatatagcaaaatcaaattattcttattggatgcttgacagttcacacagatatgatcaaccaggcaaacataatactgagtactattaaagatcctcaaattaaatatgcttcctgatcaaggtcgatatttcttttcactaacctagttaagttgattacaatgtacacaaagggagattgtagcaaatagctaattgaaatactccattgccatattcaatcaagctttatcaaggaaccttgtgacataattcatgtgtttaaagaaggatcaggattgtgttctagtcagggtatgtccaaaagttatttttgattttaccgcgtcattgatggagaaaccctttgtccacttgatgagcgttcctgacgatattgatgtctggctcactgggaaggaaaaggtgaagcccagctctctctgtctcccttctgggaggtggaaatcatcaccttcagtatcaacaaattttgacaatgcagaagcaataaaatcaaacagttcctgcattaatagtcagaaaatacataagacaagcatggaatgtacagctccaagaaatttaaaatcaagcagcaaatgcttaccatggaagttccaaccatcagatgtggtggaattgagacttcctcgtactgttgttggacgacacgtttctccttgccaccgagttggactcgcaggacgcggaagttggttcctccaagatccaatgcataaaacaacccctgttcatttctgcaaagggaaatcattatgatcaaagaatgaaattactacttttggaagaaggcagcaggaaacattgtatgcttatgggtgagtgagttctaacagactggtagaaggatccgatagaataagaatgaatcattatatttaagaaacttccttcaggatgtgcctgccacatttagcttaacgatgtggaggttacagagaaacttattaccagaccaactataccatgagataagctcgactgatggatctaattggtcagattgctaacaaggaaaccacaatgcaaagaaactctctgccatacattagttaattacctgtcactgaagccttaacaaatcaaaccaacaagaaattaattaatcacatatcataatcagaaatcctaaagagccaaagtaggaacaaatggacgatcaaattaattaatcacatatcataatcagaaatcctaaagagccaaattaggaacaaatggacgatctactatagatcacaaaaccgaagatcatctgagaacgataggatatgttgacgggagacctatctttcctagcttagataggccaatttatctatcttgtttgagttctatgtagaatcctgtttacacaaggacatgaggggtacagttcgtaatccggtaccccgcaaattgttttagcaaacaaatgtgatctataatctataacatgtatgtatagtatgtgtatgcacaatcagctaaattaaaacaatcattttcaagcacaaaaatcatccttgtcaagagtattatcattttctcttggctactttatatttttttctataacaatgatttatgtttgtgttaataacacatactagcacttcattttttttctcattgcatgatgctttagtaactctgtacccccatcaccgaaatcctgcgtcctggtgcatgagaagcaatttcagatgcccacgactccacatttttccttcaatcactggtatgagccaatttgccttggctctcctcagcagagtccgagagcaagcgtttccttgtggttacataacttatttcagttataacaaatg

SEQ ID NO: 58618 - DNA, 766 bp, Oryza sativa
attcctgcagccctgcaatgtgaagttggggcgtgtcctcatagatggaggagcggctctcaacatcatttcccccgcggcctttgatgctatcaaggccccggggatggtgctccagccgtctcaaccgatcattggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccctggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggag

SEQ ID NO: 58619 - DNA, 2268 bp, Oryza sativa
ctagtcgccccggagccaaatgagcccctgctactttacttagcggcgaccccccaagtagttagtgcagcgttggttgtggagcgcgatgaagacaatcctcatttcgtgcacccccattctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgggaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcgccccgaaaggccacttgaacgaagaacgccccggggatacggcccctagcagaggggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttccgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctctgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccaggcgcctttgaagaaaggcttacccggccgtcggcgcgacccgaccccttaggggagacggatgcgcctgaccgacccccgaggcccgtcggagtccaggcctcgggacccgaagggagcgctccaagctcccttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcacccaggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgatcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcagggctgcaggaat

SEQ ID NO: 58620 - DNA, 717 bp, Oryza sativa
attcctgcagcccgttgcgagtatatggattgctgcaagctacattgttcagtctgttgtggatgagggtgtttctccattcttgattacctacatatgcaattctctatttgttatttacatcccaatagttgaggctgcacgatactttgaggattctatcaacaacttttggacaaagttgaaaggcaaggatgttgcggacctggagcagtctgctgatctggagagcataaatcttctccatggaagtgaacaagagggcaatacagcctcaccaacaaggttgcctgaagacatattggcttcagaagcagtcttccctgtccaggccgagctgaatgtagcagatggcagcaaagggttggatgcaaaagggcgctggacacgtgctcgtgtggctagagtcagcatggtagtctgccctttctggtttctcgctcagcttacattcaacctgtctctaagatacaccactgttacagtaagtgttactaaggcctgcatttccatgccattatttaacctcgctcctgtccattggtaacatgtccttgtttctttgtacctgcagtcaaatacgatattgagcagcacgtctagcctcttcactttcttggttgcactagtatttcttggagaaacattcacgtggttgaaactaatcagtgtacttctctgcatgggaggaacgataattgttagcctagctgattc

SEQ ID NO: 58621 - DNA, 2107 bp, Oryza sativa
cccattatgcttgtctttttcgcaatccctctcgctgatactcccttccaaatatccctcgctgacgggtgattctttttagtgaaacacttgcattgtgctagttctagattaaaaaaaaaaaaggttagaataactttcgctggctgtcgtccgctgccgcgccatcgtctcccccccccccccccccatctcgtgcagccgtccgccgccttgaagccaccggcgtcgcctcgtcggcgcgctacatgatcgagcacgcctcggcgtcggaggctgcgccgaagctttcgttgccgccgccgccgtaaaggtcgtcgttgccgccgatgtcgccgccattggtcccgatgctgctgctgccgtcgagtccgccgccgccattggcgctgtgcccgccaccgccgttggcgccatagtgatggtgatgatggtgtacggtgacgtcgggtcgaccgtctccagccggcggcggacgcggacgatacagaggaagcggcggcggtggcttcttcttcttcttcaagctcttccagcactggctccggtagatgtaggcgccaccgcacgccgagaagagagacgcgatcatcgtaacgaacacttgaacccatgaccatgacttgcagttgcagacgaacacgcgacgctcatccccgccggaatggccgtcgccgccagaaccatcattgccgccgccgccgccgccagtgcatgcagggaagccagcatagcaggggagcgcgggtggagagaagtacgaaacgtctggtggagagtagaaaatgggtggaggtggcggcggcggtgagagaggtggtgggcagaagatcgcagggggagggggagcaccggagatgatataatccatctgagctacgcggtggagaggatgaagctagggcgacagagtcgcggagagagagagacagagcgcacgccggcgaagaagaagatgggagggttttgtagtcttcctccctctgctcacggtgggccaaaaaaaacccagcaaaacagggtttccttcccagaatgtgtaggttcctccctctgctcatgatgggtcaaaaaaaaccaggttttcctcttctcatagtgggtcaaaaacctagcaaaacaggttttccttcccagaatgagtaggttcctccctctgctcatggtgtcttggtgtgtccaaaacccagcagaacaggttttccttcccagattagaatgggtaggttgggctaaaattgacccacctagctctgctgcctctgcatccccaggccagcctctccaggctccactattctcttgttttgggcctgttctttcttttcttttctttttttttcaaatgcagcattaggccactggcttccatactagtgctatatatggaggggggagggaggtatatatggatggttgaatgtgacacctcttggagcatctcaactgtttattccgatcatcgagccaaaaggccagtacaggccaaggtttagatcagctgaaagagacgcttcagatcagttgaaagagacagggtctttctgatagaaaaatatatgatgacgtgccatgagcctcttaatatcttgtactagtggctaatcaaatatggttagatttggaagtggcctgcatggtagtggcacaccgggctctcctagtacttctctcggcaagagtgacattgacgctggcactacaaactcatccgctgactgctggatcatcatatgttgaccatcatcattatttctatatagcaaatcttttcgcaataccattatataattttttttcgacatgaaactatattacatcttcacatgataatgctgtatagtaatacatacgttattcgttataaaatgttttcttattattatctaaaaaaaggttttcttattgaaacataagcttattgctaacaatacagtaatagtattagaagtactactaccgcgtttgaacaaaatatcaaattactcctctaaactattgtgacaatttaccaactgaacggttacaccaggctacccaaactcgttaatccaaataaattatcctttgaacactcttttaggcggttttggcatgagatgacaca

SEQ ID NO: 58622 - DNA, 702 bp, Oryza sativa
atttgccggcatgcaacgagccggcgtgacgccgaacgaggtgaccctcctcggcgtcctcacggcgtgctgtcatgccggacttgtcgaggaggggctccagcaactcgacgccatgccggaacctcgcatcgagcactacggctgcgtcgtcgacatgctcgaccgcgccgggagactagacgaggcagaggagctcgtcgcggcaatgccagcacaccccgacgcgctcatctggggctcgctgctcgccgcatgccgcgcacatgacgacgtcgagcgcgccgagcgggtgatgtggcggcgcaccaccgacgccgacgcggacgccggcgactacgtgctgatgtcgaacacatacgcgtcgaatggccgccacggcgaggtggtgaaggtgaggaggcagatgaggaggaacgagatcgacaaggtccccgactgcagcctcatcgagatcgacggcgtcgtgcacgaattcaaagcaatcccagcaaattccatccgataaaaacacaacaagattcatcaaagaacaggttatccgattgatcgattgatcactgtagataacaagattcatagaaccaaggatgcaagatttccactggaaattttctacttctagctgtacatgagatttcagaaggcattatttggctttattggttattgctgcaagaagttgatgctcatttgggcttg

SEQ ID NO: 58623 - DNA, 754 bp, Oryza sativa
attcctgcagccccggctcgtcagccatcgggacgcacgtgacgacgccgaggaagtccttgctggacatgtgctcgaagaagaagagcgtccgcggccgggagggcaggaacaacgacgcgaggcagccggagcggcggcgagccacgaagttgccgtgcgtccaggtggtggagttgcatggcgcgctgcacagcgtcacgtcgcccggcgcgaggtcgtgctcgtcgcccgggtgcagggcgttgtagtgatccaggcactcccgcgcgagccgctcgttggactcctcctccctgagggcggcggcgcggcgccggtcgtgctcgcgggcgcggcgccgtctggagtagtagtcctcctccagcatgatcggccgcggccatagcgccgcctcctcgtcgccgtcacgtaccccgccgccgaccatggctgcgtccaggatttgcgtcgcgatcgatcggagaatccgggagcctttcaatctcgggaagaaaacgtcaaatatcagagaagaaatcacccaatagagcaaaatcgctcgggagatcgtttgattcgtttcggactcgttgccgttggagacaaactgggccttgaaataggttggcagcatggcatgatgggccccggcacgctgagcttcttttgggcctgagaggccttgtgggcctacatctatgggcccaaattgctatacttttacggagaaaattgcatatctagaatggcttcaatataataccattataaa

SEQ ID NO: 58624 - DNA, 2246 bp, Oryza sativa
gttgtcatacgctgtctcgtgttgtccattctcgtggagtagaaaattgtagtagtggacaattttcaaacttcaatgtccaaagaaagaacatagttgagctgtcaattcttatttacctgtagaatctgatggatcataaacagaaaaagtatccttacactgctgaaatgcttgataagagttactaaaaaaacaagagcaaggcgacagtgctactgcctttttccagaacaaaattatcagtacatctgatatctcttagttatataatatctggacagaattattaaattcttctctaatatattttactaattaactatgttgtcatgagtcatgagtaatatctcgtgacaaacaaatgaacaattgtgcatagcaatactgctagtaatcagaaccctagacgttgtgcaattggcttgggtgacttgggaccatgtagttttgctaatgatgcagctatgctgttagtctttttgtatacgaaatatttatgctctgtatgcatggttatcattagggcctgttcactttgatgccattttcaaccttaccaaattttggtaaagttaccaaaaaaagtggctacatttagtttcctgccaaattttagtaactatataagaaattctgccaaaattttggtaaggtttttttggcatcaaagtgaacaggcccttagtgaaagtatctatgcatatgcataatgcaagtattgtttgttaggaatgtacatgctctccaaaattccgtggttttgttcgttgaatcatataccttagagatgatgtcctaattcgtatgcaagtgtttacatttttatcgcatatttacagatcatatgtatatctgctagctgtgatattgttagtctccatggtgtgtttcctagttggcctcgtaacatcagaatccccccagtattatctacctgatttagtggcctctctgatcgacagaacttaatgtaagcagcggctaactgataaaatatttgcacaggacatatgtggaactaagtacgcgattcatggcatgtttaatttttctaggaactaccattgctttcatctactccaatgcattgttcttgcaaagggaatatagccttttttagctcacgaacatgtgagcacacagccacacaacacggaggatgcagatgtttagggaggagaaaaaggctacagattctttcgtaatccaccctgtcctttgttcttttcctgccattcggaatttagtggtgacccaatgacaaagacctttccagtgtttccaattccaaggctgcaagtattaccgtgaatctttctgtcacaccataaaaatattacaccccttttttgggtcctgtagtttatcctttaacctaaagatcttgattttctacaggtggagcctatgatgattaaccatctggaattaatgcataccacataccagtctttcaatggtgaaattgagcaagggatctgctgcaaacttttgtggccatgtggggttttacctgaaatttcaggtattcctcaagcttttacctcttgcagacttcaactggtaatttaagttcactagtctccttccagtctcgtataatggtggtacaatttacatctggttcagtagaaagtagtaaatagaaacaaattatcaaaacaagcagtaattccacctattgagctgcagtagagtgtgattgtcagcttgaagcccatgcactatctctatcatggaatggatcaatgccatgtgttattcctgagagcaacccttgtgatatgcactcccgagagtggcttcagatagcttccatgtttggcaacttttcctatggaggaagcaaattaattgccacggaatggtgtgtaacgaaaagaaatgaagttatcgaattcaatcaatagtttccacagttgtgaaagagggattaacctgtgagttagtcacagctgacaaacttctatgacaactgacaggaggaaattggggacgcagctaacttgaagtaaaggtgtttggatagctagagtgataaccaaaaaagtgggcaagttcacacgctctaacagcaggaccataggatattccatatgctgctgctgctgtattattgatgagccaccagcattctgtagctgttttcttgctctcttaatttgcaacagaaatcactattatgatctgaggattgccctgcagttcagtacaatcatggcatcgtactgtacacacttttg

SEQ ID NO: 58625 - DNA, 1020 bp, Oryza sativa
agtatggcttccatggtagaaaagaggataaaaggcagtaagtgtattgttacctcccctgggggttgctgctgtgcgctgcagctgagcatggtggtgagggacagcatcctttcttcctctcacctgccatattttcatctcctaacgttagctccttcccacattcttctgtgtcccggtggctctgattataacctgaggtaacagaagagaagatatagaaaaaaaagaacagctgctcaaattaaggaactagagtaagctgctcgttttcccttgtcctaccttctagtgtggccccaacaatcgcaaaaaatcctctctttgccccagttgtgccgatgctggtggtaggctttgaatgtgtagggaagcaaccgatggatggttctgaggaactctctcgttgttgctgctgtatcttctctcttgaatcagctgctctctcttcctgttggacaccagggaggccgagcttaagctctagctccttatcctcatcggcatctaagtttgtgttccttgatccttctccatctgcttctttcaccttccattctctcccgtcagggatgaggtgtagcagcgtgggagggaggcctttgtccttgaattcttcttccataggacttgatctgctataggaaatatgaattctctaagaaaaaggaacaagaggaaaatctttgtgttaaaatgaatagatggtggtatgtggagctgaggaaggactacagtgccaatgttaagggcttcaacactcaaaaactctaccataaatgatatactacatatgaagttgggaaacgatgggaagaatgcaagtatgcagctacttgaagagttcagttttgcactcaacttaggccggagaaagtgtcaaaacaaacgtgtaacatattctaaggtcaaagtgaaagctggaaagagaaaccgggaagagataggacttgtgatcatcaaatcaattcatgtcacaacctcaaagacgttttcgagcaagggaaatggagcctg

SEQ ID NO: 58626 - DNA, 9432 bp, Oryza sativa
tgtttatgactgcaactttcgcagtcatacaaccattgttggatcaaatatcaagggctcaaatcacacaaaagtactgttcatcagatactgtagcagatgaatcctgtagcgcgtactgtagcaagtgataacaaacagtactggtactaaatcatggccgttgaaatcttcgatccgatggtattgaagacctaagactgctaattttgcagtccatgttcaaactgcgtgggatcccaatccgatctagcgacgcctacggggttatggcttatccaggcaagtggggggattggtgatgtgatggatgcggggtttgttagtattggtttattatatcatcgtgtagttgttgtcggatggtggtggtgtcatggtgacacatgctgcaatgcttcttgttctttcttactacactgcccttctgggaccactgtcggcgttgggagaatgcgttttctcttgatttgattttctgatcgctgtccactttgcatgtgctgattgctgaaactatgattttgatccatgctgatgaagaacacgtacctccggagctacggtgttacttactcttatatagcaacctaatactagattgaacagattttaatcgtacgaatttaatcaagtactaagttgttatataatttttgaaacaaagggagggagtaatttaatttcgttcataaagagagcatgggttcccatccttcacaactgctgcaacttgtaggaacgttcgcaacttcgcatgaaggtatagtgcacgcctacgtgttgccgctgcaggacgatgtatgctcctttcccttgcttgcccatgacgagaactcaacagaggccagaaaacagctagtgcaccggaaacacagatgcatggttgcgagtagtgcaccggacgcacgcacgcgccatgacatggagtatattactgtagcacactacgggatagtggactttgtggcagctagcctcgccctggcgcgcgacgcgaccacgcgagagaggcagagataaggagtggacttttgcgcgcgtgcggcgcgtccgccactgcgtctcgtggtcgccgatcacgcgcgcgccggtgtaagatcgagagatcagatggacggtgtggtacggtactccgtatccagtggtggtcctggtctacagcgctggcgcgctctttcctcgctcgtgcacgcaacgcacgcgcgagcaccaccgcggctagctgcgcacatcgacgaggaatcagtgcgttcggtaggcggtagcccctgtagacggtagtgtggctccgcaccgcagcgacgactcgcggcgccgaggtgcgctttggcgcagacggccgaccggcccatgcgggcaccgaatggcgctatcgaatatcgatcttggagacttggacatgcaggctaagactgtgccggcagtgtcctgtgtcccggtctttcttttctgcgattttggacatctacagttctacactttcatggacacggctctgttgatttgcaactgcagggttccgaggtacaccgaccgtgttttccaactcgacctgttcgtttttgccaggaaggcccatgaggagcctgaaggccaaatcataccaggtgccagtagcccaccacataataacgacatccagtttcaacagcgtccattaagcaagaaaccaagtacaatgcttcactctattcttagaaccagtgtaaatatactctcaaaaccaggcagtattgagaatagttttgggtgatgtgacatctaagtgggccaggtggcacttacaatcaacaaaaagaaatgaaatacagtgggacccacgtgtcagacgcaacaaaatccctacccctctcttccctatctccctctccttctctctctttagctcttctcctgtaggccggcgcaccatgaaggtgatactggtggcagtcccaaaggtggtatcacgaccaacagggagagggccaccatccctgccgatttcggttctccctcaccttcgctgaccccgcgcgcctccctcatcgttgtgcaccgtgctcatccacggggttgtcctggtcgttccctagcggcgtaggcgcaatgctcgcctcgtcgatatggcaagaatctgtggtgccctctacgaccctaccaacaccgagggggaggctgactacaccgtagctccgtccgtctccaccgtaccctacattctaccagcccccaccatccagttgtgttttggcactgccattagttgcgacgccccacgtcgcgtaccaccattggccacaacgtcaacgtgcctatctgtgcccccacgtcgtgtcgtggtgtccaccgcatgccaagttgtgagaggtcaacccggccattgaatctagctgtccccttcgactcctaattagaagattggggtagggttttttttgtgtgaatttgacatgtgggtcctaccatgtttcatcacctaaaagagttttggaactatatatttacaccggttttaacaattgagtatgtgttgtacttggtttttcgatgggctttagtttggggtctatctataatacattcgatagtttttggaggaaaaaaacttgtactaaactatagtataattaaagtgtaactaaaatatgtaaatttattttgaaatcaaaacttgcactattactccagtgagtaggagggtgcgggttcgagtccacaaccaattcaacagcctaaaatcaaaagtttttccctaaaaaaatattgcaagttacctggcaatttctttggtttgtactgccgtgtcggcgaacaagtaagacgtgatcattaccgtgcagcaaacgcatgcgcttttcccttttttttttcatggcacagtttttttttcctgctaagtgtgtatacatcaagagtttgtatttctaagagtaaatttcacaaaatcacaaattctttattcaaaatatcacaaaactacatatttaaaacggtgtatcacaaaaccatagatttaacaacaaattcgccatgaaactacatgtttaagataaagtactataaaattatagatctagtaataacaaaattatcacaaaactatgagtctagcaccaatttaatcgcaaaagtacaacatttacatcttcaatataacattagttctaagagtttaaactctaaaatatgcaattttgtgataacatcaatattaaatatgtagttttatgatacttggtattaatttgtaattttgggataatgcctttaaatctctagttttgcgatagttttgttaaagtatatagttttataaaatttactctttctaattcctgttcggatttcaattcaaattcagatttacatgttttatatctatattataaggtttagcttataaagtttttttatataaactttctatgacaacttatcatgatgggccagacgcacgtggggtcggccgaaacatattcgtgttcctggccgcgcccgaacattcacacattagatctaccgtcttttttttttttgaaaactaaacatccattaatataaaccgacagagttcacgggaataaatcccagtacattgccaaatagataaagagagagcgtaaaaccatccgtttctaaagaatggaaacctgcactaaggctacaaacttcataatgaaaccacacagcagataaggtgcacatcgatagggagctgcggcaatgccgcgacgaatgcaaccttgggcctccttcggcgtgcagcccgcttgacaaaccggtaatccccatccggttgactccacaaagactgcacaaaacggaggtctgctgctgagccatagattttggagtaagcaacaccggactcagcaagaggtgtccacggagttcgtcgttaaatctgaggagcgtgagctcaacccaaacaacaaaccctgcatggaacaagctgataggaaacatataggaagaaggagcccaaatccagatctccaaacccactgaaaaactcgaatggtggcaaacgaactgctgtcttcttggatcgacgtatggggatggggaagagtaatcctacgaatcttgactgatggaacctaagcattgggagctctcgaactggcaccagtgaaatcgtcgccaccacgccgacgggttgtcatcaagcaccacgagcagcaagctctgggcgacgatagcaccggacgacgcaagccacgagaagtcaccgcagccatcacacgagatggggcgatgacctcccagccactgacgacgaagcagccgacgctgtggccatagatgacgaagcagccaacaccgtggccactgacgacgaaacagccgacgccgtggccactgacgacgaagtagtcgacgccgaggccgcaggcgacgaagaagccgacgccgcggccacaggcgatgaagccgacgccgccgcaagaagccagctccaaccgtcaattcatccacaggtctacggatctcacacctccaccgccaccaaccgccgccgccgcctaccacaccggcgcccatggagctcgctagccaaaagtaccaaatagggacaaaccctaactacaggagagacctaacaacctaaaaacaaacctagaaacacaatactagtagggggaggtggccggacccctcctccaaccttcgccgatggcgagccgccggaatcgaaggggaagaggggccggagaggaagaaatttgggggaagaactgtagagagaggatgggaacgagagaagggtcgcgaagcgccgtggtagcagtctagatctaccgtcataattatccgttcgagcttcgttatctctaaatccagtgtgccatttttctattttaacttattccttcgctgcgatcaaacacataggagggatgggacttgatcaaactcgacaattttgtacgaccgatgaaggtagcatggctcaattgttggctacatcccacggccacacatgtcatatggccctataattgagagagaaccttcatgtccagtagttggccactatttgtccaaggacccaggatagaccaaaagtggctgcctaactgttgggcttttatggccaggcgtatttaatcggttgaatcggtttgtcatgaatatcctagcggaccatgggaaatctccaggtttaataatgattttgaatgttgatgctcagctcatcagtttgtgagttgtgacattgatcccgagtttgatggttaacctgctgaaagcgtgttcttgcttaggctcaatctggaggcacttgacacacggccatggaccgaccttcgcctaaccatgcgcacatctcgcgtaaggcaagtgcgcactgagctcgtctttgtttagtcatggaaaccgcatgccttaatttgttaggagctggggtaatttttttccctgactagcgcgggatggcggtgcgttgcaatgcgaatggaaaagagaaccccatcacacatttaaagcctcaaaagttttagaaaaaattaaggtcacatttatcatcattttgtacctcacttcaatattttttttaagggatataaagtctaccaaacctgtcgatagcaccactatataggtacatgaatgtacatctaaggctgtaacactggtggagaaaccatctttacttccggttgggaaccccgtttagtcccgatttttcaaccgggagtaatgattcgggactaaagatacatctttaatcctggttagtaccaccaaccgggactaaagagaggggatctttagtccaaccgggactaaagagacaatagcgacagtaccagatggtccctttttctatttctttttttctttttattttctcccgaatcaagtaggcaaatccccaaatcaaagtaacatcccaaattcacatcaccaaatccacatcacaaatcataaagttacttatacacacaaatcaaatacatcacaatatcctaagaaattgctcaaatacatcacagatccaaacaatgaatcatgaatttttaacttctcagtcaaatacatctaagtgaatcatcacattttttttttaaaaaaaagaatgccgccgctagccacgaccgccgggcgcggcccagccgcccgccgccgcgcgcggcgccgtcgccaggccgccgggcgcggccccgccggccttcgccccgcctgtagaatcgagatgtcgactagaggggggtgaataggcgatttaaaactaaatgacacctaatcaaaactaacttaagttgctaggcttggtgagggtcaactctaactaagcaactaagttatgttttgcaaacctagggtgatagtggctcaattatatctttagggaagtaagtcacactcctatgtcaatgtttagcaatcctagggtgatatgatctcaagtatgtctctaaaaatgtaaattgcacaaatgtaaatgcgacaatcaaatgagacaaggagacaagagatttttcaccaaggttcggaaattcgccggtttcctactccccgttgaggcgagcccaactccaccgctcaaccacgaagccaccgcacgcccccttcgtcaaggggtgggcaaggcgggagccggcccacggagaggactacccaagcctcgatcactagggtagttcttccttcactccgaaggtggtgaactccaaaccactcgcaaaccggcgccgggcctcctccataatcttctcggagaggtcaccgggcaactcctccacaagccgtctaggaggcggcaacctccaagagtaacaagcaatgacccggcgtgaagatgatcaatcaagtgccacactagctctacaaatggaagcaatgcacttgactcttggctaatcaaccctctaacacactagatggatgaacacaaagctcaagtgggtgtgagagaggtacaaggggtgtatgcaattgaattgggtgccaagagagcccccttgcagctagagggggagtatttatactcccaccaaccaaaactagccattgggggcgaaatcccccaactttgtgctctgccggtctgatcggaggtatgtgggtggtcagaccgtgctactctgcaacggctagaaaactagccgttgtagtgttgtcagagggccccatcggcctggccggtcagaccaaaattgattggccagtcagaccagcctcggctcggtcagaccggcctcggctcggtctgaccgaatacggctccgtcggctctgtatcgaccatcccgagcagcaccatcccggcctccagggggccggtctgatggcgcatgtgccgccggtcagactgctgttgtgaggccggtctgaccgcccctggtcaggctgagcccagtgaaagtaaaggtgattgtgtgtgtgtgatgaaaatgtgagcacaagtgaaaatgcaatgacctaatgtggcaatttaatcatttctttgctaggtcataccccccttgatagtacggcgaaactaacaaagaaactcgcaaatttgatcgcccttcacctcgatcaattttaaaattaaaacactagttttaccgttttcttttcttcgcttcgcgccatcaaattttaatccatcgatagtcatccatgcgcacacatgacgtggacctaacttaaaatatatctcaatagcaatggttagtccataattatcgcttgtcattaattaccaaaattaacaacgggggcctagatgcttcaatctccccctttttggtaattgatgacaaacaccacaaatatatataatcaaacatagaacacatggatatatactgcaaaggaaatcaaaagcttcccctaaacatgtgcataacaatcacaaatagcaaatatggagccaatgcacatttcaatttcacaattcaacatatcacaaacacaagagcaatatctcaatgtgaagttcaagaaatattcatccatgagtataagatggtcacatatatatcaatatcacatacaccatccatcatcgcacaagttcacatcacaaaagtcataaatcatcctaaaagggctcacaaataaacataggctattacaagaccacgagtggtccaaatgacataaagtttataacaaaacgacaaataatacacaatatagagtaatagcacatacccatacaaaatatagcccaaaccaccttaatctattagatatgagggcactatcctcactactactagtcccaatccacaaaaggtaaagcacacttttctcccccttttggcattaagcaccaaaaaggtcttcactcttgtggaggagaaggaggacgcgccgaagtggaaggatgaggagcatcacgacgacgatgatacacaaatgcttgggagctctccaacatttggactcgagaatccaatgtacctactctagtgtgcaatctccccatggaagcattcaagtctccaacatccgtgcgcaagccacgaacatcctcatgcaaagcttcatacccggtagacaagcgttgaatgctttcacttagggtattaatagccccaagtaccgggttgaagtactcgttgggttgcattctaaaataagcatactgtggatggaagaaagtatttggatcatacccaggaggaggaggaggtgctgagcttgagctagctccaggatgagaggagggcgccgccctaggagcatggagagctccaagctgaaggcggggcttgtactgcttgtgcttcttcaaattttgcccaacagccccaagcttgtcttgaatcaacctcgtgatgtaaggggcataatagattccctgagtgaaggtccccttggagatggcaatctcttgcatcatgagagacacaatgtcgaactgacggccctgaatgattgcatcgttgacgtgccaagccaccccctaatgtcatcattgttgccaaggtgagggaggatggtagctctcacaatcctgttaaccacactggggatagtcctcaagccggcaaccttcccatgtgtgtaccgcactccatcttcataaaactgagagagatagtctaaggagagcggattgtgggtgtgctcctcatacaagtcatctccaaagtccaagcgaatattgaggagccgccggaattgcctcctagagatagaacactggagggtatcggacatccacttcatctcactatagtctccagccacccacactgtagcataaaactgccggatcaaatcttcattgtagtcttgcttgagggtcacaatccagtcaatgccaacagtcttgaagagatcctgcaatccctcaagctctgtagtctcattgatgtctctccaagagatccacttatgctctgcaaatgctttccctgcataaacctactcatacacagactactggaaagcggtgtgaaaacggggatccggggtgtcccgaggcctcaaaaactaa

SEQ ID NO: 58627 - DNA, 1197 bp, Oryza sativa
gtggctagggtttgggagaggagagaggagggtttttttttcgagttggggaagaagacggctgaatgggaggagatggagtcgggtaggggaagaagagagaagaaaaaggacaaaagtcctgggcccacctgccggccggtcagaccggccctatgtggccggtcagaccgccgcacctggccggtcagaacgcgcatatagcgccggtcagaccgccaggcccccagcctactgtgcacagcccttgcacagttcggctacccccactcagtaaaaatcaataaaaaatttatttttggagcaattttgaaatatgtgagttgaaatattgccaaccattcataacatttgaaaattatgaagatttgcaacaaaactcgcttgagtgctaggaggtgaccttttatggtctatatgggttttgggcgaatttgattttcaaacaacttttgaaatatttgatttttgaaataggtttgaataccaaaaacattttaaatcttcttctctaccaacattgttttgaaacttttctcaaatttcttctcaatctcattttggggataaatctcattttagccaaaactaagaatctagtttcttcaaaagagagccaaaatggcattttcattcaaaaatcatttttcttgcaatgagaggcttggaaaacatatagggaaccttttaaaatattttccaagagatagttttcaaattacattgattttgcaaaagttttgacttatgttgacttgggcattttgaaaatactactagcacaactagttgatttgctcacatataaagggaagtagagcaaatgcaagagtgcaaaactcccccttaatgtgacatgctccatttttgcaatgaagaaccaaatggcaacaaatccaaagcataagagcaaatgagagcaaatatacataatgcaaaaagaagcaactatggtgcaccatctcaagccacattagagaagtctataacatttaactcattcctcaatttgcaaaagcgggtttcatcaagagacttggtaaagatgtcggctagttgatcctcggttcttatgtggctaatgactatgtcacacttggcaacatggtcttgtaggaagtgatggcgtatgtcaatatgcttggttctagaatgttggaccgggttattggctatctttatgggggctgcaggaat

SEQ ID NO: 58628 - DNA, 718 bp, Oryza sativa
attcctgcagcccgcagaagttttctttgatatgtaggattgttgcaggtggtgcccttaaaatctcatctctgaagcacctcaaattccacagtgactgcgcatgttcatagttaatcagaactcagaagttagcacatgacaaaacatactgcatgcaactttgtactacctgtatgatcacatgcaagataaacatgtctttgtccttgttttctttgttgggaacatcaatacttggcatttcctcagcagattggccaggagttactggatgataagaacacacaatcaccatggatagatcggttggagctctgctttcgttggtttccttgttcccagcgggaggcctaggtagacgatggggaagtcttcaactcggcaagagaggatggattcaaccagaactcgttgttcattgctgcactgaatcggtgtaatagcgctcttgcagaagttggttttgagtcccgttgcctcaccaaaaagagtcagcaatctcttgatagtgttggcttcagtggttgttggcttgaagaacagcaccgcgtcatcggcatacaccgagagcaaatctcttcttgcatttagaggcgaaagcaaaccagccagctttgcccgagaaaccaaagcttgcagagcatccatgactaagataaaaagcaacggcgatagagggtcgccttgtctcagtcctcgagccggtttaattgga

SEQ ID NO: 58629 - DNA, 772 bp, Oryza sativa
gtggatagcaccgaccccttttgcattctgtatgtcaagatggcgcggttgagtaagatcttgtctaagtggggtcagaagaaaatgagtaatttcaggctacaacttcagattgcgaatgaaatcattctccgttttgatgtggcacaggaaattagaattctatctgacttggagcggcagctgcgagctgcgctcaaagggcgctgtttggctcttgcatcacttgaaagaattaggattcggcagcgtgccagggtcagaaaccttcgagagggagacgccagcactgcttacttcttcatgaaaatgaaatcacaccaaaggaaattgaagatactctggctggagcatgatggcgtcattgccaccacgcaggaggatatggaacagatggcgaagacccatttcgaatatgtgatgggggcctcacagggtgatttaaaacaaatccttttccaagaaattcatttggctagggcaaacttatctgagctggatgatgccttcacggaggaagaggtctgggctacaatcaaggccatgcagaatgagaaatcccctggtcctgacggcttcactggcctcttctatcagagatgctgggatgtaataaaaaaagaagtcctagaagctcttcataaattttgcacaggcaactcacaaaatcttgaactcttgaatacggccatcattacccttctcccgaagaaagatgcaccgacacttttgaaggatttcagaccaataagtcttattcacagctttgcta

SEQ ID NO: 58630 - DNA, 7531 bp, Oryza sativa
caagacaagaaacaaacgagtaatgttcacaaatcgaagcgacacgagatcgagtttgaacacccttactaatgtcacccaacacttagtcaattgggtgatccttggaaagaacggtgtgtatccttggtggcataggtggattttgtgccttctcctcctccacttcaacttgagcttgacttggcgtagcggaagtagatggctcatcttgagtggaggtggatggcttgtcttctacttcaataggcttgacatctccaattgacatgttcttcatagctctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaatttggttagtctaacaccctttcgataaatataacacttgcaaccaaaaactcgaaaataggcaacatttggcttcctcccaacaattagctcataggaagtctttttcaagagacgatgcaaataaagcctattgattgcatggcaagcggtatttatggcttccgcccaaaagaaatcggaaacaccatattcatcaagcatagtccttgccatctcaatcaatgtacgatttttcctctccactacaccattttgttgaggtgagtaggtagcggaaagttcgtgtttaataccaagatcatcacaatagtcctcgatattggtattcttaaactcggaaccattgtcacttctaattttcacaagagtgcaactaaattcattttgggccttttttgcaaactttttgaaaagctcggcaacaatagacttatcatgcaaaaagaacacccaagtatagcgagaataatcatcaacaatcacaagacaatgactatttccaccaatgctcttataggttgttgggccaaacaaatccatatgcaagagctccaatggtctagatgtggacatgatacttttagtaggatgagaacatgcaacttgcttgccggcttgacaagcactacaaagcttatctttctcaaacttcacatctttcaagcccacaactagatcacattttgaaagtttgctcaattgattcatgccaacatgggctagcctcctatgccaaagccatcccaatgaagtttttgcaactaaacaatttttcaaatttgcttcactagaattgaaatcaaccaaataaagatttccatatctaaaacctttgaacacacaagacttgtcaagaaggctagaaacaataacttcttgtggcaagaaagcacatgacaagccaagatcacaaatttgagcaaccgaaagcaaattgaaacttagagatttaacaaaagagacattatcaattgacaaatcattggagatagcaattttacctaacccaattacctttcctttgctattgtcttcaaaagtcactttctcttgttcattccctcctacttcaaatgtggtgaacatagccctatcaccggtcatgtgttaagtgcatccactatcaagcatccaatggctctgtcacgcctagaaattcccgaatagaattccaagcagaatgtgcattaaaacccccgtccaggaccggccagggtacacaaacgacaaagttgacatacagatccacgtcttacaaatatcataaaagtcttacataaatgcagcggaaaattaaatgataactggagctaagccttgacttggactgcagcgggaacaccactccacatgcatcattgacggcacggacgaagcctactcttcggagaagccaccatctgacacgtactcaaactctggggtttgggagaaaatagagcaagactgagtactacccactgtactcagcaaatcataccggaataggggtatgatgcaggatataaccaaaggataggtagagcggttcatttgcataaagcgagcatttaaaaacagtagttgaaagcagtaaaacagttgtagtaactaatcaatattaatcatccactgtccaacgctacaccacgttgcgacaagcccaaccatccacctgaactaaccaattccattagactagactagggtgagactaatcacagtgaatctggttgatcgcccataaccgcgggcacgactattcgaatagttttactctgatcagaggtgtacaattgtacccacaacacacagccccacgacacgttaccgtgcgccgacatgccaccacgacataccggaaagaggccgtgacaggatctttcgcataaccccctctagccaagcacaccacacctcaggtttcacccccgtccgcagcgggcaacgggcagtcccctctcgtgcctaggtgaatctggaagcgacagaggccgtcgcagggcccgccccgctccatcacgcccacccttgcctggatgcgtcaactagaggaaagctacactacaagcccagccgttgcccacgctggcttgtggtaagtacgataagttcttccagggcatcccgcgaaccgatccttaagtgctatgggcgcgaccatcaaaaccatgcacccacagcccaccatttaatgcattttaattgactaacaccaggacggaggctttaatccaacaccaacactagaacctgaagtctatgcattaatgtgattcccccattgtgtgctagttgaactaagcatggctaagcaatccctagtccaatatctagtcatgttatatcccaagctaacaaaggagcatggtacaaaaatagcatggctgtacagtaggtatacatcccatagtaacattataaaacaatacagtatttaagggaaaacgatagaacatttgtaatatgggatcaacatgttcaagtgacaagcatgacttgccttgctctgctgctggtggaacctcggcgactatttcaaagtacaccggagcgtcgggagagccggaatctaatcaacatacaaagcaaacaatacaaacatgccataagactactgaaacagagaacaaaaccatttttaatggattctatgcatttttcttgatttactgagacttgcatgggtttaaacgaagctcggatgaattttctatgaattttagaagattcactgtgtttttactataaactgaaaaatccttaattgatttattgcgtaataaataaaatcctggggagagagaggggcggcgccgacatgcgggccccacatggcagtgactcgggtggcgatccgcggtggaccgggtccacagaccggggagggagcggcgcaccacgtggtgctgacgtggcgccgaagtggcgtacacgtggcagccacgcggcagccacgcgggcagccgaaccgacggcggcggggagcgcgcggccggcgcgcacaggcggctcaagctggcctggcagccatggcgtacagcggcgctaccgcgaggcggcggcggcagacggcggcgacccacggagagcggtggcgacgcgacgagcggcggcggcgcgatgcgacgactaggcagtggtgctaccagaggaaaagagagggggaagatggagggggtgtcctcatcgaagaggtccgaccggcgtggagggagacgacggtgaacggtggtgagactctacggagggaagtcgacaagcgacggacggggtccgggacgacctaagaaacaaaatgggagaagttagaggggaagagaaagatcaccgagggcaggaacgccggccaaaggcggcggccatggccgaacacaccggcgcacggtgcggagtgggtttcggcggcggaatccgacgggaggggagtggacggggtggcccgcacgacggcgaacgtgacggcgtcgacggcgcgactcggcgcagcggctagcgacggctagcggcggccggaacggtggcggcggcggtggaaagaagggcaacgacgctagggcggtagagtgcatgggagcgggcgattgcaaaacgaaaaagagagagggggaaacgggggtgctttatatcggctcacgagggtcgatcgtggccagggtggtcgcgatttcgccggcggagtggagagaggtggggaggagagagaggtgagattcaaaaattgaatcccggccgtctcgagcgcgggcgcgggcggaagagagagggagtgggcgcgggcggcgtcgtgggtgacgtggcccgggagacgcgggagcgagtggggcggcggttgcgggatacggcggcgccggttggaggtgggagacgggcccgacaagtgggccccacctgtcggcgacccgaagggaggagggaggcggccggctcggctgggccgtggccttcggccggcccaacggggagggggagaggaagagaatgggccggcggcccattcgaaaaagaaaaaggagggaaaagaaaagaaaaggaaggaaatgaatttcctaggattaaatattgcttgtgctcgattttaattggttaaaattatttctagagctctgaaaattccactaaaaatcttgttagcacatttcgacatgtagatctcaagaaaaattccacatgccaattccgactattattcgcattaatttatttagggtttctctcttgcttttacaccgatattttcttgaggccaattaaatattcaatttaggcttgggaaaagaacttcagggtgtgacaggctcccaccggtgcggtagttcacctacaaaagaagatcaagctcttttaggtaccaaacttgtttgggtctttggagattagagactaaagctttgggcacccaaatggcattctttttaccaccgagtataggggaatccacatatctagcaacaatgctaccatcataagccttcctaagcatataatgggaatcaaacatgcatgtcttagggggcttactaccggggcaatcattcaccaaatgcccaacctcacgacacttggagcaatacttaccattgctcttgacaaaacgagtggcacggtgagaaggtttcttacccttctttggaatgaatccaagtctctccttgttaaggatgcaccgttgctcactcaaaatcttgttaagagtgttcttacccttgaagcacctctccaaactcttgttgagcttagccacttgctccttaagcttattgttctcaacaacaagtgaggcatcacaaatagaaacacaagggctagagccagagctaggcatatccacaagatcattaaaagaggtagaaatgctagatgatgcaacatgagcaatatggcaagtagcactatcatcaagcaaatcacaagatatgccaacatcaatgagagctctatgttaagtagtggaaaggaggttgtcatgagcttccttaagcttctcatgagaaatggtgagtctctcatgagaagtctttagctcctcatacaagacctccaaagaagcatgatccttctttagatccttgaacttgacaatctccttctcactataagcatagagctcctcaaacatactcacaagctcatcataggaaacatcatcacaatcatcatcactcccaccatcactaagagatattaccttagaggagccctttgccatgagacaaagtggagcaaagagtgatggagcctccttgatggcaacaacggccatcttcttcttcttggagcttgcatcatcaccaccttcttcctcggacccggatgaggtggagctctcctcatttgagtctcattccccgatgaaggcctcaatcttcttgccttccttcttgagcttcttcctgagcttgtagcctccacttttcttcttggatgacttgtcttcatcatcatccttggaagtgcacttggaagcaaagtgtcctttctcaccacactcaaagcacctcaagttggagagagtcttcttgggtcttctatttcttctcctattggagttagagcctcttcctctctcctttctccttcccaagagatcattgaaccttctagcaagaagggcaatctcttcctccaagtcctcattggcttcatttaccttgcccttgcccttgtcttcaacttcggcttggagagcaatgcacttcttggaaggtgaggcttccttcatctcctccttcttcaacttgtacatgtcattggtgttgatcttccccaagaggcttgcgagtgtcatccttgacatgtcggagttgatgagcatggtgacaagggtctcatacttctccggtagaggtctaagcatcttttgggcaacctcaagatcgatgtagtttgccccaagccccttgagatcattcacaatgacattgagcctcccatacatgtcatttacactctcatgaggcaacatggagaatgtctcatattggatctttaggaaatgaagcttggcatccttgtactcgcttgtgccctcatggatctccgccaacttgttccaaatctcatatgcggtcttaaggttgctcactctatcgaactcctcttggctcaaagagttgaacaaagcattcatagcttgggcattgagttggaggttgtggtgatcaatctccgtcaagggcgtgtcggtgatagtaaagcctacatccacaatactccaaatatggaaactcatagctttgaggtgagtagacattttaattttccaagtggagtagtttgtgccattaaacatgggagccttccctacatggttcacctcgttcgacatcttctctctaggcggtaaagcccaatcaagagagaccaagctctgataccacttgtaggatcgagatgtcgactagaggggggtgaataggcgatttaaaactaaatgacacctaatcaaaactaacctaagttactaggcttggtgagggtcaactctaactaagaaactaagttatgttttgcaaacctagggtgatagtagctcaattatatctttagggatgtaagtcacactcctatgtcaatgtttagcaatcctagggtgatatgatctcaagtatgtctctagaaatgtaaattgcacaaatgtaaatgcgacaatcaaatgagacaaggagacaagagatttttcactgaggttcagaaactcgccggtttcctactccccgtcgaggcgagcccaactccacctctcaaccacgaagccactgcacgcccccttcgtcaaggggtgggcaaggcgggagccggcccacggagaggactacccaagcctcgatcactaggatagttcttccttcactccgaaggtggtgaactccaaaccactcacaaaccggcgccgagcctcctccacaatcttctcggagaagtcaccgggcaactcctccacaagccgtctaggaggcggctaacaagcaatgacccggcgtggagatgatcaatcaagtgccacactagctctacaaatggaagcaatgcacttgactcttggctaatcaacactcttaacacactaggggctgcaggaat

SEQ ID NO: 58631 - DNA, 7673 bp, Oryza sativa
cctgcagcccccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgaggggggggtcgggtgtcaggtttcgggctcgggctaaccacgcacctccctcgggtgtgcagggttagccgggggctaccacacatgcacaaccttacttttcttatttcagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggcctcgtcgccaccgtcgtcctcgccgctggcgtcgccctcctcgtcggagctgggggcgaacgcgagccgaggggccgacccctcgaagctttggacgatgtggttggcggcatcccggacccacgcgcgcgcatcgtcctcggtcccgggagggaactcctccagcgccatccatggggagaagccggggtccctgacctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtctagggcgcgctgcatgtccgcgacgttgtgttcggcagctgcgaggcgggcgactaagtcgctttcgcccgtagccgccccgccgctgcgcttcctcgcatccagctccttttctcgcgcctcgaggttagcagcctgctgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcttcctccacctctcgggcgatctccgccagtgccgccttgcgggcttcaagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctgaatccatctagcacctcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccttgtcgcaagccgccccggaggttgtcgcctgagcgtcgcccgagggagcgggcccaggcgatgcgcccgcggccttgtcgcaagccgccccggaggttgtcgcctgagcgtcacccgagggagtgggcccgagcgacgcgccggcggtcttgtcgtaaaccgcctcggaagacgccatcgcctccgcctggcgagcccgggcggtttcctcccgggtgacttcttcagcttggcgagcccgggcggcctcctcccgagcggtatcctccgcctgccgaacccgagcggcctcccgggcggcctcttcagcttcccgaaggcgatctgcggcctctcgccggtcagattctcgcctccgttcctctgcggccgccggatcttcggcctcggattgaccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccgacggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcgatcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaagtagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctgaagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaattccattcgcccgcttgcggcgcataaggtagatatgcggttgtggcagtcgagatagatcgtatcgtgtgtgcgttaattacgctcgctgaccgaagtgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggtggctcctgccccgaccctgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgggagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagagagagcttgagatctcaccctaagcccccggccgaactggcaaaggggggcctgcgcggtctcccggtgaggagccccgagctccgtcaaaccgggactaaagatcaaaatttttataacctggactaaaaacaatctttagtcccggttctttttgatccgggactattgtgaattttgccggaccgatcaaagatggtttcttcaccagtgtaacatactcagggtttgtcttttttttttttacggagagagtacgctaaaaagataaaaatcaaggataaagcgctgatatgactagctttatattgaaagcatacatgtatgtgtaaacagtggtgaacatcggctttcaaaatccagtgagtgaagtcaagtgtccactcatatgcttcccccgcagggaacacgatcttaattgcaaccatttgctgagctactaagagcagtacaatagcaggttattagccagctataaacctattttaatgagataaaatatgagagagaagagcagcgggctacagatctgtagccagctgcagcgcggactccaagacgctatgtgtgtatgacaggtgtgaccatatattaatagtatagtaagtaattattgtataaattagctattagattggctataaataaattggagctagtagtgaactatactattaaacttgctctaatacacggatagctcaagttatttgtagtttttatattttaaggcttaactccaagcacgtattcgtatactgacatctggtttgaagttaactggctaactgcctcttttcttctgtcacttctcgtttctacgatggaaaactctgcctacagatatgcatgcatttcgtccaggcacatctttatcctctcatcttttgctattattccaaatgatcaaaagccctggagctattattggtgaagtgaatcctccgatggttacaccacggaatggattggccgctcactcaaccagccacgccacctgaccacctgttacgttgcaccagctgtaaccggtgaagaaaaggtaaattttggccaaaagcgacgccagtagaatttacaccgttccgtggataaacaaaggcatctgatttcgcaaccgaagacagaaaacgaatcgctatcagcacgggagccacacgccatggcgatgctgcacgttgccgtcactctcgctcccagtcaaccgagccgcgacgatagcgtttttcccgcgagggcacgaggcgggggccgcgttgctcgccacttcgtccggctaaattcggagccgagaattagccgggcgaagcgggtgggcgggccagaaaaaacgaagaattccggccgcgtttctggcagcccgcacgaccagcagatggcggtcggtgtcctcgtcgtcgtcgtcgtgatcgcgcgcctgcccggtggtgccgtggtggctggtcgtttcccagcgacgtacgggttcagcgaacgtgttttgccgcccaggccagatgcgttgcgtcctgccttggtaggggtcctaggggagtaggactcgtcggccaaaagcttgacgcccatgactcgtcaactccacgctcttcgcctgtttctggtatggaagcagatcaagctagtcagtagggcggtcgagacggtgccgatgatcttcattatggtcttttcttatggttgagcagcttcaattcccacgagctggtactagtagttcatttgcacacgatgctatggtcgagtcgagtatggctttggtctaaaacgctttctttgccatgtgtggttggaatttccacccctaaattagcttggtttggcgacttgatctaaaaccacgtcacgtcgcgaggaccgaaaggacacacatggctctgtccccatccacaacgcttggctaggaacacccacgatccggacaaggaccattatcgcctgacataatctgggctgcaggaat

SEQ ID NO: 58632 - DNA, 1884 bp, Oryza sativa
agaagccaagggagagaaagaaaataaaatagcagaagaaaatgagagcaaagacagccgcatctgtgcagcagcgcggcgacgtcgtggagagcgacatgcgagcacgagaaaagccggcggtcgtctggcccgtccgtcgtggtggtcagtcaggcaggcagtcgcgcacacacgccgacgaacggcgtggctcctgttcccggacgcgccgctgcagcgatgcgcgcccgagttattttcgttttatctgtctcaccgctgcgtctacgtgttgggtttagcgcgcgacgtgtcacgctggccggttcccgcacgggacacgcacttggcgcgtagccgattcaagcccgacgcgtgtcctcgtttcgggaacttgcaggcacgttgtcacgtactactataggttttcccggtctagcagcccagtttttctacggcctcgaccttttttatgcgagaatgtctttgctttgttcagaaatggcaacggaaattgttcccccgcttttgcttttgtccggaggatgagttccgtgggaaatggatgtttaatactttaaccccgttattagccgctagtttttggagccgtttttatcttttcctgtgatccgttgttggcatctgatgaactgctggagaaaaaccttttcaatgcaagttgaaaaggagcctttcagatcaagaagaaccgcagatagccacctgtcctctgccgctgtctctgccacttcgattggataaaccaacagtcagaagtttattgacagctgttaccgtcggccccacatgtcagcggccacgaaccagccgagatgaggataagatcagacataacggggcatccttggaacagaatccgggaaagccatgtgggagtggccactggcctggccagcaccgcctttaaggcgtgcgggggccacgtaagtgggaccacctttgtcagtgtcacatgcgcaacctcccggtccgtgtgccatgttaggtaaccgcgcgccacgctcgccggcaaacgtgacgcgaggcggatcgtccgttcgcgcaatcgcgcacgcgcgcaccgttgcctccgctctttctttctttttttttttgcggcaaattccgcatgctacgttgcgttttttgttggtcaaacggacgcgcgccgtgccggtgccgcgttcgaaagcgagcgggttgttgggtgcgcggcgcgttattccgttcctcccgtatataacacgcgccacccccgcaccaccgccgctgcaaaggccagcgcccagcgagagacagccaccgccaccggagcagctgcgttttcagctacttttccgtgccgttttctgttggggggatcgcgttcgccgacgagatgagcagcagcaggctcggcgggggagatcgggcggggatgtacgaggagggggaggacgacgagctgttcggggagtcgtcgtcggtgtccggcggcgagtcggacgacgatggggaaggggaggaccagttctcggagggcggcgcggcggcggcggcggcgttggaccagatggagcaccgccggttcgcgccgcagccgctgcggcggttgaactcggacagcatctacgacatgtcgtccatgacggagcagctcccagccaagtgagtacccgtcgagaaaccctcgattccatccagaaatctcaactcttctgtcctgtgtgctcaccgtccaagaacaccgtgttaatctgcaggaaagggttgtccaggtactacgaggggaagtcccagtcgttcgcgtgcatgtcggaggtgaggtgcctggaggatctgcgcaagaaggagaagccatacaagtcgaagatcaagtcgtgcaacagctacgccgcgctgggagggatcgccaagacg

SEQ ID NO: 58633 - DNA, 2701 bp, Oryza sativa
cacttccactgatacagtgtcactgctagcatcggcataagtttcgtatccctcgagatcttcctctgttactacgactgcatcgatggacctgctggggcttgaaggcttggctagcataccttcccataacggcaaaacaaaatgctcgttgtcgaattcggtggtgaacccatcaacttcagcctccacaatagcttcacttgattgttcactgaatcttactgggtgggtgcggtttgaactctgaatttgatggcagctggaagcgaggcactaaatggttcactcgattcttcacaagattttgccgagtgagtttggtttgagttctcgattgaaaggcatctggtgttgagattgctaaataatttaacagcctgtagcaaagaagaaacgaacaagaaaatttatcagaaacttcagggatctaattatatggaccagagcagtgtttatcaattcgtcattcaactagcacacgaaagcataagagattaagtgggttgcatgcctgccattgagatggtgctaaaagtactctgggccttacagaccgtgcatgatctaaagcagcttcaggagtcatgttcctgtacttaatctgcaagttacaccaaagataagatgccatatatgaaacaaataaaaataatgcatacaataaacatcacatgattaatgcagtttctcataccaaatagcataaaactatagtggtgcttcgtccccttccagccttacaatgtacataagtgctaccaccttgtgatgcatttcctggagaagaaaaaaaaaacatatgcataaatccaatttctagtgtaactcagagttgttgttcaaatgatggttacaattctgtccaatcaaacgaatttactttgggggcttatcatcagacatcaatatgcaagacaacagaaatgtcaaaggattttattactcgaataaagaatggttgcgaaagtcaaaaggaaaagtattgctcaaataaaatcaaatacttgagaatgattgcgacacattgacatgatttaataagatatctttcctgctcataaaaatgatttgaatactaccaaagttcaactgcagtgcccaccttaattcacttaatcatcatcaaagcaaactggtgctgataatatggtttagaacgcatggtggatggtacttacggtgaataaaatcgacagcttgacagatatcctctagagaaggggcaaatagatagtccctcgtgggaatctcgagatgattgatcccgtgagcctgataaagagaggaaaaaacttcttattgttcagaacaaaatttgatacaagcctgcttatgccaagtgtcatgccgtgatgccgattacaccatgtatattgagttaaagaaaggatatagaaaatggccacagcttgtttgccctgatattttgaatgtacatatagaatatgaatggtaaagatgcacgagacaagtggatcctggtgtatgaactatatatattgaacttcaagtatggggcttaactgttcacagatgaaaacaagaacagtagataaaaatatgcacgcacaaagatcttgatacatgccaagaaaatctgcagctacaaaatcaggtgaaggtatttatttacctggtataaggatgttggaaccagagtttcatacgattcattcagtgtgacaacgccccttactccaagttgcttgagatgcggtacatcactagagaaagggacagcacctagcaaaacatactggagatgggaggtgggaagaaaatcagtacacaccatccaatgaacagaagatcaccatattgtttgatgaactgttcaaattatcagatactagtttaaaactgcatgcatcgtgcatggatggtagacagagctaccaatgaaagtgtgaaatataaattggaaaggattcctatatgtgatcagtagctgggcaaattactcatattggtcataccatagctctagacctcaataggatcactaatcaaaatccctataaccatccttcaagagtaatcacaagcgtaagtgatacaaacataacacatgcgaatctacatgatattggtacaattcagaatgttgatttgctcgaaagtgtagtattggacccaaaaaatcagccgcaggccacatactgtgaatttacaacctgcttatcaagcattggagggtaacaaagcaagcacaatgaatcaactctgctcaaggacctggaactatgcctacactgatcgtccccaatatccatgagtgaaattaaagcaccaaatcgctccagaacgacaaggtgcagtatattgggagagagatgagggtaagattaacacacctggtcgatgcgatcccaccaccggaactcagactcgaaccggttgcggaggacgttgtagagcagcgtcgggtagaacagcaccctcgcgccggcgccgacgagcgcgcgcttcgccctcagccgcacgacggcgaccacctcgcccccgcctccgcccccgcccccgcccctcgcctcctcccgctcgtcctcctccgcctcctccgatcccccggcgccatcccgcagctcccgtatcctcatggccgcaacaatcgggagcgcaccaaaccctagaagccgactcgcctcgtggaattctcctcctgcaccgctggattttggggattttgggttggaat

SEQ ID NO: 58634 - DNA, 1930 bp, Oryza sativa
attatgcaactctatttgcatactacaccttcttttttctgtgggggagcatattggtccttttgactgttacattgggcttcattgccaaaaaagaaaaaaaaaagcaactgatcatttttggtaaagtcaaaaattggcaatgctaaaagtttgtaaaattttggcaacataaagatatgaaagtgatgtttaatttgatgccttaccaaaatttagtatagtttttatgagtagaagttcctagaattaccaaatgttggtagggattgaaaaggttacatggtaaagtcttgtttattttgttgtcttaccaaactttgataataccaaactttggtatggttgattttagtaataaattgaataagcccataattccatgcggaattgctattatatactattcttaattgttgctctctactgttaaagaaagttcactgcactagattttaaaacactgttttattggatggaacatttagttaagggtatttgtggagctacaacaatgtaattaattaatttcagtttgttattcacggaagattcatccaactaccataattcgtggaaaaaaaacaaatttcataacataaatgaataaatggtatactacggtaccttttccgtttcgatttaccatatggtattatttacgcgtcttgtttattgtccgattttgttatacacattttgttatgaaccacaccaagacaagtttgtggagtccaagttgtgccttaattagccctcaccaggtctatgaatattacattataatttagacatgtttagattcgtactatttatttgccatatcaaatataaataattatggggagagttatttcgagccatagatttaccattaagctcttatattgttcttttgacacaataagctattatattgtttatacccacacttcatcaatccattggctatcttttttatcgtgggtgcatcaaaatgttttactatagttccctagattttgtggtgtgccaaaccaacatgtataaaaatgtaagaatatacatgaagagcaaccaaatttgaaccaagaacttcacaatccagtactaagatatagccatatactttgacacgaaggtttaaaagtaataagagcgtagccgtcatagcgtatcacataaactaattgaaaatatgtcacattcaaatatttcaaaacatccttttcaatacgaacgatgaaatcaagctttgattactctaaaaaaaccatgtagcttgttagacttcctcacccggacttagtagatagatcgctcataagcctggttggccaaattctttctattgtcatcgtgtatacggaatcgacaaccactcccttagaaaaatcgtccatgagaccaatgacatggtgtcatggaagaaatctgccaaaggaagagcagtaaaacgagcatgttcaggagggcagaattgcaaaactgcctaatcactttcccccatcgccggtcaccgcctctgctttctttttggttcggaacacgtcacgttgacggcgaccgggccagcctaattacccaacccatcgctttcgccccgtagcttccacagatcggccagatgccaaaacccacgcagcatattcccatcgtgcaacgcctgtgcgctcacagccgtcagatcaaagatcggacgggacggggcgctccgtgccgactcggaaaccgcttcacgctctggcctgggccccgcccccgcgttcggaacatgggctgaacgaaatattattctggcccatttgatccccacggctcgcaccatgtgggccgagcccgagattgcagtcaattacggcccacgaagaggcggatgcgagtcgtcttcatctcgtccgacgcttcaacccgcaccgatcctgcgccaccccttcgccggcggcttctc

SEQ ID NO: 58635 - DNA, 702 bp, Oryza sativa
cctgcagcccccatagttatgcatgtcaacaagttgggttggcgatgttttaccctccatataggtctttgacccttcatctagcaagctgaaaaacgacccaactctaacaactaatttcaactcattgtgatttgtcctacaaatcatagcaacaaaaatatacatttagctaattgttgcatgttacctgtcgatgatatgggcccgggggtatcaggtttagagggaggaggccgccccccgataccacgtggccctcccccgaggggagtcaggcccaaggtggggtggcggccactccttcctcaaagactagtcggaggaggctgccccccgattccacgtggccactccttccccaaagactagtcggaggaggctgcccccccgatgccacgtggccctcccccgaggggagtcaggcccgaggtagggtggcggccactccttcccagagactggatggaggaggctgccctccaatgccacgtggccctcccccgaggggggtcgggcccgaggtagggcggcggccactccctggccgagactagagggagaaggccgccccaggtgccacgtggctccccccagaggggggatcgggcccgagttcgggcggcgaccgccccctcccgtgactagggttcgggctcccccgaccccctctctaggtcaccacgtacagtgggttaggtg

SEQ ID NO: 58636 - DNA, 730 bp, Oryza sativa
attgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacaggcgggtgacgtaggagcgcgccaacagcctgaagcgcgccctgaggcgtgctgccgtcgccgtagacgaggaggcgacgctccccatctcgccgttctcctgcaccacccgcgactggcgatgctgcggatttttcgactctctcgagcgcctccccccgcttgggactttggcgcggaggaggtgggggagtacgagctcgatggcgcgggtttggctccccgtcgtcgccgctcacactcggagagaggtcgtgcgcctttgcttgctcggccattaggctgaacaagggaaacttggcccacacggaagagtatgagagctcagaaaacacacgctgagccccctacctggcgcgccagatgacggagctcggggctcctcaccgggagaccgcgcaggcccccctttgccagttcggccgggggcttagggtgagatctcaagctctctctgtgtgtggaaagatcgcgtgccaggaagaaacgcgagacacggacgatgtatacaggttcgggccgctgggaagcgtaataccctactcct

SEQ ID NO: 58637 - DNA, 1365 bp, Oryza sativa
cctgcagcccagtgttgaaggtatgttatttgttcaaattgcaagatatggcccttctcctcctctgccttctctgctgtgtgatttattttgttcccatgcttgtcaggaatcatcagttatacattctattggcaatcttggaattcatggtcaaggcatcctgaatttatctggagatggagatacgattcaggcgcaacgtcttattttatcacttttctacaacatagtggtaaaataagttcattttggtttgtttattcacaatcagttatgagtctgaattgctttatttctttctgcataccttttgtggcttaggcacatttttatggattcggattgttttcagagttggaatgatgaatatgcctttgatattgccttaaatttgacatgttatgaggccatcgtgtgacatcagtagtttgcgtgatctatctgtagtgttctccattctgttatttacttattcatatctcatctaactcgatacactaaatttaatgttctaaacttatctttgagatgaattatgctgctgttcatgatatacaagatcaatattttctcgaagcccttaagatatagagtgttgttcattatatacaagatcagtattttgtccaactgttaggtatagagtgcagcccttgatgcatttcctttctcttttaccttgcatatcgtacgctggtataaccctgttgcaaccttgttgtttttgattttttacagttcaatcatttcattgtttctattagatgcttctgatccttcgtgatcattcagactactctaattgataagtaattccattttaggttggacctggagctgttctacaaggcccacttgtaaatggaagtagtgatgatgtgtaaatactaccaccttcagtttttgtgttgcttttatttttgctattccaccatgaagtttaaaacggtttctgagcttttgtctctacactagggccccaaagctgaactgtgaagatgagagttgtcctatggaaatctttcatcctcctgaggattgcaacctgaacacttcattgtcttttaccctacaggtgcacactttaatttcccaaggctttccgtgcagggggtatctatatatattctttatcttagattttgccttttcatttaacatgtaacaaatggttagcttttgacacgcagatatgccgtgttgaagacattgttgtttctggccttgtgcaaggaactgttattaatttcaacagagcaagaaatgtcactgtgagatcatctgggaccattagtgcaacaggattaggtaactttttcttctttgccataaatgctattaagattctgttcagcattgtgg

SEQ ID NO: 58638 - DNA, 2138 bp, Oryza sativa
ctttctacagtggcagtcatgcagggggtggaactgcatatggtagtgctgatttaccatgtgaacttggcagtggtagtggtaatgtaagtacatcatcttcaacagctggtggtggtataataggtaacagagatcgagcatatggatctttgtcaattatcatcctctattcagtcactgttactcttagtagtactggtttttactgcctttcatctgcacatttccagtaatgggttctttggagcaatctcttccactactctcccttgctggttcaatagaggcgaatggtggcagttttgctggtgcggtgactcatgctgcaaatgaaggacctggtggtggttccgggggcacaattcttctatttgtgagggcattgtccttggaggagggctctgtactttctagcgctggtggggttggaagtaatggtagtggcggaggtggaggtggccggattcacttccactggtctgacattcccactggagatgattatattccctttgcaacagttaatggatcaatacttgcaaggtgcatcttaattctgatgttttctctgtttgttctatttttttccttctgttttactagctagatctgttcatgatgctaaagtgctgctacatctgcattcttatatttaaagttctaagtttatgatgctttttgctggtggatgtccttacatttccttaatcgtagttctggaatatttcaaggagtaatagttagtagagcaggttaagcaaactaggagcaacccccattcctcaccttcccattttccagagccttgattctgtgtggtgtgggcagccatgtacagtaagattggtaaacagtatgctgactcttcctttttgaccaaaaaaatactgcctattatttgttgtgcagaggaggaaccgttgatggccaaggttttccgggtgaaaatggaacagtgacaggaaaagattgcccaaaaggtctttatggcacattttgcaaggtaacttgtagcaaaagtgtgtttgctatttcgaattattgatatatttgtagcttattgtttctttgtttaaatcagataacatgtcttcttatcaacatagccgcatgtcatagttgcacttcaattttttcagtccaacctgccatactacttattttctcactttgctgcaacggtttttatggcacgatgcaggcctgtcctttaggaacatataagaacattactgggtctttgaagtccttgtgttctccatgccctacaaatgagctccctcatcgtgctgtctacataagcatccgaggtcatttctattgtttctttttgtatgcgtctcaagtgcagatcaaataaatttagtgacagaattatggcgtctaatctgcaaatacatatgtcgttgggtctatggttttaaattttctaaagaattataggctgtcaatggtcctatatctaatgggattatttgcaataaatctgtggacacgaggtatgcataccacaaagttccatgcggcctagctgctagaagtgccttgcttttaactgattgtcttgtgtaaactaatggctagacggaattgttgctgtatataattattgttgtttactattttaatgagagtatgaagttctgttctctcatgttttagcattttcaaactcttcaacttttgttagctttacatgtgatatatgaaatgtttcggccagtttaccttaatgttctaaccttagatattgtttttgacaggaggtgttactgaaaccccgtgcccatacaaatgtgtgtccgatagataccgcatgcctcactgttttactgctcttgaagagttaatatacacttttggtggaccttggttgtttggtctgtttctctcaggccttctttttttattagcccttgttttgagtatcgctcggatgaagtttgttggcactgatgagttgcctggaccagcaccaactcaacatagctcccaaattgatcactcttttcccttcctcgaatcactcaatgaggtagcagaacattctgcattcctaatttgtttctttaagctgtggtgtgattgttctggtttttcgttgaaatctctcctcatgtggtaggtactggaaa

SEQ ID NO: 58639 - DNA, 849 bp, Oryza sativa
cattatctgcaactgtaccagtacaagaaccagaactgcacttgtattatgaatttttatacaattatcagtctcatcacatcatggattgaggtatgctttctggttttccatttgataggttgctgctacaccagatttaatgctgggttatttagatttctttcttggtggggatgaaaaaaggcctgacctcccccctcgtcttcatcaaaggttgccaatgtcattaatctttggaggcgatggaagttacatggctccattttcacttcacagtgacagtgtggtcacaagtcttattagtcaggtttattctgaaacatttcaagctgtactggatcactaagtgaacaattcattttattagcatataacatgaacatatttttacagggtgtaccttcatcaatatggcaccgccttgttgctggattgaacgcccagttgcgtttggctcgtcgtggaaatctaaaagccacatttcttcctgtactcaaatggcttgaaactcatgcaaatcctgctttgaacacataccgcgtgcgtgttgaccttgcatggttccaagctacagcactaggttactatcaatttggtctagttattcattctgtgggaccattcagtagtggccttcaaggtggctctagaatgaaatttgattatcatgcgcagtgagtcatttgctttagctctgcacattttgcacttatcatattaaaatttatcccactgatccgtaccatgctgtgcagatttcagaacacagatgttgattctcaactagaccactcaaggaacaatgatgctgttatgcttaaaagaataactggcgggccgcaggaa

SEQ ID NO: 58640 - DNA, 743 bp, Oryza sativa
ctgcagccccggctagtcccctacggtgtctccggatactgtcaggagagacgaaagcgctatctttgatctcgccgggcacgaactcgaggaggaagactaccctgttatcgactacgagtcagaccttcagaccgccatgtcgacaacagttagataggctaccccacgtattgtacttgtgtgatctagatgaataaagaacaacaacggcttcggccaacaggatgtagggttattacctgacaattcaggggcccgaacctgtaaaaaatccccgtctccatctcttttacctcagtctcgcgtataccctactaccaatgatccccataccatgcaaataccggaattgcgacatcaaacgtcgacagcgagtatattattatatgtgcagagtatattatatagttatttggtcgtatatagttatttggtcgtatatttggtctatatagttatttggtcgtatattattatatgtgcagagtattaattaggaatattttttttgacagctattaattaggaatattacccatactagctacttgcagcttgggacacatgctcttccctggagcaggcagctagagcaaatcatttcggcctagcccaagaaataatggcccgcttggcccgcatgtgttccggcccaacttgcatcggcttcagttgctccttcatttttcttgctgatctcagttattgggagcactaaaacactgattatagtagtattt

SEQ ID NO: 58641 - DNA, 1696 bp, Oryza sativa
ttcctgcagcccagtaaatacacactacatcatttttttcgaaaatttatatcccaataggttctattaatatcatagtatttataagattttatttgatttttttatcaatttaaatttgaatttggatgaaactccctgaaatcttagacggtttatacttccgagcctcgtcggaacatcgaattttacgaaatccgtccgtcgaaatcgtaaatcctgatgtcatgtttatatgtattattttttagacacaataaaaacaaattatatgatgaaaatcctaatggaaccaacacttgtgttggcgagataattaaggtcgtggcgacatgattgacggctaacacttgggaatcctcggaatgtggatttgacgtggcttgcattggtgtatggagatcgtgataccctcgtctcatgggaagccttgtctttatgtccctgtgttctcccttgttagggtagaactcgagagataagttgagatacaatctaagcaatcccaatctgtaggcagtcgtttttcttccgggatcactctcctcatttgctcaagagttatcaggaatgtaaaattttgacgtgtcacatcggatattatataggatatcacatggagtgttcgggtactaatgaaaaactaattataaaatccgttagtaaaccgtgagacaaatttattaagcctaattaatccatcattaattagtaaatgtttactgtagcaccacattatcaaatcatggagcaattaggctcaaaagattcgtctcgtaaattagtcgcaatctttacaattagttattttttagctgatatttaatacttcatgcgggtgttcaaacgttcgatgtgaaagggtgtaaaatttttatgtgggatctaaacaggccttagatgtgatatcctgttcagatatgtccgtgtacgtggagtatcctatattttgtacactaaagattaagtatggtccttggtggagaatgttctctcattattttttttcatatatgcatgtcatatataatatgtaatacacagatgttcttacatgcaaaatatttccatcatgcatgggaatcaagcagaaaggattaaatgcatcctcacgtcatatcagacatctgtgagacctatctctagtgtattcccttagagcaaaaattctcgttcttcatctttagagagagaccttgggtggtgtttgaatctcccgaatataaaaataaagattaagattaagtgtttcacacagaaagaaagaggtggtaatagtgtataattaattgagttttaattattacaaacttaaaaattagattaatctgatattttaaaacaacttttatatagaaagttttcacacgaaacacactgtttagcagtttaaaaagcatgtcacttttatccaaaattttattctctactcgtagaacaaacgaacagggcctaacttatacctagctaacttagcttttctatttatagctagctagctatctttaactttccctgcataaacaaagcaatggaatagtcaaaagcaatgggcacatgttacaatgcgacatagctgggatgtctctcgtgtaaatttgcttctcaaatacaatactgatatttttttaggttaatcggatctatgccattacaaatttacatttttaaaaaaaaaactattactattcactta

SEQ ID NO: 58642 - DNA, 704 bp, Oryza sativa
attcctgcaccccctatataaggagggtccgtatgcctcttggggcacgattcttttttctcccaatcatacaatcaataacacactcggcggaatcatccccggacaggagtagggtattacttctttaataagaaggcttgaacctgtataaaattcattgtctccaaacccatccactttcctagcttgatagccacccccttttattattgccgaaatcttgtttcgatagttggctcgccaggtaggggaggcgtcaagttctcgccgactaagtacgatgggtttcgtttctggcatcgacgacttcgccttccctcccgggcaggcgttccgattcggcagcttcgacttcatcaccaacgacttcggcaagatctctctccttgactcggattcaaaccagtcggggagaaaccaggtccccgtgccgtttggtattccgaactcggccgaggcctactccaagatcatctctcctgagttggtttcaagccactcggatgagatccaatctgttcctccacgatccgatcaagacgatgggtcctatccctcaatcttgatgaaacttcctgacgacttggccgccgtcttcacagccaaaacatctcccactcggagatctaggcgagctctggcatcggccccgatccagtctagatccagggaggttggcgttatactccaacctcttggga

SEQ ID NO: 58643 - DNA, 728 bp, Oryza sativa
ttcctgcagcccacctgctctggttttgggctctttggaataatcgcagtcatcgattgacaagatcatcagagttgctgaaggaagaggataggcatgtagcatttcattgacaaggttgaggtcaaacttttataatttagactatcaatgactttaaaaatatttagtttaaaggaactagacaacatatatagatttgtcttttaaagtactataataaaagtaaacatgcatttatttattatatatcttataatagaaaaacaaggtcaaagatgtatcttgtagaccgtgttattgtccaaaacgttaattaaaatgaaaccggagggattatgtttttcgtcctcgctgtaactctatactctactgtactcctctgtataccttgcaaacaatttgagcaatgaaaaattattcaggtgggaaatctctcccctccggtgattcgttaaaaaaaaaaaaacttatgactgcatacgtcactactacagaaagcgtttttgcatacgggcggaatcgatcttcacatgcggttggccggcccgcatgcgcgaaatggtctgcaaagatcaccatttgcgcatgcggccgtcgcagccgcatgcgaagattgatcttcgcatgcggctgcgacggccgcatgcgcaaatggtgatctttgcagaccatttcgcgcatgcgggccggccaaccgcatgtgaagatcgattccgcccgtatgc

SEQ ID NO: 58644 - DNA, 8555 bp, Oryza sativa
ctggttgtcgtagaagagacctcttgcgttgcagacatcgcgacggatgaatcggcagaggtcagcggccacgttcaagatagtagtgtggttgaatcgttgtgcaaaatatgggatttcggggatctgcacacagaaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactattcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcgggggccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactcatgaaagcgccttccgggacggcgacgcttatgaaaccgagacctttcctagatgccttcatataccattcgtgcattaccctcatttcccatggtagcttgttcataagataagttggcaagaatggcttgccatactcataagtttcaggcacatcggcagataaccaggattgcacttcatcttgggccgctagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagactttggttcggatgtagtaccatctggtatgtgcacttcttctaccagagcagattggggtgtaggtggagaggtttgaactgagggcggagccgggggagcatgctgtttagttggggaggtgggagaggcttgaactggttgcggggtcgggagaggcggttgttgagaaggggagggtggtggtgtaggttggcgaggcggtgacctaagcggtggtggtgacggcggatgtcgaggtgacggtggttcaggaggcgacggtggtgcaggagcggcagcagtcattgcctgcgatgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttctttgtatttgtctctcttcttataacttggtgcgtcttgtggaaacccgaccttccaacttgtctttgaggacaaaccccttacacgtccagagtgttcagccgtccccaacgccgcagtaagctgatctctctccctccgtgggacgaactgtcctgatctttctttctcgactatctgctgcaaattagtagtcacttcttctatgtctggagtctcgaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccaatgcttccgctgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgatgggcttcccatcctgatcgagagcaatcacgttgtaagtttccttgggtaatttattcttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgcctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcacaattatacataaatctcaaattaacacaggtcacaatttaacttattttcacataagtcccaataacttaatttcacataactcccaatttaacataagtcccaatttcacataagtcccaatttaacataggtcccaatttagcataagtcacaattaaacagaaatctccaattgacataggtgccaatttaacataagtcccaattatacataaatctcagtttaacaaaaatcacaattatacataaatcacaatttaacataggtgccaatttaacaaaagtcccaattatacataaatcccaatttaacataagtcccaatttaaacataagtcccaatttaaacataaatctccatttaacaatccacaattaaaccttctcaaaattaaacaatccacaattgcacatatcacaatccacgatgcacaattaaacaatccacaatccacaattgcacatttcacatttctaaaaagtaaatgttaccgagcgacggcggggacgacctggcggcggcgacgacctggcggcggcgatggcaacggcgaggggggagaggtccgtgcggcggcgacggcgacctggcggcggcgacggcgacggcgacggcgagggcaacggtcctggcagtggcgtcggcgacggcgaggggcggggcgacttcggggaggagccggcggtagcggggacgacttggcggcggggacgacctggcggcggcgatggcaacggcgaggggggagagttccgtgcggtggcgacggcgacctggcggcggcgacggcgacggcgaggggggagaggtcctggcggcggcgacggcaaaggcgaggggggagaggtcctgacggcggcggcggcgacggcgtggggcggggcgactttggggaggagccggcggtggcggggacgacggcgacggcgacttgggaaattttggcagcctggcggctagggtttcgcgggagctgggacttagaaaattttggctccccgcgctccctatatataggcgcagatcatcgcatgcgggcggcttaagggaccgcatggaaaaatatctttccatgcggtcgacataagccggccgcatgcgaaaaagatctttccatgcgggctgttaagccggccgcatgcgaaaaagatctttccatgcggtcgacataagccggccgcatgcgaaaaagttctttccatgcggtcgacataagccggccgcatgcgaaaaagatctttccatgcggtcgacataagccggccgcatgcgaaaaagatctttccatgcgggctgttaagccagccgcatagaaagatctttttaccaaaaaaactcatattttttttcctctataagtaaactgtccatatatatttttttcccaatatttcgccacaattatacattccaaatgtttttggcactaagaaaactcatgaaaattactcaaaactcgtaatcaaatgttacatgctaatgattacaacataagggggacctaaattcatgcacgtacatttgctaatgattacaacataagggggacctaaattcatgcacgtacatttggaatacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacctgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactgttttgtgaggtgcttttcatgtccttcgtagtcgtactcaaggtaaatccattgatgtcgtaaccttgccatgaattgacaatacttgaaggcccacatgccaatctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaatactttttgcgaaattcgattgaaaaagtagcacaactttgttataaccacctttgtatggactggtttgactgcccttatagcaattggtaggaacactgttagcaacctatgacagtcatgcgcattgtatcccgaaatggacaaatcctttattgatactagcttcctgatgttcgatgcgaaaccagtaggcactctaaccccttgtaaacatttacagaaggcttttttctcatcaagtgtcaacgagtaacaagcaggaggaatctcggtcttcccatttggcagcagtactgggtgaaggtcatgccgtatggacaaatctacaaggtcgttacgtgacttcaatccatccttcgttttactcgggatgtccagcaatgtgccaacggtgctatcaaacacgttcttctcgaggtgcataacatcaattgcatgtcgaatctctaggtccttccagtaatctaagtatttaaagaaaattgagtgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatatcagacatccagtcttccctttaatctgcccagataatgaaaagtttgcaggtaggtcattgatggtaacgaatatgattgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaacgcaaaccttacattcctaggatccttagcaaattctgggtgttttgcatcaaatgtcttccactggcgagcgtcggcgggatgtcgaatcataccatctattttccggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcttgccaattctccaatcctcgtgacctgcccgctagcacctctggttcaacatggcgtagcatatcctctaaatcaaaaccaccatcgaaatcatcactatcggtggaaacatcgacaatcattctttcacgcgacatgtcttcgattataaaattctctgcctcattcatctcgaaacttaactcttcatcgtcatcttccggattggcgaattccccgtgataggtccaaaccttgtagttggcggtgaatccgtactccattatgtgacccagggctgcagga

SEQ ID NO: 58645 - DNA, 2385 bp, Oryza sativa
tcctgcagccctacagaaaaacgatttttgtagtagtgcgtgtacgtcttgcaaaagagtaaattgcaatacttattataaagcttgttattgatacaagctagatgcatacatacatgcgtgaactgatcatacaccctcttaaccaacacaagctgatcgaagagaccgatatcaacgacgaatcactaatatagtgtatgtgtaatatttgtgacatcaaaatttaaacattagtggatgcatccacgagaccgtaccacgattcatcacttcatttgtacacttcctagaaagagcatctccgataacatcctttccaaatctcactttccaaatgttcatttgaccgatttgccaaaaaataaaaagatagtcaaatttacctttcatttcaatagcctctctattacaattctctaatctgatagtgggtctcacatgtcagcctccctacttctttccccttcttctttctctccttcaccctctcctctatctcttctcttcctctctcttcttctttgccggccgccagtcgaatccgtgtggggaaagaggcgttggaggccgtgcaaggacagagacggtggagaccgcgacgagcaacaacagtgcagttgtggtggatggcgagactccaaatgatgagtcatgagagagactgtgatgaagccgaaagcgcagccagaacgtattcatcaccagtgaccggtctgacctcgtcgacaccgccgctaaaggtcagcaggccctccgatccatccctgccctatcatcgtcgttgcttgctccgccaccactgctacaactccttgctccaccatcagtgccgtcaccaccaattgatccgccaccgtcggtgtcatcactgcttgcgggtgggggccagtacatggcgagagagagagagagcaagagagaggggggggggcggggagccggaagaagggatgggagagatggtgggacccacctttggccaatgaagaggctggctacgtttagccattcggatggagagtctattggaactcgttttttctctatgttggagatgatctaaagctcatcaattttttttaatacaaactaagtaacacatatataattagataatcaaattaagagtatcttttattttgtcagatgaatttgttttacagattaaatagtatataatataggccgtacctgatctttgtcaaggttatggataccacgtacctaatagtagttgactaaatctcggcaggacccaccacataccatgtcctatacggaaacaacctgcggatataggaggagttctggataaggaaagacaaccagagttctacatagaaatgacaagaactactcggattgtatccatattggtttccttagttctacttggacaaggggacacctatgtgtataaatacaaggctccctaggaggagaggggacacaaccaacgcccaccatagacggaacaacagaagccacaacatacaagccaacatacgacaggacaagacgccggatatcgacttcagggataggcacggctagtcccctacggtgtctccagatactgtcaggagagacgaaagcgctatctctgatctcgccgggcacgaactcgaggaggaagactaccctgttatcgactacgagtcagaccttcagaccgccatgtcgacaacagttagataggctaccccacatattgtacttgtgtgatctagatgaataaagagcaacaacggcttcggccaacatgatgtagggttattacctgataattcaggggcccgaacctgtataaaaaggcatgtataaaaatctccgtctccatctcttttacctcagtctcgcgtataccctagtaccaacgatccccataccatgtaaataccagaatcgcgacatcaaatgtcgacagtggcgtaccaggtaggaggattttggtgcttcaggatttcaatgagatgggtttaagagatagattctccaacaataagctactcgacgactttggctatggggagatctaacctgaccggaatatgtctttcgacaagagcggaaccatagtcaccaattatttgatctctcgagatcaaccaagcttcgacgtgttgccatggtgtcggcatggtgtcggcatgatccaacattaaattctcgacgtgtgcgacatcaactggtgcaaggtatcggccggctgagtccaagtcgaacccgacaccgatccctaccaaccaaccaagcacgtcgaggagccaaaaatctaccgctggattagtactaccgtgttctaactaggacacgatttctagccacgatctactggtcgacagcctgacgtcaccctgcatgtccctttaccgagccaac

SEQ ID NO: 58646 - DNA, 1777 bp, Oryza sativa
aaggttgattatatatatgtatatatatatatatgtgtgtgtgtgtgtgtgtgtgtgtgggcgcgcgcgcgcgcgtgcgcatatgtgtatatgtataaatacatatattacacacatatgtataatttaaagcacttaacattttatatgcatatatattaccaaaatatatattaacactaaagtaaatgtgtacatatataaatatatatatacacgcatatatagtacaattcatttgctcgatagctatagatacgacttcgacgccggcgttatgtcagaagaggaaggaccgacgttatgaattgtcgatccatcgtagtagaattcaccatcgggattaaggacttcttcgttgatgaatcccattagttattcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggcatactcgcatatgtagtagccgtataagttagttccttggtcctgctttgcacacttcatgagaaacgatgagagatttaatataatctttatatttaactgtaattagagatttaattaaatacaattttggatcatgcatatactcaccggaaaatgaaacctccatccaagtttttctttccaagtcccgcggaccaatttacggaaccgatcccaagccctacatgtgcagttgcaagctatgattaattaattattacccgagatcaacataatagcaatagaatccccgcgactttggaatagatggtattatattacctgtctatcagttggaagaccttttcaaaaatcttctcctctttattcattgagtcatacacagtgactctgcatgcgtccaagtcgaagaataacaggacccagtggaatctggaatatgcgtgagatgagatatatatgaaaatatacatgctatatgtatgggaacgaaatttgttcgaacgacaataaaaactcactctgtgttgtacggcagtagtataaacgtcttgaaatgctgctgcgttaggagatggacgagattgtcctctgtgtctttctcgtacttgtcgatcatttcggtgttgattttccgagggtcgatgaacccagtatcgtaaaccccccgccgtcgggccctttgaatctccattctacaacaataaaatgaaattgttattgtttacatatatgacaggagctagttattgaacgaaacaaatcgaactcaaagatacttacaaaatccatgcgctcaaaagagagacgtcgagggcgtccaaatggtacagatcgaagacatccttgaaatggagccagagaacatcttctccttgcaagaagtcggggtttctgatcctcgctccgaacatctctctacccttggcgctcatttccatgtaccgttcatggaatttgtacatctgtgtcggtagggactgcagctgctcaggcgtgacaagcggtttaccgagttcaaacttgtatgccacttccgcctttaggattggtgtggctccaatcagctgatccacagttagaccggtatctgaaatgaaatccgttattccaaaattttcgccgctcaccaacggctcgacctcttggtttggttgttctccaagctagggactggtttggacttcttgtgata

SEQ ID NO: 58647 - DNA, 770 bp, Oryza sativa
gagaaagacatcatttcagactttcgctggtccatcaaacttgtgctctctttgcaacaaacaaaaacaccatttgagccaagcgtcaccagaagaaactttatgcccttttcgaggaggaaaaacattgctgggctgagcatttcaaacaaatactctacagctttggctttgttcttggactgctccattttgacaaaagtatatttctcaggaggagataatgaatttgccattgccacaagctcaatctcatttggggaagtgtaagtaatctgaatcaccaggaaattattaagtgacaagaccttaacatgatacatagtaataagtaccaattcaatcctttgcactcacatattttgcaattggtgcaatccttgaacccttcgcaagtgagacaggctcaaaaaacacaggcactcctgattcatgtgctactggggaaaaaaaagaagaaaatagcatgcatgtcatcaactttttgatgcaatgtagagattaggacaaaaacataatggtgtaataattgacaggactgtctttctcatttttgtcaaggaagctcctcaaaacgatggtcaggagggacatgagtagtgcaccagtatactcagagtcagagataatgcagttcaataataatacaattctataaaattagggagtgtttacaattagaattgcatacattagtaccccgtccagttaaatttatgtggtactgggaaccgcaaatatttttgagttttgactagggctgcaggaat

SEQ ID NO: 58648 - DNA, 1458 bp, Oryza sativa
  unsure (1)..(1458): unsure at all n locations
caggaacttgaatcccgtcggaaactttcatatagatttcagaatccaatgacccatataaatatgcagtcactacatccatcaactgcacttctaagttcaaattgactgccatagatattaaaaaccggaatgtaattccatccattacaggtgaataggtttcatcgaaatcgatgccaggtctatgcgtaaacccttgtgctactaatctcgctttataccgaaccacctggttgttctcatcctgttttcggacgaacacccatttatatcctacaggggatatccctacgggggtacgatcaacaggaccgaatacttttcttttattgagcgagattaactctgcctttattgcttctttccatttgacccagtcttaacgctttttgcattctgccatggactttggttctgggtccagatcaatgatcttagcgatcttttcggcaaagtatatgtcgacaatagtagtctctttattgtatgtttcacctgtatccacataattggtggatatttcctctattctttcacattcctgatcttcattgtttcctgcaatgtttaagtcaggaatttccggtctcccagtgctagtagtaattgcgcgcgcattctcactaggttcattgccatctgggcatatcactgcaggtggctcatcttcctggtgagctccttcactattctctggtgctgtggtattctgtccaatctgttgtttcgtaggacgtctcctagaaactttagtttggttgtgtgcaaccggtggtctccccctcttcctagaagttagggtagatgtagaaattaatttgaaaaccggttcctctgcgtcatgaggtatttctattctttccggtgcattcacagcaggtatatgagatttcatgatcccctttgggttagtgaaggcttctagcagattatttgcaattctttgcaaatcaattatgctctgaacttcatggtcagattccttagtacgtggatctaaatgtaggagatttttagtttcccactcaatttcgcggcattcgaccttctgtaggtactttcctccccctaatgctgggaaatgatcttcattaaatatacaatcagcgtatcgacccgtatgtacgtctcctgtcaatggttctaaaaatttaatgatagacggagattcaaatcctacatagattactaattttctatgaggacccattgacgtacgcttaggtggcggtatagggacgtatacaacacatccaaaattgtgcagatgggaaatatttggtgcatatccacgtgtaagctgcataggggatacaacattgtatgcagtgggtctgatttgaagtaacgccgctgcatgcaaaacagcgtgtccccaacatgtagttggtaggttgctatgcagtagcaatggcctaccgatnnnnnnnnnnnnnnnnnnnnnnnnnnnnnnnn

SEQ ID NO: 58649 - DNA, 4025 bp, Oryza sativa
tctgactgatatattcttctgagcatggataaccacaagaaatgcatatgggtccttggctccataaagtcatgacatatgcacctgttcacatttcaagagtctgggttttggatccccaaattctgaattttcaattcctttggtgatataaatctacaaagtagaccaaaatcgttgctactgtgcttgggtgacattagaaaaactagcacagtccactaatttgataagcaaatagtactatgttgaattgcttacagtttaacagagacttaaatatagtcactatacgatgcctacatgaaccttgttttcctttccaacagcatagaaaattagcagtaacaattggtacgtgacattggtaagatcatccttgtagataaatagaatcaatccagacagtctaatattgctatagcaaagtgccttttattgatgtactaaatgtcttccatcctaagtcaaaaaagcatgtttccacgtcagggtgggtgctgtgttcttcactcctgttttcatgtgcgtatagcatgagatactagtttatgagcacaaacaggtctcctttttgcaatgtttatccatttctgttgttgtgttgtttcaccatggtcctccattcaggaaatcaaatgtgtagctataacatatttcttctctaccctattccctactttagtgttgtgaaaaagggttttgaagttgtagtatgccatacgatatggttatctatgggccaatggtagaacatgtgcaatatgtcatatcttatgttatctctgaaaaggtagagacctcacctagtgaattattaaaggagacaagatgcacacaagatcttaattacaatgatcaattgcagcctttatcttttatgaatttaatcaattcaactcgttgctgcagattcacacacccgataatcagcaattaagcacttcacttagttagtctaagtgcccaacaactttcaattcttcaataaaatgaatagtgcgatggtcgaaattcagtttgctgacctgcgtggaaaatgcttcaaatccatttgccgcagaggttaatcatgaatatcatacggttcccagagtagtgataacgcagcagtttccagagtgcttgtgaacttgttaagtgcccctcccatttctcggtatctccagttgctgcctttgcaggtggacgcaaatcctttcacctgggaagaaaaatgacagccattcagccaatgatgcccttgtactaaccatggacagcatcacgcacaaatgacataagaagaatcaactcatccttctccacgaaaacaaaaatggaaaccaattgtgcttttatagtaaccatacaaacttgacacaaaaatgacataagaagaatcaactcatccttcacgaaaacaaaaaaggcaaccagttatgctattgcactaaccatagacagcttcacacagaaaaatgcaacccatgctgcttttatactaacgaacagattactccagatagcttctttcagaaatgggcataggcagaatcagctcaactacagtctcaggtccaaacaaaactagaatatttacaaatttgaagcaaagacacaccatctgtaatcaagaacacggtactactatatttctctgcatagtaagatcaagtaaccttcaagaacattctttgaaaagaaaaaaaaaagttactaccttcaagaacatcataccattctagattttgcttactggctgacagggataacacaatagcattaacactaatcttactaattttcctgaagcggcattccaaatttcattaacaacaaaatgaaaacaggccacatatatgacataaacgagacgcgatttatcatggcaagaaggcatccatccaatcaacagtaaaggacctaacacggggaatggggatcattcagcggccgaaccccacaaaataatttattctattttattttattttgcggggagaaagaacacgagctgctattctatatttctattcgattcgaaacgtgagggattcaggcgggcaaaagggaagggaaaggaaggaggtcgtccggccgcgtggcaccctccagaacctgctcacctgccgccgttcgcgcgaggagggtaaggccaggccgccgcggccgcacaggggagaaggctagggcgcggggaggccgtccacgcgctcgtcggcggaacgcgcgaggtgggcggcgcctcgcattctcgccaccacgccgtcgcacagcttgtggaagagagaaagagaggaatttgaagagagaaagagaggaatttatatttctgagcaattttgcgctgagcttagtttctaaaagagcaggggtgctttactaaattttcttcgaaaattcttgcaaacaagattttaaccgtttggtttaaaaaaacgtaagacgtaggatcattttaaccataattttttttgtaaaattaataaatatatagatgtatttactagtaggttgttaccgaacattggtaatgcccacacctcttcctttagctatatccattaaaaaacaaattgaagtatctataatatctactaccccgtttcaggttataagactttctagcatttctcatattaatatagatgttaatgaatctagtcacacatatatgtctagattcattaacatatatataaatgttggtaatgttagaaagtcttataatattaaacggaggaagtacaaatcacccctacagtatgtttagataatagaaaaatgagagataggattggaattgaaaaatgaatgagatgagacttggggtcgtattccacccactcggcctatcttgtcctcttctgaggaaggattccatcccggcatctacctatctggcgttctttcgcccctcctcgatatcgctactttctatggttggttgctcatcgccactgctggatggctgaccgcttggagaaacgtggcttgccgcatcctacctgttgtgtcttctgtgaccaacaggatgagccaattgatcacattctaattaggtgccccaagtccctacagctgtggtggaccgtcctctcgagcctcgggctcccacattgcttcctctctagcgatgtttccttccacgagtggcactgctcccgccgactcaaagttccgagggagcatcgttgtggattcgacacggtcgtgacccttggggcgtggtccatttggaaggaacggaacaaccgcgtgttcaacaactgttcttggccctggtccgaggtggtagtaggcatggcgcaagaggctgccctttggcatctcgcccatcccctgtcgccaacgctaccttcttagcgtgctaggtcgtttggtcgtcccattgtaatcgcgagaataggcttaagtcctctttttcctccttttcctccttttcttcccaaatccctcttcatttctttgttttgccgtttgcgtaaattttatttctcttaaagtcttaacacaaaggtgcacaatccttttgcgtattcctgaaaagaaaaatcaaggattaatattaaatagaagagagagagcgaatggttagaattttaaaggtgtctttgaatatgtggaaaataatttctgtggctcattaaccaaacaaggccttttaagtagccacatctctcgccatctatctcctgttggttatctggactaggtgagcgatcgacaagcacatacaggcagcgacgctacatgtgcatgcggcaacacgagcagagtagtgccatatgtagcagttcagcgtatgggaaggaaggcgttggccaccagtttgaccacatggtttgatgaatggcggaagattcggattcactctcatccttcttcatcacactactcttttcatccataaatataatagataatccataaaatgccattgacaagcgtctaagtcccagaaatatcatcgacaagtgtgatttccaagaaatgccatcgtacaaatgattttgtcccaaaaataccatcgtcgttagggt

SEQ ID NO: 58650 - DNA, 5977 bp, Oryza sativa
caaaatcgtttgtacgatggcatttaaaggatctttgtccggatgaatggttaggatcctttcactactggaaaaagtgtttttccaggcgggccaatcaccatttcactggcgggcaagcggtcctcctgcaactcaacgattgtaaaaatagttgatttttgcaggcgtgtaattggttcgcctgtgaaaatagcttccagcgctaaaaaaaggcacccaccgccgtttccggcagtagattcccgttcccaatccagttcccacacatttcccatccaatccagtgaatccaaattcaacaaagaagtcaccagttcatccaaaattcagtttcacacacaccagccatatttcagtttcacaagaatcaattcaagcaaagaaagcaaacaaaatcacatgtaaaatcattcctaaaatcactttatacatatagctcatccatcttcatcagcaaaaactcccacatcgccgggagggagggagaggccgggagccatcgtctgccgccgctgcctcacggccgcgccccgccgtcgtccgccgccgccgccaccgcacggccacactccgctgtcatccgcgccgccggccaccgtcctccccccaccccctccggccagatctgggagggaggggccgggagccgtgccgcctcaaccctcctcgccggccgccgccgccaccgcccgtcgccgctgccgccaggagcacgcgccgccaccgccgcctctggccggcggccaggagaggtgaggggaggagaggggccgatgagagaggagaggtgtggaggggaggccgggaggagaagtgttgagggagagagagaaatgagtggtggggagggggtgggaggaggagataaggagttaagattttttttagtacgatttttgcaggcggaccacataagggtcacctgcgaaaatccggttaagtggtccgcctgcgaaaataaagcggacaatgaacttcaccccgatttatatttttgtaggcggttatttggttccaaaggtcatgtccgcctgcgaaaaaagacctcgcgtcgggaaaaatgccttttctagtaatgtttatacttatgaagagagatagtatttcattaacttttaatttatagcctatgtagctaataaattgttaatattagcgtgatcttttattaaccgagcaatagaacatagaaagaaagaaacgttgtagtcataacttgggaaacaacttcagtgacatggccacttgatgagttttgagagcggttttcactgacgtggctcattgacttagtcaaccatgtaaggacgtggtagtccaatcacaaaataaaagtgaatccatatgtaagtgactagaaaaaaataaaaaagataaatgaggcccacttgttatactcattatctctctttttcctccttcctccctctccctatccctctctcccttcactattcccctgtcggaagtggcgagggagggagtggtggcaggggctcagggcgatggtagtagtaaccggcaccagagaggggctgtgtgatggcttgccgttggtgccagagagggggctgggggaatgtcgtgccactggtgttggagagggggttcggggactatgggaatggcgtgccaccaatgtcaaggagggggctgggggactagcggctcttcgcctgcctccatagcttcaccaagttcgactccaccctcgcctcctaccttgatggcttctccaagctcgagctcccattgctgagtgcggcgccaccactccccttttcacttagtcctccctgttgctgtcccatcccgcctcctcgctgcccacccctccttcacctccccgcagggatcttgtccttcatatctctcccaggtttcgccaaccgccgccgccgccaacgaggttgttgccgcctccagttcctcttccaccggacaccaaacccctccccctcctccgtcgccggtgatgccaagctaagtggcaaggccgctggttctagactttgagtggttccaagcatgaagaagttaggggaaaggaagagggctgataagtgggctccatattttttatattttttcctagtcacttatatatgggccattttctattttgtgattagattgccatgtcaacgaaaaacactatgaaaaccgctaagggagttaaattatatcggtttaatagttagggtgaagacatccgatattatggtttagggatacaaatcaaattggacatatatttgaggggggtcataatggacttactctatgggaaaggcaattttgaagaggaaggatgcggccaactttaggccttgtccagcaggcctcaattccggcccattccctgttgatggacctgaattaaagcagggccttgagagaaaaaataataatttgtccaagaaataattttactctgatccttagtgcaattcacgaggggaaagaagaatagcattgcaactaagtaaggaataagttcactctgtgaccctaaaagtgattgaaatctaatccgtgaccctaaaccgcaaaacaagatatctcgacccccaactcttaaaaccggtgcaatttgactctctcgcggttttggagggcggttttgctgacgtaacgcctaagtggcggtgttgacagggtcttccttacacgtggcgttgacgtggcgcttgcgtggcatcagaattaaaaatatatatatatatatggcccatttatcattcacataaaggatgacatgtgggacccactgacatgtggggcccacatgtcatcctctcacctccccttcttcctcgtccccctccctctctcccttctctttttctctcccccaaactctcttcaccagagcggcagtggggacggcaacggcgtagaggggaactggcggtcgggagtggcggtggcgtccggctcagttgttgtcgcccgccaccatgaccgatgaatctggatgacgacggttgtagtggtgggcgtagcgcgcggggccgtggcgggaggaagtgagctcatcgaagccgttgccgtccgtgtccatggcggcatgaaggtgtggatctcgtcctcggcagccgggcgaagaacgagcgagcgaaggagcgcaactgcggcggcgactgctgctgcgatgacgacgtagacaataggggtgaggcggcgcagtggtagtggtggtgggtgtagctcctggggccgcacgggaggaggcaagctcgtcgaagccattgtcatcagcgtccatggcggcatgagggcgtgggtctcgtcctcggtggccagtaggactgcaagaggacgagcggcaggaggactgcaggaggagagacggcggaatgggggcggcgtgcccactccgcctcctctccaggcccgcgcccgctgcccacacgctccccctcggggcacgctgctcccacggccagcctctctcttcccccacccatggccgctgccgactcccaccgccacagccgccgctcctcaccgcccaaccgccgctgtccccactgccgctccggtggtgaagagagtttggggagagaaagagagaagggagagagggagggggatgaggaaggggaggtgagaggatgacatgtggaccccacatgtcatcctttatgtgaatgataaatgggccctatatattttttaattctaatatcacgcaagcaccatgtgtaaggaagaccctgtcaacaccaccacgtaggtgccacgtcagcaaaaccgccgagggagacaaattacaccggttttaagagttagggggttcacggattagatttcgatcacttttgagagtcacaaagtgaacttattccactaagtaagcatctctgcttttattgggtaaaaatgacacgacgcattgcatcagaaactgatcatgaacaaccatcataagaaactcaaatttgactcctattacaccgaatcaactcaatgtggaaaactcaaaagtaagtgctattacaccctaccaaacttcaaatcggtcaaaagaatcgacgacgacaagcaccatcaggtgctctagtatgtatgcagtacacgtatacgtatatgtatgggtacacaaaaaaaattaaaaatgaaaacccctctaatggcagctaacgctcgcgccaagatttgaataaaaattttattgcttaattcgatcgatcgtcttcctcctcggtgggctcgtgctcgatcagcggtagcagcggtaggccggggtgtacatgcagctctcggcgtacttgacgaggtcgtcggggcgcgggaggcggctggcgaggccgagctcgtacgccttggcggcgaccttggcggcgatgtgtgcggagatcttgcggatgttggtgaagggcggcaagatgagccccctggcgaagttgtcctcgctcacctgctccgccagcgcctccgacgccgccagcagcatgtcgtcgtggacgcggatggcgcccgagatcaccacgcccagcccgaaccccgggaagatgtaggcgttgttcgattgccccggcacgtacgtcttcccctcgtactccaccgcgtcgaacgggctcccgctcgcgaacaccgcacttccctgcacaaacatttcgattcagatcgccattgacgatttcgattcagctctattgatctctcaccttggtccaggtgtatgcctcctccgcggtgcattccgagtgcgacgtcgggttggagagcgcgaagatgacaggtttctgcatttgatttcatgttagtgcacttgatcatcatcatcaagaagaggagcgcacatatgcagccaccatgatgtgtgcattggttacctcgttgaaggcggccatggcctcgacgacctcctgggtgaatgtcttgccgacgccggaagtgccgatgagcacggtcggcttgatggactgcacggcctccagcagcgtcttcaccggctcgtgctcgtgcgcgaatggctgcttgaagtgctgcagcgactccttcctcgactccacgatcagccccctcgagtccaccagccacaccttcttccggcaatcattgatcggaatctccgtctacacgaataacacacaatcaaatcacactccatattgttgtttatcatattcagtgaaagtgagtgaggcaatattcagagtttgcagtgtgttttcattcagttacctgctttgacatctcgagggcaatgagctctgcgatgccagttccagcctcaccggcgccaaggaacaggtaagtgtgatctgcaagagttccaccgaccaccttgagcgccgcaatcagacctgcgaggaccactgatgctgttccctgccatccatcgttgtagaccaaattcatcacattagtatttttgtggctactgattcagacaaattatatgggcgtgaaaccagaagaggttcacaaaagtttcgctttcttgtacctgaatgtcgtcgttgaagacaaggtggctcttgctgtactttgcaagcaagtcaaaagcattgtggttggcaaagtcttcaaactgtggaaaggaaatttgatgttattcagtcatctcctgaatcctgataaaggtaaaaacagagtgtgcacatgtaacttaattaattcttctatgcagactgacctgaacgagcactttctcgccgtagttttgcttaactgcggtcataaactcctcaagaagctcgtggtattcctgataaccatgataacagagataagataaaaaagaaattctatggtaaaaagagttttctgtttcaccaattaattgcaggtgaactacgtgtgcagaaactgtggcttacctctccggtagcacggcgttgcttgagtccaatgtagaattcgtcgttgagcagtgactcattgttggtaccaacatcaattgtgattggaaggcactgcatcatacatatattcacatttatagtcagcaaagggctgcagg

SEQ ID NO: 58651 - DNA, 739 bp, Oryza sativa
ctcaccaaccaggactaaagatctgggggtatatatattcccggtgcgcccttgtcttctccaccaacacttagacgtttttccatcgagatcaatctcggcttctccttcaccgccactacctagggcaaccccgcgccgacgccgccgtcgtctctcaccatcgcttggcagtccgcgccgcctccgccgtagacgccgccgcggcatctcttgggtgagagccaccgctgcctctctctctctcgatctcgatctctctctctctctctccaaaccgccgccggctagctcgttgccgagcgccactaccacgccgcggtcaatcgccaccgcagatgaccgacttcgccgcgccgccatgccaccggtccgccgacgccactgccgcgcgccccgacatcgccgaacgtgaacgaacgtgattgaaacatgaccaaacgcgaacgaacgtgaacgaacgcttaacgaacgtgaacgaacgcgaacgaacgtgaacgaacgtgaacgaaacgttaacgaacgcgaacgaacgtgaacggaacgcttacgaacgtgaatgcacttgtactaaaagtgtgagaacgaacgcgagcgaaacgtgtacgaacgagataattaaacgattattaaacttagcatacatatatgattatatatatatatgttaaaacgtgaaatacaatatatgtaacttggcccgtttagactaatacattttcctggtaatgttgcagag

SEQ ID NO: 58652 - DNA, 1903 bp, Oryza sativa
attcctgcagcccgatcagataacgccaaagttcactttacactcgccagcatgaaacaaatggagaatatgtagatcatcttttaattttcgagcaggattcaagaagccaaatcagaaaatgaaaactaacaccctgcagggacattagtgtcccttttaaactgttactggaagaaactggtggttctgtatatttaacaagttcttgatgtttaactctaaactaataacttggtcagaaaagttatggtcactaacttggtcactaaagttatggtctctaaaataataatgtagaaggtttaaagaatagttcatatcttacaatttacaacaaactgaactatatgccagtggtttccctgatcagaagtttgaagaaaaagtatattatgctaaaacaagctcttttgacagttgaccaaatcaatgttgaaagtcagaaaagaaaaattcaaagctggcagggaaaaaaatacggataccatgaagatggcaggttataaacgagaacaacctcatataacctcagcaactagaaaatcaatgtgaagatacaaaattggaagcctatcagagcaaaagtagtccatgatacaaatgaaatcaagtgaattaccatgaacaaaaaattgggagtcatcatgcctactgaaaacatcaacagaaacacgcccaccacctcccccagccaaaccatcccctccgcaagcacttattgtgccacctccttgcctgttacaacaaaatatcagagaggaggcaactgttcgaaataacataaattcgaaatttaaacaaaaaagttatatatatatattcatttaatattttaaaatatcaatgagtatggttttcatagaccagctcacttaaaagtccaaaactccaaatatggctggtcaggccaacctgcattataatctaacatgtacataactgatgcttcttggtaattctttgcttccatggttccttctacgttggagacttggaatgtattgtttgatcttcgctagtcatgctcatactagtcactatgacataattgtggaattttagactagagcaactgatctggagtaagtttaagtagcatttagtccaaaatcctttgtttattagttgcctggcaatatgtctttctgaagaatgtgtttgtaacccaaatacgtagatatcaacatacaatcttcgagggctacaaatcctatcatatgatttagcacttaacataattgtaaattaaaacttatctggtccccatcactgcaactgtcagttttaggcatatataaataaaaaaaggatacacaatctctctcaaatccttattaggtcctaaaataccagtaccagatatagttcctcctgatttatttcaattgggaagtactgtttcaatccaatgcactggaatgtgaaatttgtaccattctcaacacagaagaaattttattggctttacatccattccagtgtaaaatttctaatacatctattggacaagctagtgcatgttgagtgcatcctatacaggaatcatgatctattacagaatatgatattggatatataactttttaaatatggtaaaattaaaaataacaaaaatataagtatatatgaattgtggcaacaggcagagcaatgatttatccaaacttcaaaaaataaattcgtgttgcctttgtgtgaaagtgtgaaaaagagccaagaggcctgaattttgaactttaacagtcataaccatatgaattgcttatacgatttcgaattagccaacaaagttaatatcatattttcaatataaattacaaatactcacatggttttagccttgagatagatgcttcccccagagccacccccacctttggtgccaccatctcctccatta

SEQ ID NO: 58653 - DNA, 3139 bp, Oryza sativa
ggggtgggaagcatcagaggacccagcgcccggagggtaggtggggggtactcgacgaggtttcggattggcggcggcggcggcggagatcgccggagacggcgagggggggttggggtttggtggtggttgctcggtttccgcttccgtcgctaatgggaatcgaagcggggcggtggtgcggtgggagataggccgtccgatttgccttgagattcggggaggggttggtggggactgactactatgctggggtttggtggggccggatgggcagtggcgcttttggttgattcatagaggagggtataccatccatctctctctatcacttgattgcagctaatagtgaatagctttgtatgatcttttaaagtgcaatgtgccaagtgacgacagcttatagtagcagattagcaagaggtcagtttgctggtacttttggaaagatcttacagttatttgaaatgtttgtttctctttcactaaagtatcaaagtactccctccgtttcataatgtaagtcattctagcatttctcacatttatattagattcattaacatcaatataaatgtaggaaatacatttagattcattaatatcaatatgaatatgagaaatgctagaatgacttatattatgaaatggaggaagtatctatttgtctatttctcgttttcacatatcactaagttacttgtaagttgaatcgtttgtaggtatcatccttttttaaaaaacccgggcacctctttgcttccacaaattattctaatctttgaaaaaaaagttaatttgatctttgccattgcaaatatgcctattcagataaatatcatcactatttatctattcgtagtctcaaggcgaagaaagataaggttgtgttacttggtaatggctcaaactcactcattatctgtgctggtccttaccaatctcttcttccttcactgccatcgtgcagcgacgggagtttgacgctcaacggacgctttgtgctccatggcagccccacaaagagcatgaatgtctcttaccagtggggcccaatgcatattttatttgattttcactggttgtaatatcaaggtgccaataagagtcacattagtcaaaatcgtcttacaaaccattgaagagtcattttgcatcggtccgaacggtaggagaactcgttatagctagttttctgtcgaggaacgcgaagcagatccaacataaatttgaggaactcgaattagactttatctgatgagtaacagatcgatgctctctttttgggctggtttagtggtcacattttgaactttgagcccattaaactcccatggacaatcattatttttcggattacatttcataccccagcgtggtcttgtagtgcataagcttactttttacttactagtacagtgtaacaatcttctattgcttacatcccttgggtcaaatacagctgacaaccactcttgtgcagaaattgtttggagtagattaaaaagagagagtaacatcaatggtggaatgaacggggtataagcacgatgcttattgattcattaccaaatattcctgaaaatttataagtagtgaaaagtacgaatatctgtacaagccactaaacacctacccctccgtctaaaaaaacccaatcctaacaacgaatctggacacagattgatctttttttagacggagtagtaaaacttaaccattcaaatatagaaattattaatacttccaaaacttaatatgcaaatacgacacatcaacgcactaagcatttaaaactcaacaacaaaagcatagtaagtacatctataatttattacatgctaaaactcaacaaacgagcacggtaaatcataatatttatcaatatcattttcacaatattttaacccaagtccatccatcttttctacaacattcaacataaatttatccatatattccacggtaaagcacgggacataatctagtatataatataacagcctcatcggatggcctaataagtcaaagaaaaagcctaattttaaattttcaagtttaattttaaaattaattttgacatattttcaacatagtttctttttcaacattagcttttaagtcacaaataacacatttctaaaagttttacccacaaattcatttttatttcctaataagccgttttggcttattaggaaataagccaaccaatggggacctgagtgacggtagaaattatttttttatgccccacaaataattgagatgaaaaaaaagtgtaagtgggctggtttatttgttgtggcccaagcaaagcaagcaagctagcgtagaatgcagggccttagccggcccatgagagcagcatcaggcaaccagcaaagcaaacagtaagcaactcgtaaagctcctgtagcatcgcaaattagtaaccacgtcggaagtttgcagtgagagggaaaagcttacaagaaggagatcctaatatcctatgttcaaaaaaaaaaaaggaggagatcctggacaataacaacactgaatataaaccttctgcgcaaactggggatggtaatgaaagggcagtttatgagtatatgagctaagctcatttttgtttgttttaatttggtgattttttcgcaggcgaacagcataacttgaccccgcctacgataataacttttgtgccacttgtgaaagtgggtttgccccgtttacaatgatcaatttccgtagtaatgtgactagctagcgagtattttctttgatggccgcaatattatctgtgataattaaggaatttgagctgacatttacaagcactatcactaaaatggtcaccactgtcaattcagcgcgaactggctatgagagtattattgagatgcacttaatagtgcagtggtaagaggtgtatggttttaattaactccaagatcctatgttggggctcataatttttttttaaaaaatatatttggaggaacatctcttcttccaaatctcctttttttaagatggagtatcactgctggttcaccatatagtttcatgcccaaaacgacaagaaccggcagtgttgctctgtcggttcgttcagctgtcggatcacgtattcacgttagccgttattctc

SEQ ID NO: 58654 - DNA, 2187 bp, Oryza sativa
tcatgttccgataaatttcgtgattgtattctttctggttcatatttgctctgtatgtgtagtatttatttttattttcatatctagggtgactatattagttttcattcttagaaaaatatatgaaaccgaatatgatagactagctggtttccgtccgtattcgagctagctgttttcattcctactattaatgatggtacgataaaagaagaagagaaaacacatgttatccctacttggtgaaaacatataatagataatatttgatagacgttaaatataaaatacaggagccataaactgactggaccaaattaaatcatattacaactaatttgagaaaacaacatgtgtaatatgatgaaatagaaggagcatgcacacataagtttctttaaacaattaaatcaaaggaaaaaaacacatttttttcactaaatttactaaacagatgaaataatatgggacagattaaaatggtgttttgcacaaactacctttttgcattttgtacaccataaaattaggaaccaattttttggtaatcaattttggaagcacttctagtaatttaattttcaaaatggtttaataatttaaaaacaagaaaaaaaaatccatggacaaactgatgcatgggagtaatttttttttttgttttctttgccaaactaacttgacatgccctcatttgattttttgatgatataggagtatcatttatgctgttgaactatatcacttacacgtggaccagtggtggagcccgtatcttcacaatggaggttcagacttacttggctccattctaaaatgtagctatttctagcacagtaacttgttccaaaatgaagctatttcttcacctatcttctcttctccaccaatcacaactctcatccaatcatctctacctactttcttaatatctgtgactacctataaaaatgcttacattatggcaggggtggacccaaggggggtgccgggtatgcactagcatacccaataattccgaaaataagttaacatgtagtaggtattaaacatctctgtattagtatgtctaaatgtttgatgaaagctttctcgtgtggcaatacaccaaggctcaataggcccagctggtggtaggttttcaatttctggcgttatctccatctcgctagcctcgaccgtgccttgtggcggcacagagtgcagacgaaagcgacgagcgaccatcagctaataaccatgtactccctccgtttcataatgtaagactttctagcattacccacatacatataaatgttcatgaatctaaacacatacatatgtctagattcatcaacatctaaatgaatgtggacaatgctagaaagtcttacattgtgaaacggaggaaatagtatttcacttttttacttcctctgaatcattgatatatcctctttctctagatgactacatttgaaattgaaaattgaaatacgaaatcattgaaggcgtgtttcatgatttgtaggattaggtaaattgaatcagtcaattctgattaggaacatgggcatttctttattcagcaagtcaccgaaaacttctgattctaccagttctacattacccatgtcttcactcctgtcacggtgatgaggaaattccgaacagggaggaataataagtaaagaaaataggaattaattggaatttgtgctgtccattcttcttcaattccatctcagggtgcattatcgatccaatgctaataatactatttgtactaatacttttgataacctgatgcctaattgtattagcgtgtagggaggctttaatttggcttgtcacatgggcacaccgacgacaaaaaacctgggtctgccactgcattatgggacggaggaagtagatgacaattgacaaaccaacaaagccagtcgcacattcaaacaaatcaacaagataattcaaatgacatatatattacaaaagttcaactggtttttattgcatgcacttgtgtataaatatgggtattatgtcaaaaagtttgggggtatagatgtacccccatgaatcaccctagttcgccactgatgtgaaccatcccgaaacctaccaaatggtcaaaatgtgagatgaagaaacaagttagtggaaaaacatatatgtccatatttatatatttctcgatgaaaa

SEQ ID NO: 58655 - DNA, 1673 bp, Oryza sativa
aagagttattcatgatttatatttccaaggtttgacttaaatattattctaaacgacttcctttatgggtatggagggagtatacctctaggttcttgctagtttgatcatcttatcctatatatccatgcatgcatggctgagcaacaagcatagaggtaacagaattatagggccttgtttgattaagattactgtggagagtattcggattactctacataatatagaaataaattaaatattttaggaaataaacttaacagatagcttagaataactggtcgaaacaatgcagtgtagaagaatttttgttttgagaaaacatatttttcaaagcataactcaaataattaattttaaataatccagtgaataatctgaaaacaacgaggcctgaggtcagctaatctgtcctaattgcatcggtcgaatttaaaactcctgtaaagagtatctcgagccatttatagttcaaaagtgaagttagttcgtttacaaggtgttcgagctccctttttttttttgagagagaagatagattttgttgctagctcgttggtctacatgcatggaagatatcccatctttcaaaatgttctggttggtcttaactacaatctcacacacgagaacatgattatgcattttaactattgacccccattaatttttgtcaactcttatatatgggttaggagtactgcttcttgttataaaggaaatgaaaaggtccgaattaccccattaaactatcacggtcgtttgagttagcctctaaaaatactagatattttacaccctcaattattcaaactggacaaataaccctctcattcaatccggagtggttttgttcatggcaaaatttgctatagggcataaaaaaagcgtaattagctggtggacaccgcaagaacgcatatatattgtaggacactataaaaaactgataattagctgctggacacttacgatattatttattatttctgatagaattggagagagaaatagtaattaaagacaagtttgcccctgaccgaacttatttcaatccgactggttcctgttcaaaccagccacgaggcttttcgcagtaaatcgatgcctgtcgcaaacccgacgagtactggcggcaagtgcgtggcgcggcggaactcagttgccaaatggaggtacacgttctctgcaccgtcggttaatcaactaatcaagttgtcttttggtgacaaatatttcctagtgccatagaccaactagcatcagagtggattataacagcaggtgcatgtatcgtcgcagtggcagtgcaggatcgaggaggaagaagcagccaaagggcagtaatggcgcaggtggagaagacgggcgcgcgagagattttctcctctgcatgtggaatctcctgctcgctttatcccgtgcgccaggcacagccctattcgcgtccgtgcgtggcgcgcacacgccgtggcatgccaattaccatgctgctcgcgtcgtatatggtgagagaccgtacgtcgtgtgggatgagacgggtattgtcgttaatggtggcactggcatgcgcggcgacgatgcctctggctgcttgggccgcggcgtgcgcgagcacatgtgcgcagcgacgacgacaccgacgacgcggcatgtgtcatttacgtgct

SEQ ID NO: 58656 - DNA, 816 bp, Oryza sativa
agatggaaataagctaaaaatctaagtgtttgtttcttctcaaccattgctagccttgccaattttttgctatagcaagatttggtaagccaaaaattttggtagagttggttgtttggattgctaccaaacttaaccaatccaaaataattggcattgccaaatttgtggctacaaaccaaataagggacataatttttggcaacgcaccaaacagcccctaaatgcttaacatcatcctgacatattcctgatacgagattaacaccacctccttatcacgcgtaatagttaatttcatgccactaaaacatgataccaactttcgcattcttcagttgcaataactgaataccaatgatagaaaaccatgtgatagtattattctagttttagctttgtcacatggagtatttttttctctatttctagtgaggcagtatagtacttagcagtagcagtagcaacattaccaatggattagcacaagagggcaggcaatgccctttttgctaagttcttgctattggtttgttctcagaatttagaggcagagcagctcatcgcagcgcaattgcctctctcaatgaagttaataatatttacaggcttgaacctatcgtcaatttacatgttatcagtgaagttattaagatgaaattggaagtctcataatgctcatacttgagacttattgagaaaagcatggcaagaataaagctggttgggctcaaagctgacatacaaacaagcaactacatatttactttgctaaagacagacagaatgcctatgttccccttcatatttgattga

SEQ ID NO: 58657 - DNA, 7630 bp, Oryza sativa
  unsure (1)..(7630): unsure at all n locations
gcaaacttgagcgactgcctcgcatacacggctccaggctgcattagcatcagcatcagatactagaagggccaggccagcacgtcatgccgatgcagtgctcgacgaaatgccggtgcaccatctggcaggcatgagagcgagcgagagagagagagacgagaggggcggcgtacgaagtgggcggcgatgagggcggggaagagtgaggcgacaagcatgccgtgcacgacgcggccgcggccgaaccctcccacctggcgggcgaaggcgtcgtcgaggtgcaccgggttgcggtcgccgctcaccgcggcgtacgcttccacctccccatccgtgaagcgccgccgctcgcgcagcgtgtcgccgaccttgaggacgagggaggacggcgccgccgcggtcgtcgccgtcgcattgcagcgcgagagggatgatggccgccagatttcgcgcgaacgctcgcatcgatccacccaccgattcctttcccttccttcccccactaaaaaatgttgtgctagccaagcccaggggcggatctaaaatggggggaatccgcaaacttttactttatatttntattaacgaaaaacaaactggttagtttgcgagcaatattctctatgaacatgaagctagggtttacgcaaattcgaaaaataagaagtaaagtgcgtggttctagagatgagaaagaggatgggctgggcgctcaccaggatgcctgcgcccttgcttgctcgcgggatggatggggatcggcggcggcggcggcggcggtggcggcggccgaactcgcgagtcgacgacgagcggacgccgcacgacgatttcctttttcgtcttcttttatttatttttttttcttctttcttgagaggatccactttcttctgggactgtagtacctacgtactccctccgaaaaaaaaaaaagacaaactctggtctaatgtttgaccgtccattttatttaaaaaaataaaaagaaaagtcacacataaaatgttaatcatgttttatcatctaacaacaatgaaaatataaattataaaaaaattttatataagacggacagtcaaagttgtacacggaaacccatggtttgtttttctttgggacggaaggagtaggcggcggcgtgagtgatgatgctccaagatgcaaaccaatttcacaatccacaacggctttttttagcccctttgaaattgaggattagcaaatgaattttagagaatttattttctataaagcctttgattcataagaagaggatagaaaatttttcataggattgcatttctaccgtcaatttcataggaaaataagcaagcggttagacctcttgtgaaacttttctttgttgagtgtctcttgtggtgtaatcaaagagtttttctctctgtttaccatattttcaatttctataatctactttaatttctacgtttttcccgttcctttttatagaggacctaaaagagagagttggtgaaggaattggttatgggagtttcatttttatcttttgttcggtaataaagatgagtatcatgtaaagaatgggtgggaattgaattttaagtcatgatataggactaagatttatctcaaaaggtaagcgtttgctcttaaacccctcttcccaatctatcctagaacttccatgccctccaaccaaacaatagatttaataactctcgttccccataacaattcccccaaccaaacgcgttgcaagtgctctagaccctgtttgattccgcttaagattattaggagtaagctgaaacaaataatagcttattatgatatattattacaatctacaagccagatttctataatctagtaatccactttaaaggtgctttttagattattgggtggctaacaactaacaaacatctaataatactgagaaacaagcagcttatagcttattctatgccggcttattataatccagtttatagtaatctaactcaatattttattttagattacaataatcttaagctgagctgaaacaaacagggcctaagttagtgggttgatgtgaagcaaactacaaagaacttccaacagttcttatgtaaagcgcgattttggtcggttaaagaatatgagaacattatatgtaagtccaatcgctttgactacaactgataagtcgtaatgccaactcaaaataatttgttatttatgagtaaaaattttatacgtgtgctatagagcttaaaaactggtgttgaaaaactatttatgacgaaataacaatcaaaattaactctaaaataagttttaaaatttaagctttggtcgtggctaaaaagcaaaggatggagctgccacaaaatcaagggaaaattgcagaaaacaaaaggacaacaaaaaaaacacacatcagaagtcacttgaaatttaacatttcaccgcataaatcattttgttgcaaatatcaacctccctatcagttttgttgtaaaaaaacactttaatgcactcatgcttaattgaatcgatcccttatagctgaatagcgaatctcaacgcgataacatttaagctctcatcaccatttctatttgtggaatctccgaaaaagtatccagattatactttaaaagtatttaatttggtaaacaccacattgatggcttataatttatgaaaacatgttgattcagttaaacacatacgcactaaggtggattttacaacggaactgagtagaggtgggcaattacaacaaaataacttatgggatggaatatcaactttaagtgacttatggatggtttttaaaaaattttcctccaaatcaatattgctaagccatccgcaacatacaataatataatatagtaaaggcaaactgattctacagcatcgtaattttgcgattttagttttgtaccacaaacaaaatccagtttactttactggcaccagaagttcccatcactcgatcggtgatctgtaccacctaacagtcaaacttagatgatctctcaaggtcagtgttcacaattccagtttcacgaaatccgtgtttggaaacgataggaaaataaacgataaaaaataatagatcaatcacagaagacactggattttggaaaactctcctaaaacagaagaaaaaactacggcgccagccagcaaaatatcttcactatatcgaggtgaggttagaacgtcgaacggcgtcttacaagagatatatatgaaggtgaaaccctaaaaggataatgatccggcccaagcctccgcttcattttggcataagctagcctttattatgtgcaaatgaatttaaatcacaactcaactatccggactttctagatcagtcaaaaatgtaaaatcaaaggtatttttaattgttattctgtgatgaacaattggcattggagattattggttttgttatttggaatttatttgcgaagtggttttggagatgattggatttcacatgtgagtactgctgtttgttggaccggtcagaccgggcatgtgctgccggtcagaccggtgcagcccgcggtctgaccggccgactctatgtcggtttcggtttcgggttatttgtttggatatccgtgattgtttcatgattatggcttctagatggatactatgcgtatgtaagactgtcgttagctactaatgagtcaagttggggatagtttggtctcggaatatggtttctttgtttgttctatgtgtaggtgactcgggatgccgggagagtatttgcgtgatggaccgggagtcagcttggggataagacgacgtccgtggtggtcagagatcatgcgggatactaagactagagttcaatacacgtggttggtgaagattccatatggtatacgatggaggtattgtgtgcgtatgggatgcggagtcgaatttggaaggagtccaaatttggtatgattggttatgtaaagtttatttcttctactagagggtttcctagggtgattaggatttctagtatgattttggttcgtggctttaggttgcttgcctcgggtataaatagagggggagcgtaaggcttcccagtatcgcttttgaaagcaattgagttgatagttgaataagggtttcgtgtttagtcgagatttttgtaaggagtgctgttggtgcactttgtaaacacagagagaatcaataaagtcgtcatccactttaagagttcttcgatctgtgtttcatcgggtttcggcggcataccggcggttagaccggcggcaagcaccggtcagacctgcgggcgcaaggcggtcagaccggcgacgtcgacaggcatggcaggcgatctcagggtggtcggaccgatcgatctacaccggtcagaccgacggcacaggcgcggtcagaccagcaggacaacttcggtcagactgatctccgtcgaatttgagggtaacttttatttccgttaaaagtttcggtttttgagcataccaaccattcacccctctctggttggcttagttcttgtagttcgatccaaaaaaacacaattcacttggtttttcggtcaaacaaaaagtattcaaactgaattttaaattttgacacaatttattcggattacatcagtttttcagcttttcgatggatttcacagtatcatcaattttcgatggatttcacagtatctgatgatactgctcatgagcggatttcgattcagggtcgcgattgtgaaccctgctggagggagtcttttacccctatgccattaagaaagttggaggttacgcgtgtgccacaaaaaagttttgagtctactgtatgccatgacacaaactttcgtttacccgtgtgccattccatctaccttctgttagcgaatgagctctgacatgtggaacccacgtatgaaaatgactaaattgcccctgaagcattttcatctctactaatcctctcccgtgcaatttctccagtgtgcctcggaccctagcctagccgccgccgcctcgcctcgcctatccggcgacgcgcctcgtctatccgccgccacctctctagccgccgccgccgccgcctcgcctcgtctatccgccgccgccgggcgtcgccgccgccgccgccgatttctcttctaaatgttccatccaaagtggctgaaatagagcaagggcaaaatagatctttcaaacctccgttagtctccgttagtgctgattccatccaaagtgacgcacgggtaaacgaaagtttatgtcatggcatacaggagactcaaaacttttttatggcatacacgtaaccttcaacttttttaatggcataggggtaaaagactctgctggaggcacgacttacacgcaaaatgcgcaattattctctgaaagaggatgaaccacgtgattaacacaaccagccactaataacaaaacacgccttcatcaattcgtaggccgtagccagctcgagcatgctggcaaattctcgcacggtctgacgaaatcacatgaaagatacgtcaaacgcccacagcaacaatccacgtctcatccacccatcaattccaccctcctcccaacggcagcaattcctcaaaaaactgagctgaaatggacatggccaagtaaacaacaacactggtcagagttaataacctataatcaattgtcgaagcagcaagaaagggatggaagagagagagagagagagagagagagaggagtccatgtccaacactccaattgtccatccagttaagaaaagcagcagcacaagctgcacgagtagagagcactatcttggctagagaacaaagccagattccttggagttgtcctgccttctgaacaagaacaggccaagacagaaaggaaacaagctcaaacagaaataggagagagagattgagagagattggagggttcttgctagctttggggtgctttctttcttgcttttttgcttttcttggcgttttcgatggccgtgagctgaatccggagccttgcctgacacccccaattttagctgctgcttaggcagcctaatttggggattttgtctcaggcagtacaaatcccaaaaccaaattcagagactttgttggctaggctgggttaatctcctccccggtctggtcgattcgaagccatggagatatagcctgcaagcttcatggggctggagcgagctcgtatttcttgatgcaagtttcagcccctccaagaacaggttcaggttcttggccataatcttcttgcagtcaaaaagaaagtctcaatttcttgctcaaatgtttggattttttttattatcttttttttttggtgatcaaggtaggagagattatttgtgttccttccattgctggttggttgctgcagtctgcatgtggtggattcttgggaagaaggtggtggtgaggtgaggtgaagagggagatgcccaaggtggccggagatggcggcggcggtggccggaggagcgaggacttgcgcgttgttttcctcagggtcggcgccgccgtcgcgctctccgtcgccgggctgctcctctcgcggcggcggccacggcagcaactccggttacctcctcctcctcctcgctcaggtatcaacagcagaggcgtcttgttcaacgtttttttttcatttcgggaagaaattccagattttcagatggaaaacaaaatgaaatttcaacgaaaaattggaatatgaacaatattttggctcaatttcaaataaatttgattcgttttgggccggaggaacattcggacccaccggtcaatctgaatttttgggaatttcgttccggaattgtgaacccgttgtttgttgctgattgctactcctagttagaaaattttggtgatgaatcgtttcttgatgtttttttgcagattcggatggaatgaagggtggtggagggctcaaggatgagctgaggatcctcaagaatgtaagaatcttgtttgcacataattattataaattgtatatattaatgtacttttcatacttccatttatatttagaatggttcagttttggatgtatggtcttgaactgttcataatccagctatattttcctcattatattataaattctctaagtctgtccatatcacatgcatttggggtgtggactttgcttttgttttttaatttcaaccttttttcttctctatttttttagtctcatactgcttgtttctattccagcagtttgacaaaatacaacttgtcctcaaatgttaccattgtattccatttttcttctccttatgttgaccctcttttgttttgattgtgaaggaggataccaaggccaaaatcatcaatggaaactctgtccacactaccactaccactacaacgatgaccaccaccgcgttagtaccactgcccccaaaatgtagaactcttgatgatgatgaagaattcctcctcccagaattcaacgaaatagttctcaaagaattcggccgagacatgggcaacattgcaacctcacctgcaccaagggtaagcgaagaagatgcaacgaagaccccggaaatttttgagcttagagaaatggtcagatcacttcaagaaagggagaagaccctggagctacag

SEQ ID NO: 58658 - DNA, 784 bp, Oryza sativa
ttcctgcagcccgtaagtaatatgtctgcatccacgatatgaaagataattgattttttgtacaatgattacccatgatttgaaagacatgacaattacatttacttccatttcttttgatgcagtgataaataccctcaggatttctacagattagattctcttgtgcaacaactcaaaggcagcggatccaggtataaaactggggcatatgcccagaacacagagtgaacaatattcttttacaggtctcatcagtgtaaaatcatgtcttaggtcttaaataaccaatataaaaacattcaaacttaagaatgcttattgatgtgaaatgaacaaatattatttgttaatatgaatgttctcaccgaaagcttgtcatctttgcctgctttatgtgttcaaaattcgctaaagttggcctgtgtttggcgcagcattggtgcactgaggatgaagaatgagtgctctgtgttcaaagtaaactgcaatgacaggaatctggaagggtatgcatttcattgactcgtccaacttgttcttcacatactatccaatcatcatgcaatttcctcacatgatgtgatgaggccatgttctctttcagatgccgcaggtctcttcagaagatgaagagggagcatgccactctgaagcagaagctggaatcatattttcaggtatgttgtactacatccttgactctctctctttctgtttaccttattttcagcattgctacatggctaaacaacttgggtatctcctgttccttctgctgatg

SEQ ID NO: 58659 - DNA, 1763 bp, Oryza sativa
ttcctgcagccctgtcttcagaagtcctaaaaatatcataactttgctatattcttcataagtttatactagtagtaataatttaatcataaaaaaatgattatctatagaaaaagaaatgagaggacaaaaaaaaaagaaagagaaacatcagaattgcagagggccaagccaatcatgggcttggtccataggcccaagagacaaagcccaatccatgggcctgggcttccctttccctccgttttatctactccgatgcacgcacagcttatccgattccatccattcctcaagctctcactcctctctcgcttccatggcgctcctcgccgtccacgccatggccgcgtccccggccaccttcccctcctcccaccaccacgccgccgtctcctcctactgcgcgctccccgccgccgccgcattctcccgctcccgctctcgcgtcgccgccgccgccgccgccaccctctcggccccgctcactccagttcttgaaggtaactgacatgcctacctaacctccctgtctctgttttgttcgtcaattcggattagtctggtgtgaaattggctcgatgatcttatatgaaactgcttttcaaatcgtattgcacgaattcaattgatacagcaccaaaacatagattgaaacaaaaacctcgcagtttgaaccaattacgattccaactcaaattactccatttggtgtgaccagtttactgcgggagaggggacaagaagaccaagaggggaaaaaggttcaaccactcgtacggaaatgtgagtctctagcacaaaaataaaattaataaaaaaatcatatgcttattgcttcctgtgctgctgtttgctgcaattcttcagacttgccatctgctgactgctgtttgctcatctcaggcgaggccgcgcaacaagaagaagggaactggccctgcacggctgttcgcgccgcctgcgcctccgaggaaggaccagttcgacgacggcgaggtcaccccgatcgacatcgacgatgacatcctggaataggttgtctgaatttccccccttgaattatggtttaccttgagcttaccttttgtctagtctgtaccaaacactgtttcttgaaattaattacagtacattacatggtctcattctacataatgtagatgcctatgatttctttccttgtaatatatatgaatggtgctgcttagagtcattttttatgcattaccagctgaagcagaacataagtacagatacaatcaccaaactttcatgttcttgctagaaaccagggaagatgcagtatctcttttttttttcttttctagctgtgtccctgaattcaagcaccttttgacatgcttcgaatttgttgtgatgatctgggaagcagttcttaagaatcaactaataaaccagtccatcagatcgggtcagaaatctgccccttttttgttgttttgtctgttgactctgttatgcgcttgagttttgacacaagaaattgttttgatgatctgcaaaacatattcctttaaagctggacaacaaaccagttcaactggtcagcttggtggtaattgtatgttaaaattctgtcattttttgttgtttggctgcaagtttgttgtgagctgctccccccgcccacaagggtaagcaactatctcgcccgaaatatactacaattttggcccaaactggaagtgtaaaccctgctacgcaatggctttaagaaccctaaaccctgaagcatgttt

SEQ ID NO: 58660 - DNA, 1742 bp, Oryza sativa
agcatataaaaaataaagggggataaatagagcagttgtcagttgtcacttttactcaacttctgttactgttatctctccgaacctagaggcaacatcacttgtcttccactggactgaaaccagggtccagtgtgatgccaacctgctgcaaggctgcaacctattacaacaactgaacctcatgaaacaagacattttgcttttcattttgatgcattttgatttgaagaataaggttttaccctgattctgttaatgaaaccatcatttggattacagagtttgcaaccaatgcactagatttttatattaagaaatactagggttcattctcatttttttcaatcaacaggacaacatccatagtggtaacttgacaagatgagacaaacaatgcacaaaacatatattcttgaaaaaggaaaaatagtaacaatacatactcgatgttgccgtgcaagtttctagtactacttatatgtaccttaagcaaacattgcatattaatggaaaacatgtctcagctattttcgcaatgcagaggtggtctgaataattctgatcctccatatacattttggcaatgcggtatcttttttgagacagcagttaaaatttcatcaatctagccaccaaaaaatgtctcctcaaatcaatactcagagaacttaaggaaaaagaacatgaagttttttggataagccagatgcacatctgcactacacaaaagttgagccctaaaaatctcatatttagaccacctcatgagcccaaagctccaaaagcttggggttccgagttgcaattcctactatgagttccgctcaaagcataagttataaaacccaaccaagaaattgtattatggtcagttgctgaattgttcagattgcgtacagcgtacattttggtgtaaaaaggtgctctgctacactgccttttgctaagttgctggagcatccaacagtatagattcacttaactgctctttgttgtgctcattccaacaaaatcatgaaccatgggttatcgcaagtgcagcaaggcatcgtgtagtggagaaaaggaattcagtgtgatttggttttcacattgctatctatttgctagagttagtggaataattttaattgatgagcatgataccgaggaggatttattaatgctatatttttcagttacaaattggggatttttggcccacggcaatacttgagatctcaatatataatgggtgcaatacatgcatgatattaggactgatggatgataaggttagtcaatggtgttttctcatggacaaaagatgctcaggtttttttaggaattcaatcattgatggatgggatttagatagaacttcatcaattgccatgtaaatctgagcttatgctttggtggaatcaacttgagcagacatatgagttgatggatgggatttagatagaacttcatcaattgccatgtaaatctgagcttatgctttggtggaatcaacttgagcagacatatgagttattattgttaaggagggagaaactattaaaccttgatgtggtcaatttcggtttgaactatctttcagatcatctaattgagctaaggaaggtggtcaacaacagttatcagatggcagctgccctagacttaagtggtgccgaccctgcacggttgaatcaaggactaataagccgtatggtgtattagcaaaacaatgataatttgtgggtagcgatttt

SEQ ID NO: 58661 - DNA, 965 bp, Oryza sativa
actaatgcttgatgcaaatttatctcctgattcacttgaagccgcctgcaaaagtaggttattccaccttatttctttacttaggcagtgagctcctaagcttatgtgataggctgatatagctgatactagtatgcatttgaaccaggtagaataaataaaggggttacctaatttgcatgcatgcggtgctggatctttgtgtttcctttccaacaagggttgcagccgacaccactttttcaatataatagcatctgtgtggctgcacctaaccttcccttgcctgcaaacaaggatcttttgttgtcttgtgccaaccgatgagaaagtcttctgccagaagaaatgaaaaagtaataatgtatacaagaaacatttttagagatatgctgtttgcaggctttttatttttagctctatgatataatcttacaaaaaaaacaagaaatcacgaccttacgatttgaaatttttcatctcaagaaaatcatgagctttcagcttgattccaaaaccttttagctcaagaaaacatgagctttcgacttcaccttgaaaaactttcaactcgagaaaccagcagctttctatatccatttggaaactttcaactcaatttgagtaatttggaggttttaactcaatatcaggaattctaagcatctttgaaggctagaatgaaaatttgaagtaagaaaatcaggacaatctctgcaacactgtggaaacgtgaaacctaaaaatttcaaactttcaccttaactctgaaacttttacctggaaataaactttcaaactttcaccttaactaatttaattttataactttcgaacctaataatagcagaaatctgtaattctatcaaaaggggaaatgagtgagaagaatgttcttgtcatgcactattggtgttcctaaagagatttgaaaaataggtgcctttatgttgaacctgtcaatg

SEQ ID NO: 58662 - DNA, 911 bp, Oryza sativa
ggaaagcatccacctcgcatactccggctctgcatagctcacgcggagatgaagctcgagcggaggcaacggtgaggaggctgcagcagcgatgatgaacgactacaaggcagtgaccggtgaaccaagacgcacttgtgactcgacctcctctggtcgacgacttctacttgccgattgacatgcttgtggaggagagaaccacgccacgcgaagaagggattggtgtggagaccaagctgcggcatcggtggggagacgctacagcgaggtagcaggccgacaggctggtcaccggctgcatgccatgcacaacgtgggcacttgtggcccaccagccgcatcttacaatagcggacgtgggcacgcggccccggtgctaacctgcacaacatctccaccaccacctccccaggacaccgccaacgccgttccagttcctccatccgtagcacgagcagggataagcagatgtggccctgggcttctctgtcctaccacgctccgttgtcggcgccgtgggggaccagtatctgccgctgccatggacttcttcgactgcctccaccattgacgcctccttggccccgtcgctctcgcctttcctctggatttgaggccgccgccgctgtcatcctgggattctttggccgaccgtgcaccgccgcttccctgggcttctccggctgatcacgctccaccactagcgccccgggggtctagtctctgtcgttgtcacaccaccgccgctgcctccacctcctctgtgctcggttcaaggtagagagagagagagagattgagggggggggaggaggcagaagagaaggggagaggagtgctggagcactgacaagttggccatgtattttttaaatatttttttagccactttagaaatgtcatttcag

SEQ ID NO: 58663 - DNA, 5727 bp, Oryza sativa
  unsure (1)..(5727): unsure at all n locations
tataatactgtggaaatggtttttattgtggcttaaaatcagtttataaactgtatatgattgagaaagatgctgataggggaaaaaatatggtaagcttccttgcaagaatgcttggctctggattgattcagagatcgatgatccatttgtgatggcctgatcctttttcacaggactgacaaaacatgcatgcatggatggatgccaaaacctttgcagtttgcagtcaaagatgtgccacagtacttaaaatgaaatatttgacaaagatgataatattactgaatctagttttatacatgctgaccattcactggctacagttgataaaatgccgttttttgcttcttgatcgacctcagtcatatattgacagtagcaccaactgatcagagaataatcacatggttcttgcagtaagtaaacctactgattagagggtaggtcatatgtatctttccaactgacagggtataaacggaagaacagtactgttcagagaatttttagattttttagataattaaccactgcagtcaatagcaacctctccagctgtcaagagaggtcctaattaactacactgattttcatcagaccgtatatcaaaagtcctgccaaccaatttgtcgagactatgcatgcatgtaattcgcattttttttctgacatgagtacattcttagaaacatatatatttacgacatgaggactcatgattcacattttggacttttgtgtctttttgactgatactggcaaaatgccagtacattgctacgtacggaatttaaaatatcacatcggtacattccaaaaagaaaaaaatatatgttaaattttagtctttagagcctaattttatatttagttagagttttttttatcttcttatattttagctataaaaaagtttaagtggattcaactgacttacgttattgcatacgttccatcccttaaaaaagttgcatcgtcaatccataaaaaatatagaagatggcagtgtgtttattctttctttcttttaacttcagtaaaacatgtctaataatccgcaactagcttatataggcaagtcttagatgtttggtggtagggttataatcgcttcttacttttaatacaagataatccaacaaatgtaattgatatgtgtgagttcgatatcgtacaaacgattttgtcccaaaaatattattgccgttagggttttgtccattccgtgtcgttaaatatactattcatcctatagcatttaatggcacgagatggacggaagtctaacggcgatggtatttttaggacaaaatagttcgtacgatggtatttattggaactcacacttgtcgatggtatctcttggatttggacgcttgtcaatggtatttcttggattatctcttaatagaatcaaccttgttttagaaaaaaatagcatatgtttattgattgagcacacaaatctactacgagaatatgtgtcaaacatactaatcctactaaaagtttgaacttagagttggaatatgtgtagcatagagttaaatcggactctatcatagattcactcttaaatagagagagtgacaccacaatgtaatcatgacaactacaatttagtgtaaacgcgtagggagaggatagcgcggcgagcccatggactcgtagcggttatgtgctatgttgattggggaggagcacctataatcagaggcctaaagatgtaggttttcactaaacttcgttaacaactattgtgtgttgatgtatcgtcctttagtgtatcttaatggatgatcactgtaccgactaacgtttataaaccgaactaacgaacacccttttccccaccaaaagaaacaacaaaaaaggcgtaacagacacgtcccgcgaatcgtagagggacatgtggctagacgtacgaggtgctggctactgctccactcgcttagagcaagtttaatagatcctagttagcaggcggtaacatgttccacatcatcaaaatcccaggtggaggagtgagaagagacgaaaaagggcggagcgggcggtccatttatcgcccggctgaagcgtgccgtacgagaaaaaaaagccttcttgcagcccgatgcgagcgtatctgccggcgcttcgttcctcctcctgatcccgtgcgtttctctgccccttcgccgttcctcctccccgatgccagattccttcatccgcgtgccaaattggcctcgcctcccgccaaatcgatgtataaatcctcaatccactccaaagcaaccgagtttgcccccaaattgtctcctcctaaaccctagatgctaaattcgtcaccaacctgcagcaagatggggcggcagtctcaaagggcatgtgtgccgacgcctatggaggtcccgtcgccggggaatcagccgatcgcgccgccgctgccacctcagttcatcgtcccgccttcgtttgcttccacctacagacccggtgcattgttccctgcagtaataacgcagtccatggcgccctcgtccgcaccatgttggttcaccacgttgcagcaaccaggcatgactggttcgtcgactcaaggaccttggttgttctctactggaattagtccatctacggagaatgctgagcgccctgatatccatgcgttgtatgatactgtccctctcttctcaatttttttggttgtttaattttttttattctgtatggatgatttttctgcataatcgatgacatggtagtagtattcagccagcagccggcaaaagtattagcatcgctcttacgtcgcccgcgtgggccgtagtgcatgtgcctcatgcccacacgtgaaacggcgccgctcatctagatatttctcactttagtaccataccggtgccaagcagcccctgggcccagttatatagcttcctcctcccaaaattaataactcgtcccaatacctatatataaaggcctgatcagtgatcaccaccaccactcgcttcctgctccctcaccccacttccacttcatcgccatgagctcgtccttcctcgggccattcaccgattttgactactcatccgtgctcgccgccggcgacttttttgccggtcaccatcctgaccagccgccgtcgccggcggaggtggtggtggccgtaggcggaggtgatgccagtgggaagcggagtttccaggccgacgacgacgatgccatgggcgtcgtgtcccgcttgtccaagaggacgaggaaggcgccgtcgagttcgagctcgccgtctcacagcgatggcggcggcggcggcggcggcgaggggaacgagccggcggcggagaggggaggtggccggcgggtgtgggtgcgggagcggagcacggagtggtgggaccgcatgagggacccggcggcgtgcccggaggcggaattccggcgagccttccgcatgccgcgcgcggtgttcgacaagctctgcgacgacctggccgccgccgtcgccaaggaggacaccacgctccgcgccgccatccccgtgccccagcgcgtcgccgtctgcctctggcgcctcgccaccggcgacccgctccgcgaggtgtcccgcgcttcggcctcggcatctccacctgccacagcatcatcctccaggtctgcgccgccatcaccgccgtcctcaccagggtcgtccggtggccggactcccacgccgcggccgcgtccaggttcaggccttgtccgggatccccggcgtcgtcggcgccgtgcacaccgagcacatccccatcgtcgcgcccagggagaacgccggcgagtactacgaccgccgcctcaccgaccggaacaacaaggccacctactccgtcgccatgcaggccgtcgtggacgccgacggcgccttcaccgacgtctgcatcggccaccccggctcgctctccgacgccgccgtcctcacgaagtcggcgctgtacgcccggtgcgaggccgggctgctgctcggcgacgacccgcagtggctcgtcggcggcgcgagctacccgctgacgagctggatgctggtgccgtacgcgcagccgaacctgacgtgggcgcaggagaggctcaacgcgcgggtggccgacgcgcgcgcggcggcggtgggcgcgttccggcggctcagggcgcggtggcggtgcctgcggcggcgcgccgaggtgaagctgccggagctccccaacatgctgggcgcctgctgcgtgctgcacaacctctgcgagcgcagcggcggggagctcgacgccgacctcctacacgacgagctcgtcgacgacggagtggtcgccggcggcggcaatacagtgcgctccgccgccgccgaacaggttagagacaggatcgctcacggtctcctccatgccggcaacactgcttcgagtagctaccaagattaccattacgggcggttataggtgttggaatataaagtgaattgtccatcttttcttatctgtttaatcttttgggttgaactgatccgtgtatgcaactcaataatagataaccgccgctagtaggttcacagccgataaccggttaaagcctaattggagggaggttaatttctagctatcctgattccataagaacatatgaaattatatatttatttatagtttaaggtaaaatttagaattatttctgcatgttaccggttacaaatttaattattggatttgcatttttatcggaataaattcagtaaccggtggtaattaatcaacttgttattggatcgggatatcctccgagtctagtaattattctagataaaccagtgtttcggaactctggtagatactttgcttatactataagaatttgatcaatttttatggtgtacaaaggttttataggacaaatgcaagattgattcgatggatctcagtataatgtatgtctcatgtgtttatgattgtaattgaaatttgaataattatcagaacacaaatttcatctaaatcttatattatgtttgtatacggttcgatcttatactagacatatatatccttgaactcaaatttcaaaaagggctacgttcactacgccagatccttgcacctgtgacggcatatctgtgacgggcataagtgctggtcagtgatgagggtcacctttgacgggtcctacaggatgccgtcatcggtgagccatcaggaggtgacccgtcacaggtaactagtcacctgtgacggttcaaaaatgaaacccgtcaaaggtgaggtaaaattacatgtgacgggccaaaaatatttagcccgtcacaggtaactagtcacctgtgacggtccaaaaacaaaactcgtcaaaggtgagataaagtcacctgtgacgggtcaaattttatgagcccgtcaaagatgataaaaaaaaaaatctttctcataaccctcccctctcatcccggctcatccttatcctctactaccggctcatccttatccatctcaaccactccccccatctctctctccctctcaaccctctctcttcatcgacctgtgtcggaggcggagacggcaccggcgccggcgggtgcgggggccgcgtcgtggtgaccgacgtccgcctcttcgccctctccggctcttggggctcgtctcggggagcagcggcgcggcgccgtccatcgtccatcggcggggaccagaggcggaggcggcggcctncttcgcccacctccgaaggtcgccgcct

SEQ ID NO: 58664 - DNA, 4943 bp, Oryza sativa
gtgagggtttgggcccgtcacaggtgaccttgtccagtgtagtggtttcttttctcaaatgagaactatccggtacgttcaacaaattaagaaaagttttgcttgctagcacgcactactggaatgtataacagtatcatgctattgctctaattaaaatttctgaaatgattgaagatatatatcattttggagcccgccgggcaccatgatgccccaattaaatttagtattaattttctaacaagattaattaatactcgattggctttttttatgaccatttaaatatatttttgcgaagaaaccctaataaatccttaacatgagattggtttggcaatgcatgtcaaatcatcatttcaacgtgttccctcgcttatcctatcttactataaagttatcccccactaactccttaagattaacatgcaaagatgccacatcattatccactaataagatgccacatcatcatccactaattaacaagatgccacatcatcatccactaacaatcatcacatttaaacatcatgcaaatatactatatctttatagtttttataatttaagagcttttcaaattcaaacatgttaaattatcatccaacataattcacataatgtttcaaatacaaacatgttaaattatcatccaacataattcacataatgtttcagtgtatatctttattatgttttatgatatcctatatacttatatagttcatcctcacttagttagtgcttaaatgattaatctatggtccaaattatctctcctttttttctctaattaagtcatatcacatcaattgtttttagccattagatgattaatgtacggttcaaactatctccctactttttttcttccataaagtcataccaccttactttttaagtttgaatcaccattctacatactatttaaatttaaattatcataaaccacattaatttacttaatctgatgttatctagctatcttacacgctattttttttattgttatcatactaaatttccgcagtaatgcgcggggtttcacctagttccatatatatggatgctctcatgtaatcttaaggcatccaataataacatcttaagaaaaatcatccataaattgaagctttctctgatcgttatgattttatcaccggaaattacgccctttttccactcgggggtgatgcattaattaacggggtgatataacaaaagggttcatttttttatttcattttcatgtgcatatgacttggccgcgtgcaaatctctgcatgttagccgtgcaccgcagtaacagttggtgtataatctttatcgtcaaattaattactttatgataatatactacatatagaatacattccggcatgtcgagctgcaaatttaatatatccctaatttaatatgactggctgatttattttctaagaaacatagtataaacgtagatgctcgtaacacgtgcacacacaccctgtaagcacacatgcatatcttatccgtattagcacctctagaagactaagccggcttatcttgaaattggcgaagtcaccacaggtgcctcgttatcaatgggtatgtagcttaccaattaaaaaataattagccgtaattgcgagcacccgtgccatgtctaggatttaaaatcggatttaaaatatatatggaagtctaaccagtggctaaattttggatagattagggacgcgccggaacgtgcatgaagattttgattattcggattatgaataaattagccaaagaagaatgtacatgtgtacataaaacacaaggtaaaagcttttgcctttgcttaagaaaatagttgttggtaattagctttgctttagattcgcaaatatttgtatgtaatctaaaaagagtctaattagatggttcagctgccaataacggtagatcttgaatataccgaatttaaacatttccagtgtattggtacacagccataaattaatgcagattaataatagcattataaagctaaggcacaatttaagccacttggcaggtgaagtggtcactattgtagaaaccatctttatccggtcaggcaaaaaccacaataatcccggttccaataaaaaccgggactaaagatgggttttagttccggtttataagcaaaacgggactatgtgctctttagtctagtcctggttcatatgctgtcaggggctgccagcccccccccctcggatctttagtcccggttgataacacaaaccggaactaaaattcgatgtatcgtatataatccctaggacttatcctcccaaactcctcatctcctattcttactctctcttatcattttctttgcactatcctctccttccttctagctacagatggagcttatccttttcttgccttatcctctccttgcagatcgagcgaggagcgaagagcgaggacggcggagggccgcggcggccggcacgcggagggcggcgcccggcggcggccggcagggccattgcacgaggatggaagcggccggtgcggagggccgccgtggtggtcggccgtgcgaatttgttttttcttttatcccttgtgaatgtttgtttattgaggataatttgttcattcgatctatgattttagaatgattgttgttgtggatgatttgagattgtttgttgaggataatttgttcattcgatatgtgatttgagaatgactgttgttgtggataatttgagatgattatgttgttgtggattatttgggattatgttcttgtggatgatttgggatgttggaaaatgatgaaaaaaaacttagtcccggttggtaacaccaaccggtatctttagtcccggttatttcaaccgggactaaagatattttgtcccggattcttagtcccggtttgcaacccgggactaaagggggttgtaaaccaggagtaaagatggtttctcccccagtgggtaatgttagccaaaaagacacgagtctaattaaatggaaattgttatgcatccgattcaactatccaactcacacacgactgaatttgatcaacggttgcaaacgactacagtgcatatgcacatgatctcctttaattgatttatggtttcatgtttttagttgtacaactggatagtatgtatagcattactcaattaaaataatttcaaagtgaggcgtgagtctcgtgtgcacaaatatgtttcaaagaaggtacaatctcataaaaatgggaacatgtggatgctaaaattatgtggatgtcagtggaagatgctactgtcagaagaaatcggctggcaaagacttttaatacagtcttataataaatcactgtagttaattaggacctgtttgacagctggagatgttgacatggaacccaatggttaattcaaacaaaggatatgataagaaggtttccaagacatataaattcttcaacattgttcttccttcaagaaccaaatatacgactttagaaacaataattgtcctgcaaccaattactgcattttgtcaagaacaagtgaaaaggacattttgtcaactgtagccaccacattttgtcacgtagaaaaaacttgaaattactatctctgtcatttttcacacattccacacatatcaatataaaataataggattaggataccctccactttatcaaatcccaataaagttatcctcacttccaatgcatttgtatcctactttcataactccaatacaacttgattgcttaaaaagaaacttattgtgagaccaagaaaaagaggcaaaaatcaatttattttggaatggatggagtatgtaattttatcagctttgtcaaatagtatttccattttgagtatactatatatagcacacctttgaccgcgaaggtatatatgctcacatgttctgggagtcctgctaacaaagatcaaaatttgacaatcaactccgtcaaatggatcacctctgaaccaatccagagccaagcatctctatgcaagcgcttatcagtattattcggcctacctatcagcatcttattgtatacaggaattgtatcagatttgtagaatttcttcagcatttgcaaggcatcttgcaagttcttgaattcgcctgctgcaacaatctggcccttaaccctcctggcctatatatctttgttcagcatgaacccatgtgtattcaatttcagtgaatagatcttcagttaattattggcagccggtttttaggcaactctaagaatggaattaatgttctcgatcgcatatcacatatattcccactgacatagctgtgaacacaacatatacatcacaaccagcactgttaatttactcacttcttaaacctgtgttatagtgaaaataattacaattctgtcttattatgggaagaaaaggttgaagtaaaaactgcagttgcccaactctgaatttccttgacatccattatatttacgactagtacttaaaaaatagctatccacacttccacaaattagttgtgaagctaggatattcatttttttttaaaaaaaattgatccatatatgaatgaaattaagacaataaaatgaccgtgacaataaaattgttccgtacacgaactattcataattgtgaagcacaataaagtgacaatgacaagttttaaagtaccaatattagcaaaaatatgccattcaagatatgtcctaacgagccagctcatctctacataaatatcattgataaaagtgtgtaattaagctgaaatgataaatgtgtcaacttagggctgctaacagatggaatttttgtccatttaaggtgtattattattgtttcaattcaattttctatgcacatgcataatatatcaaatgattttttttgtttgccataacttaatggatattaaacttaaatactctctct

SEQ ID NO: 58665 - DNA, 2247 bp, Oryza sativa
  unsure (1)..(2247): unsure at all n locations
tttcaaatatgcgatgtaaattgaaaattaaaataaatttataagtagaacattttaatttgaaaagaatggtaggaaggtatgctaggaggaagtttgtcttactctcctaatattatatagattttaatagatagtaatataaatattatataatttaagttttcaaatctgcgatgtaaattgaaaattaaaataaatttataagtagaacattttaatttgaaaagaatggtaggaaaattatgctaggaggaagagaaaaggaaaaaaaggaaggatagtagaattcaaacccagcaccttagggctcacagttgaagacttcaaccaccaagctatcacagttttgttgcaatataatgcttgcgcatctatttaatctcatttggacctcagcaccaaatcacttggcgctgagctatgatgactcaacaaatttatgccacctcggattagagctcagggccaatgctattggcgttgggaagttatatctcagcgccaaggtccgtggtgctaaatccacggcctatttttggttaaagttttttttaagggctagtttcaaaataagttttttgaaaaggaccaatttatcaaaaaaaaaaaacggcaactttcgtgtggagtgcaaacattgagaaactttcggtcagctcgcacgacaggatcaatttcaatagcaaattaaagtcaacacaagtagtgtttacaacttgcctataaacttcgtaaccttgtacttccctatcacacatatattccctcagtctcaaaatgatataagcagttcgatttaaaacttttcacgaagagtaatgtcgacgtttgatgttgcgattccggtatttgcgtggtatggggatcgttggtaccaggatatacgcgagactgaggtaaaagagacagagacgaggatttttatacaggttcgggcccttgaattgtcaagtaatagccctacatgctgttgtcgacaacatgctcttattcattataatcacaccagtacaatatttggggtagtctatctaactgttgtcgacatggcggtatgaaggtttgactcatagttgacaacagggtaattttcctcctcgagtctgtgcctggcgagatcagagataacgctttcgtctctcctgacattatccggagacaccgtaggggactagccgtccttatccctgaagtcgatatccggtgtcttgtcttggcgtatgttggcttgtattggcttctgttgttctgtctatgttgagtgtgtcccctctcctcttagggggccttgtatttatacccatagatgtcccctgtccaagtagaactagggaaaccagtatggatacaatccgagtagttcttgtcgtttccatgtagaactctggttgtcttttcttatccggaacaactcctatatccgcaggttgtttccgtataggacatggtatgtggtgtgtcctgccgagatttagtcgactactattaggtatgtggtattcataaccctgacaagtaagtagagaggcgtaaaattaaattaaatatgattgtaattaattaagatgtaaaattaggtgaaaaaaaattaaataagcagaaacgattatgattggataagatgaagtcgagaagtgatggtatcttatgagttttacgagtaactttaatgttataaatagctactatattctagaaaagatgacgtaacaatatcgtacacgtacactgtaggtgaagatgattaatttatatagaaacctgacctgtaacgggacactactacaaaatatgaaataaaaaaaaaatgacatctttaaacaattatagataccgattttttttaaaaataaacctttaatattaaaaacccgcacctcctaattgagccgagctgacgggcccaccacgaacgacgagataaggccccggtatcatgaggagataaggcattcacagactcttgcaaatctctctccctcatctctcgactctctctcgctgctcgtggccggtggaggtggcggtggccgcgccgtcccttccgccagatccggggaggggcggcctancggcgggaggcggcatgtggcggcggaagggaggggggatgcagcggcgggacaagaggaggtggcggcctggcggcggcgccctccctccatcggatctgaatgttcttcaatgttagtgaatgatttctgtgatgttctttaatgttaatgaatgatttctgtgaaagat

SEQ ID NO: 58666 - DNA, 1758 bp, Oryza sativa
tgcgccccgtggatgagctcgatgcatcggctcaatgcattgagctttttattagctcacgagggtctcaaaggtgccggtttttaaaataggattggtgttagagcactcatcagtaccgcctccgtgatgccggttaggaaaaccgacatcttaaggtgtttcccaaccgacaccttttacgtgttctgtgttagtgggagaagcccgtatagtgtagtatagtcgatcgtctccaatcgatagaaatctcgtaatgtatcgtacatgtacactctaggtgaagaggattaattaattgggaattaaacctgacttgtaacgggaaaagacaggctagtgtagttcaatcggtagaaatctcataatgtatctcatgtgctgatgtacgtacatatagtgatacacacagtactatgtactccctcctaaatatagaaatttatactaccattctgaaaaagaaaaactctatctctactaaattcgtactccctccgtccccaaaaaaaaaaaaaaaaagacaaatcttgagtttccgtgtctaactttgactgtccgtcttatatgatttttttttataattcgtattttcattgttgttagataataaaacatgattaatattttatgcgtgacttgtctttttaattttttttataattttttcaaataagacggacggtcaaacgttaggcatgaaaaccagggtttatcttttttttgacgagggagtactgagtagtacctattctaattaaggttttatatattttcggtaagacacggagagtacgtcttgtctctctaggagaacaaaacaacaaagcacgcaatatttggatggaattgacagacgtacgttcaaatgagagaagtggcggcggccgccgggcggggtcggtggcggccgggctgggaggcaggaggaagaatcttttggtaggatttgtgttgaatttgttgtttagaatttgtgatgtatttgattgtgatgtgaataagtgatgttttgtttttaaatttgtgatgtaaccatctttgagattttgtgatgtatgatctgtgatttggagatgatttggggatttcacgatttgggatgattgatgtgtgatttatttggggatttgacgatttacggataatttgggaattgagtgaaatcaatatgcaaggagttaaaaataataaaaaactaaaaaaacatatcaatcgggacctggcctcttccatcgttaccaaccgggactaaagatttcatctttggtcacggttgttaacaccaaccggtactagagatatttcacccgagactatcttttgtcccggattcgtagtcagtgttagaattcacgttgtcaacaatcgaacaagtacacacgaacacacggacacgaaagtggagggcaatcaactttattgatgtttctctctctgttacaagtattactttgccctcaacctcactattgtatttatacccacaataggatatcctatatggatacatacatatatatttggtataagcccacttcattaataaggaaacagaagaatagaaggaggaggtaccgtgatcctcatgatcacggtcctacaaatccgactccttcgggagatcggtttcataacactcccctttggatgaataccgcgctatacatatgcctcatcaaaactccttccaaaaatccagtgggagaaaaggaataggagaaggagtacatagtacacgctacttatattgcactg

SEQ ID NO: 58667 - DNA, 1104 bp, Oryza sativa
cattcttcaagaatgatatactgatctgcatgatcaatatcaacggaacacagttagggaagtgctccccttgatttgtgcacatctctcatcctcctcataccgatgccatgcacaagcttctcaaaaacactagttggcaaagacttagtaaataaatctgcgagattttcactagtcttggtgagagtcaccttgatttttatttcttttgcaattcatgcatatagaagatttaggcgatatatgttttgtgagactcgtcttcacataacccatttgtatttgtgcaacacaagctgaattatcttcataaataatggctggagttggtgtgatatttagtccacatgtattctgtacatgttgtatcaccctcctcaaccacatgcattccttgctcacttcaaataatcctataatctccgagtgatttgttgatgtcgcgaccatcgtctgcttcgtcgacttccatgagatggttgtaccaccacagagaaacacatacccagtctgtgacaatgctttgtgggggtctgacagatatccagaatcagcatatcccgccatggttaaatcttgattttttctaaagaataaaccgagatcttgtgtgccacgtaaataacggaggatttgcttaatgtcattccaatgccgtttggtaggagctgaactgaaccttgcaagtaggttaacaacaaatgcaatatcaggcctggtaccattcgcgagatacattaaagctccaattgcgcttaaatatggacattcatgtcccaataattcctcgttattttcctgtggtctaaatgggtcactctctactgctagagatcttactaccatgggggttctcgtcggatatgaatccttcatattaaatttctccaatatcttctggatatatgcagactggtgtaacaataccccttcaggagtgtgctcaagctgcagcctaagcaatatttagccttacctaattctttcatctcgaactccgtctttaggtaagaactagcttccttaatcacctgtgtggtctcgatgatattcagatcgtccacatatacagaaataatacaaaatccatgttctgatttt

SEQ ID NO: 58668 - DNA, 927 bp, Oryza sativa
gctgttacgattgcctgatggctaaccattgcaggaggaatgtacggctggggatcctgggaccgatgtgcggccatgcgttcatccaccttccttgccacctcctcttgcatgctgagctcggctcgataccctgtactcaagatctgcaatctttgcctcatccgactcctgtacgtgtggatgtcctccttgaatccaatcttccagggaatcacgcctttccctggtgttcgtcctggatgctcgggagtctgtagggcgagtgacagctcgtccttctctctgtcgggtcagaatgtgccctgagaagaggctttcactgcgtccgttagtcgactggcagcctcgcgtatctgatcgctgaagacaagggagccatcaactgggttaagcgttccaccgtgagcatagtaccagaacttcgatcgatccggccatttagcggtggccggttcgatacccctctcaatcaatcttgcctccatctcctcccacttcggcattgcgacgctatatccgcctgaccctaagtggtgatggtacttctttttggcggcattttctttgtttctggccatcatcgcttgcccttgttgccctgtcttgtaagcaacgaacttgtcccaatgatctcttagctttgggaatacgtcgaagttcggtgttagtcccttcaggatgtatttcttgtagagatctcccttgaagctctggaactgttctgccattttctgtagagtccactgtttcactatgttctccgtacccgcgggtagcgtgagcatctcgagcattgtggtccacaacatctctttctctgattccgggacaaagctgtcattatccccgtgtgcccttgttctgcgccagtacaccgtgctgacaggcacgttgtccctcacaacccaaccgctgtggcgtaca

SEQ ID NO: 58669 - DNA, 2768 bp, Oryza sativa
ctcaccaatcgggactaaagatcttttcccgctatttccaaattctttttaaacccggttagggttaagaaccgggactaaagataatagcactgaattttgaatttcattacatttgtgtttctaaaatagtaaataatgcattacaattatttaaagtcgaaaaattaatgacaaaaccttcgaaaaattattgttgtctgtagtaaactaagtggataatatataattagcgcatgatgatttaaaattgttaaaatttttaataatcatatataattagcatatgcatgatattaaattgttaaaaattctaattaatatatgtaaataccacatgcatgatttaaaattaataaaaattctaataatcatatataactagcatatggttgatttcaatttgataaaaattctaataatcatacataattaacatatgccatacaacaattgattttatggatattcaatacatcaaaaatagtttacatcgtgtacacaacaattacggtaatacatcagcggtgacggttgaccgcacgtactttctcctgactattgttccttccttgtgatcgctacgtgagtaaggggtgtcttcatttgttaggaggatactagggtcaatcgtcactgtgaaagggggttgcccatcaaactgatcgtaatcttcgtcagtcttgttctctactccgacgatttttctttttcctgggagaaccacgtggcgcttcggctcgtcaggccctttgccctttttttccttgctaaacatgtccttgacgtaaaaaacttgcgttacatcattggcaaggacaaaaggttcgtccgagtatccaaccttgttaaggtcaaccgttgtcatcccactgtcatcaatcggtacgcctccaccagtcaacctagcccataggcaccggaacagagggaccttgagaggtccatagtcaagttcccatatgtcctcgatggcaccgtaatacgtgccagttgtaccatcgtgtcccatggcatcgatacgaacaacactgttctggttcgtgctcttcatgtcttgggctctcgtgtagaatgtgtacccattgatttcatatccctggaatgtcgcgatcgagccagatggtcacctcgccaggaaggccagttgttggttaatcgtctcgttacccatgagatgttgtcgcagccacgcggagaaagtatcaatgtgatgccgtgtaatccatgcatcggacttaccgatgtttctggcacgaactagagccaagtgctcctcgatgtaaggagccaccaatgaagattgttgcagaactgtgaaatgggctttacgaaataaattgttgtctaccgtcattattgctttccttccgagagtcccctttccccgtagtctcccttcatggtgtgattcaagtaccccgattggcgaaggtcttcaataaattctacgcgaaattcaatgacctcctctgttccataccccttggcgatgcttacctctggacgagcacggttacgaatatatttcttcagaacgcccatgtaccactcgaaaggaaacatgttgtgtaggtacacagggtcgagaataccgatctctttgacaaggtgacaaagcagatgcgtcattatattgaaaaatgaaggtggaaatatcaactcaaagctgacaagacattgcaccacattattctgaagggcttctaatctatccggatcgatgaccttctgcgaaattgcgttcatgaaagcacatagctttgttattgttgcccggacattgtctgggaggataccccttattacaactggtagcagctgtgtcatcaacacgtgatagtcatgagactttatgtttgtgaacttcttctccttcgtgcttattattcgctttatattcgtggagtatcctgacgataccttgatgctctccaagcattcaaacatactgtccttctctgccttgctaagagtgtagctggctggactcaagtaatggcttcctttctcctttggttccgggtgaaggttgctgcgttgttccatatgtttcagatcattacgtgcttccagtgtatctttcgactttccatatacacctaggaagccaagaaggtttacgcaaaggttcttagtgaggtgcatcacgtcgattgcatggcggacgtccaagaattcccaatagggtaactcccaaaatatggagtttttttttcacatcgccgcgtgaccatcttcgctctctataggctggctgctaggcccctttccaagcactactttaagatctttcaccatagcaaacactgttttaccgctgcgatgttttggcttcgtacggtggtccaccgtatgttcaaagtgcttgcctttcttccgtactgggtggtttgctgcaaggaatcgacgatgacccatgtacacaaccttccgacagtgcttaagatacgtactttctgtttcatccatacagtgagtgcaaaccttgtaccccttgttggactgcccggataggttgctaagtgcaggccaatcgttgatggttacgaacagcagtgctcatacgttaaactcctcctgtttgtcctcgtcccacacggggacaccttccttcttccacaacagtttaagatcttcgaccagtggtcttaggtacacatcgatgtcgttaccaggttgcttggggccttgaataataatcggcatcattatgtacttcctcttcatgcatagccaaggggggaggttgtagatacacatcgtaa

SEQ ID NO: 58670 - DNA, 1575 bp, Oryza sativa
cgtgaacgttgtcggcttaatcacacgacatgattgcaaacggacatctggatatgctacaagttgggtgtgtgagtcatgctggccacatgagatacacatgtaataaaccaactctagcgctttcattgttgttcgagagatgattctactcgctcgctggttctcgaaccagtacgtagcaatctcccacaccgcaacttccattggtgttcgagagatgattctactcgctcgctggttctcgaacaagtacgtagcaatctcccgcaccacaaacctccattggtgttcgagagatgattctactcgctcgttggttctcgaaccaatacgtagcaatctcccgcaccgcaacctccattggtgttcgagagatgattctactcgctagctggttgtcgaaccagtacgtagcaatctcccgcactgcaactttcattggtgttcgagaaatgattctactcgctggctggttctcgaaccagtacgtagcaatctcccgcatcgcaaacctccattggtattcgagagatgattctactcgctcgctggttctcgaaccagtacgtagcaatctcccgcaccgcaacctccattggtgttcgagagatgattctcgctcgctggttgtcgaaccagtacgtagcaatctcccgcaccgcaacttccattggtgttcgagagatgattctacacgttcgctggtcctcgaaccagtacgtagcaatctctcgcaccgcaaccttagatggtcgaggtacgactacagtaataacgcagcagtcctcgcacgacaacttcaaatgatcgagagacacctactcactggttctcaaccagtcaatcgtagcgatctctcgtatatttatttctagtggttgagttacgactactacctggttcttgaccagaggtgtagcgattctcccattacctctacttcaacaaagttgatatcaggtacacaatatctccaagtgttttacccagagatcccttaccacaaaagacacctagcgttgaaacctatcctaatgtccctttacaccgtcttgacaaagcctctgaggaacctaagggaacttcggctggggaagtctagagcggataaggtcttgtcggatcctttagagacgaaagaccatgtaagatctggtcgtgtaagagttcttgccgtgcgtattaaccaagccgtgtaatcggaaatggattttccaacctcacggctgggggctaggatcagtgcttgttcaaccgaggtaggtcaaaggtccaagagccttatcctccgagaacgattctacgacgacaagggtgggggctagggagagtgtataactaaacaaattgactgatcgaagtcggtaaaagagtagatgctcatatacaaaacattggtttgtaaacctaattcattttcagtttttcatacattctataacatgttaccctttgagcactcgctcgggggctatttctatctaatattcttttttgagtattggttttagaaaattctattcggcattatcaaagactccatgtctctatggttctacaccaagggggtgc

SEQ ID NO: 58671 - DNA, 1407 bp, Oryza sativa
  unsure (1)..(1407): unsure at all n locations
gtacagagacagagtgccgacaggaatacccattccgtgacatagtaacagcagcacatatcagcaaatgcttccaggtaaacatacatcatcacatctaaattctttcgacacattcatgacagcaaaatcagggcaggaaatggggaaaaatgcactacctgacaaccaagatctccaaggccaagaatgcgctcgccgtcggtgacgacgatcacctggatgctcctctccggccagttcttgagcacctcaaggatcttccccctgaatccaccaaacaaacaaacacagattcctgtcaggctgcaaattcctaatcaacctcaccatcatcagaaggaaagcagaatcctagcaacaaaaaccgcacttgtccttgaggctgatgtacaggccctgtggccgcctgtagatgctgccgtacttctggcaggcctccccgaccgtcggcgtgtacaccaccggcagcagctcctccacgttgtcgatcaggagcttgtagaacagcctctcattcctctcctgaaaaagaaaagcacaaaaaaaccaagaaacatgacagtgttcagtaatccacagttctagtgaaagggcatgtaggtgttgagttcaaatctccataggaacaaatttcatgttgggttatctaagggctaagttctctgtttggtaagctaagtttctaatttaaaaaggctgcatgtatccgattgaatgtagagctcgagtaaaaatacccttctcaaaaaaaaaaaaagaagtaatccacagttcttgctgcatgaacattatcaatgcatttgatttgagtgggtgatcaaacttttggtggtggtggtggtggtgtttgtgattgtacctggaggtccatcatggcgatgtagcgctggagggggacggtgtagttgcggaggttgtgcatgagcttcttctcctggagctcctgcgagacgatggatggcgggaggaggccgcggaggtagtgcgcgtcgcgctccgcctccgagaaggccaaacccttgttgtgccgcgggtctctcagcagcgtgtacccgctgcatcacatcacatcacagcgcaagaaattcgaattcaaattcaaattttttgttatggccaccgaacgatcggttgcgattcggaaagactcaattctcaaattaatgtagattttcatggatttgatgcaatgaacgacacgaatcagtttttttttaggccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58672 - DNA, 1272 bp, Oryza sativa
atcatgcttgactagcatatcgaatagcatagtgcttcctgtttttagttcaaccacgaatgaccccaacaacataattactaaactcgcacataattttaaaagccaacaaccaatcaggaggttgaatgattggcgctaagatgaattcttttaacaaattgaaagattttaaccactcatcattaaattcaaagggagcatatctagctagcagataagttaggggtttagcaatttgagaaaaaaactttaatgcatcgatagaaccttgtgtgacctaagaagctgtggattccctttacattgttgagagatgaaagttgcttcattacttctatttttgctctctccacctctatccctctttcagaaattcgctgtcctaggactatcccctcttgaccatgaaatgacattttttttctccaattaagcatcaagttcttttctttacaccattgcaaggccttgtctaagttctcgagttaatgatcgaagatttttccatagactgagaagtcgtccatgatttcattcgtcatttcggagaagataaacatcatgcacctttggaatgatatgggtgtattgcacaacccgaacaacattcgacgataagcaaatgtggtcttgctttgatcatcgagatgaataggactttggtgatagccagaatagtcatcaaggagacagaagaaattatttgtaagccgctctagcatctcgtcgatggaaggcgacggggagtgatccttcctagttgccttgctaagttttctgtaatctaggcacatcctccatcccatgacgattcgttgtgggatcaatttgtttttggcattttcaacgaccgtcataactccttaggcacaatctggattaggcacattatagaagtttttctatgggatagtcgatcagaagatcgaagtcagggactttgaacacgtggaagtctagggtggcttcgacattctcgttcctcataggcactccacgtagaatcccataaacttctatgataggacttgaggaactccgaaaggttttgtcggttcgtactaatggctcgtgatggcaacacgagctgacttcgttgatctgaactctgcaatcgtagcaccacatctcctctagtatcaaccatgtcgaaacccgatagaccttgctaacaagactaatccctgcgtgcgtattgaagaacaccgaactctgcaatcgcagcaccacttctcctctagtatcaaccatgtcgaaacccgatagatc

SEQ ID NO: 58673 - DNA, 967 bp, Oryza sativa
agtctttcctctctctcctctctttatacgtatatatacatacatataaaaatatatattttaatgtgtatacgttttttttatgtataaaaatttatacataaagtgtgtatacatacgtatacaaactttatatacgtacgttaaaaaaatatggaaaaacctagaaataatatcacgtatacaaactttgtatacatgtatacaaactttgtatcctatatgtataaaaaaaagaaaaaccaaaaaaaaagaaggaaaaaaccaaagaaaaaaagatatcagaaaccagcgggacacatgtccactcccacgcgcgcgtccccccgcccctcccctccgcgcgtgccaacgtgccacgcaggggagcgggcacgcggatgaccgtttattagcattttcgccttcccgctcctaactccttgaaactcatctatctcaacatagctcaaggataagattaaaaatatagtatgatgttccattttaaatcaaatttgggaaatgcttatgcttaaagtgctaagggtgtcttgctatgagcacacacatacatgtgagtcctctggcaccaatcctttattttcctcatatttagctttttcgtatcaaatgacttcccaagctactttaccaacttgatgaactaatcatcacaagcaaagaaaagaaaataatgcatcttttccctactccctaagagaattgtctttttagttttaagatttgtctcacagagattgtttttatatagtgatatccaccagaactcctagtaccacaaaatatatcattctggttcaagattgccacgaccattttcgagatcctacgtgacgctgatgtgacattatcatacagatgcaaacgtggcatcatcactagcctacagaaactgacgaagtataaaggcataggtacatgcaaacaaatttagaaacctgccgtgctccttgggctgcaggaa

SEQ ID NO: 58674 - DNA, 20327 bp, Oryza sativa
  unsure (1)..(20327): unsure at all n locations
cggtcggggcgtcggaggagcgggctcctcgaggccacgatggcgcgggcgggagccgcaggggggaacaatctaccccgggagggggtcgtgcttctgggccccgcgacgggggtccggggggcaactgccctgccgacgcccgggggaagaggaagcaagagggtaccccttccccatctcctccccgagggggcggggcggtgcgtgccagcagcaggcgcccggagggtaccgcgccgacgtcgcagcccgaggggggcgaaagaagaagcggctccgcaagatgggggagacggaaccatgccggggaaacctcatctctcccccaaggtggtcgtttagccgacctccccgcaggttcgtccccgcgcccactgcggccgtattcattctcccatcccccaaggcgagtttttactcacccgcttctttttgtcttctggtttttcttctgcttcagcgagatcccgtcgcgcccccctcgccattccaagtccggccggtctgaggtcgaggagacggcgaccgcggagactcggaggcgagaagctgaccggcgagaagccgcggtccgcctccgggaatccgaggaggctgtccaggaggccgtccgggctcgccaggctgaggaggccgctcgggaggaggctagactccgccgggccgaggagtccgtccgggaggcggagacggcacacgcacgccaggcggcccgccaagcccccgacccgactccgcctgaggcgacgacgacttccgaggccacccacgacaatgccgcgggcgcaccgctcgggcccgacccctcgggcgacgctcaggacgagccggcttcgggggacgcccccgagcccggcacgtcgatcggcgggccgagccgcgcggcacccacaccgaggcggctctcccctctgccttccactgccccactgagcgcggagcccctcctgcaggccttagccaccgcgaacagcacggtgctggacgggctaagtgcccagatggaggtcctgcaggcggagcgggtggagctcgacgcggcgtgggcgcgcgtcgaggaggggcggcgctcagtggaggccatggtggaggcgggccgcaaggctcactgccggcacacctcagagctcgaggcccgtcggagggagctggcggagatcgccagggaggtggaggaggagcggagactgccctcatcgccaccgccgtgctcgacgagatgcgggacgacctccgcctccaatacaggagccgggcggcggagctagagaaaaagctcgacgccgcccggggagtccttgacgcgccgctgcccgggaacggcgggcggcggagagcgaggcggcgtcccggcggcgtgaagaggcccttgaggctcgcgctacggcgctggaagagcgcgcccgcgcgaaggagagggacctggcagaccgtgaggccgccgtcgccatccgggaggcaacgctggcggcgcatgaggccgcctgcgccgaagaggagtccgtactccgtctccgcgaggacgcgctcaccgagcgggagcgagctctcgaggaggccgaggccgcggcgcagcggctagcggacagcctgtccctccgcaaggcagcgcgagaggagcaggcgcgctgtaatctggaaggcgcccgcgctgagagggccgcactggaccagcgggccgctgagctcgaggcgcgggcgaaggagctggacgcgagggcgcgcagcggcgggcggccgcgggtgacggcgacctagccgcccgcctcgcagctgccgaacacacatcgccgagctgcagggcgcgctggactcgtccgccggagaggtcgaggccctccgcttggcaggcgagatagggcccggcatgcttcgggacgccgtctcccgtttggaccgcgccgggcggcaggcgggcctctggggcgggcggaccgcgaagtacgccgccaaccaggggggcctcgcccagcgcctctcagagatggccgggaccctccagcggctccccgagagacctcgcccggggggcggtggagctcgtactggcaagctatcaggccagggaccccgacttttccccgtgggcagcgctggacgagttccctcccaggaccgaggacgacgcgcgcgcgcaggtccgggacgccgccgaccacatcgtccatagcttcgagggtacggcccctcggctcgcgttcgccctcgactccgacgaggaggatggtgcggacgacgaggctagcgacccgggcgcgtcggagtgagcccccgggcccccgccaatcttgatagccctttttttttcgaggccttcgggcctccttcttgtatagactaacttaatctgcaatcaaataaagagaaaatttctgtgtcaattctatttgttgtgtgtatgaggcaaggatggtctgtgccgcggtccttctgagtcttggcttgaacaagggctcgtgcccaggtcccagcctcaaacggcgcgggtcggggctagtgcctggggagatccacatgtcgagactggccaggccgggagcgtggtgaccgagggttatggatgacccgattgtgggcctttgccgattcccccccggagttcaccacaccccggggcacggctcggttctgggccccttttggcgattttagccggcccgggccaccgagggcaggatcgagcacgagcgtgctaattcaagtcaagattcttcaaaaggaaacaatggcacagatacagtccttaggaaatcgaaaatgcttttattgaaatacggaagagaaaaaagataagtatatgcatgtggtagcccccggccaaccctgcacgcccgggggggtgcggggttggcccgagcccgagacctgatacccaacccccactaggggtagaaacgacgaaggtgttcgatgttccacgggttaggcagctccgtgccgtcgcccgtggccagccgaacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctgatagcgcgcggctcggagggccgcgcgccgccttcgctcttccaagtagtcgaggtcgtctctgcgaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggctcttgaggatttctgcgttggcacgctccacttggccattgcttctggggtgggcgggggaggcgaagcagagcttgatgcccatgtcttcgcagtagtcaccaaagagctcactagtgaactgggtgccgttatccgtaatgatacggttaggcaccccaaaccgagcagtaatgcccctgatgaatttaagcgcggagtgcttatcgatcttgatgaccgggtaagcctcgggccacttagtgaacttgtcgacagcgacatacagatactcgaacccgcccggggcctgcctaaacggacccaggatatcgagcccccagacagcaaacggccatgaaagaggtatggtctgcagggcctgggccagctgatggggttgcctggcgtggaactggcacgccttgcaccgccggaccaggtcgaccgcatcgttgagtgccgtcggccaatagaaaccctggcgaaaggcctttccgaccaaggtgcgtgaggcggagtgggctccgcactcgccttcatggatatcggcaagaagctcgacgccttgttcccgaggaatgcacttcaggaggactccgttagccgcgcgccgatagagggtcccttccaccagcacgtagcgcttggagatacactggacgcgttcactcccttcgcggtcctcgggtagagtcttatctgcgaggtacacctggatctcagtgatccaagcaatcaatctaggggagctgggagcgctcccctcgggtcccgaggcctggactccgacgggcctcgggggccgttcaggtgcatccgtctcccctagggggtcgggtcgcgccgacggctgggcaagcctttcttcaaaggcgcccggtggggtctgggctcgcgaggaagcgagccttgagagtccatcggcgaccgcgttatcccgtctgggcacgtgccgaagctctatcccgtcgaaatggcgttccatacgtcgcacctggcgcacgtaagcgtccatctgcgggtcggagcaccggtactccttacagacctggttaacaactagctgggagtcgcctaacaccaggaggcagcggatccccagtccagctgccaccctgagtcccgcaaggagtccctcgtattccgccatattattggtcgcccgaaagtcgaggcgaaccaagtatctgagaacgtctccgctcggcgaggtcaacgtgacccccgcaccggcgccctgaagagacagggagccgtcgaactgcatcacccagtaggcggtgtgaggcagatgcgaggggcccgagctggcctcggggacagagacgggctcgggagctggggtccactctgccacaaagtcggtgagggcctggctcttgatcgcgtggcgtggttcaaagtgcaaatcgaactcagagagttcgattgcccatttcaccacccgtccagtaccctctcggttatgcaagatttggccgagggggtaagacgtaaccaccgtgacccgatgcgcctggaaataatggcgcaatttcctcgaagccatcagaatagcgtaaagcatcttctgggcctgagggtatcgggtcttagcgtcccggagggcctcgctaacgaagtagacgggtcgttgcacctttcggcggggccaaccctcttcgctaggggccgcatctccagggcgctcttcgtccgagaggccgcagggggcgcactcggcttctgtgccaacgacctcggggtcggagggcgacaggcgcggccttcccgcagtggccccgaggccatcctgggggtcgggggtacctggcaccgtcggacaagcaggcggagggccatctccggccgtcgggggccttgggccaccgttcagctcgggggcctctcctccctgctctctcccgggtcgagttgatacaggattaacctcggggtcagagagcggcaggtgcggccttcccgcagtggccccggggccatcctgggggtcgggggcgcctgacaccgtctgacaagcaggcggagggccagctccggtcgtcgggggcctcgggccgccgttcggctcgggagcctctcctccctgctctctcccgggtcgagtcggcacagggtggggatgcgcggaatgagggttgtcctcatcgcgctccacaaccaacgccgcactgaccacctgcggggctgccgccaggtagagtagcaacggttcatctagctccggggcgaccaggactgggggagagctgagatacgccttcaactgagtgagggcccgctcagcttcctccgtccaggtaaacggcccggagcgtttgaggagcttaaataggggtagcgccttctctcccagcctcgatatgaaccgacttagggcggccatacagccggtgacgcattacatatccctaagcttgctgggggggcgcatccgctctatagctcgtatcttctcggggttggcctcgatgcctcgggcagagaccaagaacccgagaagcttgcccgcaggtacgccgaacacgcacttgtcggggttcagctttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctacaggggtaatgaatgcagttttttcctcatcctccctagccatgcgaatctgatgataaccagagtatgcatctaaaaaacacaaaaggtcgcaccccgcggtggagttgacaatctgatctatgcgtggcagggggtaagggtccttaggacatgccttgttaaggtcggtgtagtcgatgcacatccgaagcttgccgttcgccttgggaacgacgaccggattcgccagccactccggatggatgacctcacggatgaatccggcctccagaagtcgcgccacctcctcgcggatgaaggcttgacgttccggggcctgccgccgcactttctgccggactggccttgcgcccggccgcacggcgagacagtgctcaatcacctccctggggaccccgggcatgtccgctggtctccatgcgaagacgtcagcgtttgcccgcaggaaggagacgagcgcgtcttcctatttgccgtccagaagaccaccgattcgtgtggtcttggacgggccgtcgcccagggctacctgcttgatcgggacctcgtcgcatgtgatcattcgctgcctcggggcggctgggacggaagcgctgaacctctcgtcgccaccctcgggctttgatgccgcggcgaggtggtccgcgcgctgctcatgcaagcaagcgcgactttgagctcgccatggacggtgatggggccaccggggcccggcatcttcatctggagataggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctaacggccaagtgtgccccggcgtcacaccgatgatcggctgggacggccggagcaccatccccggggccttgatggcatcaaaggctgcgggggaaaggatgttgagggctgcgcccccgtctatgaggacgcgccccaacttcacattgcaaacggtgggggaaaccaccatcgcgatctgtcctccccgggcaacgcacggcgggtggtcggtctggtcgaaagtgagggcaacctccgaccaccgcgcccgccgcgtcgcctcatgggtaggggccacggccagaagctctcgcttcatggccttgaggctccggcgagaaacgtgagcgcacgctcccccatcgacggtggcgacgatggccccgggctcctggaacccaggtcaatngtcgccatcgtcgacatcaccggtggtggccttctgcttggcctcacctcgccggttgccggcgggagccgccggggccttgccctcacggcgctcctgcctcctctcctcctcccacttcctcgtccgctcagccaaacttttgaccgcgcggcaatccgcgaggtcgtggagggaggtgttgtgcacggaacaccacttgccaaacttttgaccggcctccttctttttgtcgctcgcaggcctcccctttcgggtggcccgcgaagcgccctcgacggcgaggacgtgaccctcgtcgtcggaatgggccgacctcttcttcttcctcctgtcccgccgccctgaccgagcggcggtcccggaggcggccggagctgccacaccggaaccggaggagttccaggtccaggcctcctccttgcgagccacacggtccgcgagctgaaaaagctccgcggtggtctggggctccttggaggcgatcttctcgagcatgcggttgtgccgcacgccccccctgaacgcgtagatcaccgcgtgtgcagggatgcatggtatggtgttgcggacttgacagaaccgctgaacatacgagcgaagagactcatcgtcccttcgctgcaccgcatgcaagtccgctttttcgcctgggcgcggatatgtgccctggaagttcgtggtgaactgctggcacagatcctcccaagagtggaccgacgcgggtggcaagttcattagccaaccccgcgcctgacctttcagggccatgggaaagaaattcgccatgaccctatcgtcacccccggcggcctcgatcccagtcgtatagatctgaagaaactcggcggggttgacgcttccgtcgtatttttcggtgatggtgggccggaaccttgggggccaacggacgttccgaaggctcgccacaaaggctcgacagccggcaccgccaaccggggacacggggggctggcccctgtgcccgaaccgaagtggcgctccggacgaggaggcgccctccattgcgtgggcagcacgacgaccattgcgccggcgctcgatactggggcgggtatccggccccccacgcacatcttcttgggtcggaggcgttgacgagggaatggcggacgaacggcgggaaacggccgccgctcgccgcgccctccgcctcgacgacacggagccggtggtagcagcaccagaggtcttggtggcggaggaccgcccaccggcgcctaggcgctgctgcgccgtcatgaccaagtcggccacgtcatccagccaacgtcgggctggagtctctggatcggggacgatgggcgggtgacgtaggagcgcgcccgcagcctggagcgcgccctggggcgtgctaccatcgccgtagacgaggaggcgacgctccccgtctcgccgtccttctccatcgcccgcgggcggtgaagtcgcggatctttcgaccccttcgaacgcctcctcccgcccaagacttcggcgagagggggacggtggagtacgaactcgacggcgcgggttctgctccccgtcgtcaccgctagcgctcggagagaggttgtgcgccactgcccgttcggccattgggccgagcgggagaagcttggcgcacacgaaagaggatgagggcttagaaagacacacgcgccccctacctggcgcgccagatgacggagcttggggctcctcaccgggagaccgcgcaggcccccctttgccggttcggccgggggcgctcagtgaggttctttgccctcggtctggggaaagttcgcgagagagagaatgcacaagacacgggcgatgtagacaggttcgggccgctgagaagcgtaataccctactcctgtgttctggtggatctgtgtatggagaagttacaaagagctggggagcaagagagttcaggctctagaacccctctattccccccctggctctcgatctgatcccatccccttcttcggtgggtaaggtcttccttttatatctcaaggggaaaccacatgcaccacttctacctactcttcttttgggtggggacccaccctatcttgaccaaaacttggctcgcatcttcgcctggaagctaaatcatagcttgtccttgagtgaggcccagcgccgtcactcgcctgacataggggatcaccctgtcattccttcattaatgggcggagattgcaatggctgcagtccgaatgacccttcgatgggatgggtcatacctacctccactccgccggatgcagatgcaacgtgggagcacagtttgtcttccgatgacgtgaccggcatcagaccagtcacagaccggtcattcttgtccaccacgtgtcagtttagcatgccgcacgtctgctcttctttatacaattacttccttgtaatggttgcgatgaagcctggcatgaacctagccgggactgacgtgccaactgcaggagttagcacgccggccccggctagggacgagttccaggaggctctcatcattccgacgggacggggcgaggcgtgtgacaggccgcctgttgccacctaacccgcgatctgaccggtctgtgaccggtcacacactgcgaccggtcacggaccggataagcgagcgcgctgcgctgcattaaatgcggcgtggcgcgctcgtccaaactgtaataaatgcggttaggtgagccccgctgtgttcacctaacccatacacgtggcgccagaaccacagagggtcggggcgccccagccctcggggtcgaaacgggagcggcccgacccctcggggagacggaggaaggggtggccacgtcaccctcgggcccgaccccccccaagggggtcaggccacgtgggtgaccgcggctgcccaagcctctagtcatgatactcccggtctcatgtcaccgacaactgtggtaggtagtggaaatatttaaaagtttgaaatttttgttcaagtttttgtaaacttggttgggttacggggctccagtgacaaactccaccttttgatccaggcacaaccacacagcctggtagctccaacatatccaaccccttttctctctcaccattttttttggaaattgtttgttattatttattttttttaactcaccacatttccacataactctgccgcatgctcttgcacataccatgttttgctaaaatgctaatacaatcaactagaaggcattttctaacataacacgtctcttgagttctacttggataaagtgacacctagagagtatgtaagacatcacctcctagaaagagaggggaaaatctttcgaatgatgaaacagataagtcatcccaagttgacactaggagaaataccgagtcatttccacattgctaagagtcattgctaggagtcccgttgacttagactatactagattagggtcttcaccttatactattgagtatttatagtagatcaatacatataaacacgatagattgctattacccattaggaggctcgatttgtataaaaaccattacctcctacttcatagctcaccttcgcgagcatccttgtactgatcaatccttatatctgtataaaccattgtctcctacttccttattatatcttgatgagcatcctttactgtccgactatacaaaatcaatactatagtcatgccctaacatgttagcaaaggtatcatgtgagcatctctatgacatgccacatcaaatattggattgatgctaatacatttaactagtttatggggggtataatatgtattttttttaagtttgtggacaaacataactcatgtttatttactcatagaactttgcatccacgattcacccatccataaatcacactatggatatgacccttggagtcaaaatgcccttgtttcttgagaggaataagtctatttcgcatccctcatcttttatccttgatcgaatcgcctcctccaaccgcaaaatcgggtataacacatcccccatctttgaaaaccggtgcaaatcaactcattcggtggtgtcggaagtagttttcataggtggggctcacatgacaatgaggtatggcaaaaatatatggccccacctacaaaaaccaatttcgaaaccattaaaggagtcgatttgcactagtttttaaatatgaaggaggtgttatacctggttttgcggtttgggggatgggattgatcaagggtacgagatgagggagttaaaatagacttatttctttttgagaaacatcaacaggagaggaagaattatacttgggccggaaaaagtacatctaaggtccctcatcttgtcatcggattacaaaattatcccccaatcgcaaaaccagatatatgggatccctcaacttataaaaccgggtcactttgggtccctagacggttttgacccggttttatccgacgtggcagctgagtcagcatgggtcccgtatgtcagtgtgtccactttatcactccctctttttcccatctctcttcatcctctcttctctcccttaggtcccgttcttttctccaacaaagagttggatgaagattaagattttcgtggcacgcttttcaaactgctaaattgtgcgtttcgtgtgaaaactttctatatgaaatttgctctaaaatatcatattaatctatttttcaagtttgtaataattaaaactcaatcaatcatacgttaatgccacctcttttgcgtaaaaaacttaatcttcatctattcatcttcgggagaaaagaacaccacctactcggttactctctctctctctctcaatattctttgggcaggccgacccgcgggtgcgaggtgggagagagggagggcggccgatgctggggcggcgacggccaatgcgggagaaggggagacggtgtctcgtcctaccgccacaacgacgccgtccattccttcctccttgctaaggcctctggctctgatttcgtcttctcccttctccgccgcatcctctcgttctccccacccgccgactccctcttccgccaacgccgtccactcctaccctcctccgccacatcctcataacctcgccagcggatggttgaagatgaagtggctggggtcggatgccccgcggtcatcccgcgcggcggtacctggtaccgcccgagctcctccagcatcgcctccaccgtgaccaacgcacgcgccgcggcaactccgcgagacacatggaggaggtgatgctcgccacaccaatgcctcctgcgagtttagcatcatcctcgacgcccgtctccctcccctcccccactaccgccgcaaccccacccggacgacgcgcgaccattagaattttcgtggaccacccattgtgcagtgccagactttgaagtacaacatgaagtcgagggctgggagaggctttatccttgaggtgctgaaggtgatgtccttgttgtaccactatatttgagtagcccttatcaatctagtgtatcttttggaccctgggggtgtttagatccaggggtgtaagagtttttgtgtgtcacatcgagtattatatagggtgtaaaaaaaactaattacagaatccgtcagtaaactgcgactctacgagacgaatttattaagcctaattaatccgttattagcaaatatttactgtagcaacacattgtcaaatcatggagcaattggcttaaaacgtctcgcaaattagtcacaatatgtgcaattagttatttttatagcctatatttaatacttcatgaaggtgtttaaacgctcgatatgatagggtgaaaaattttgatgtgtgatctgatcagggcctctgtttggttaaatctgaactgtttgcttgtagataatagataagtaactttgtcttgtcagtagattagaaacccccttccccttctctaagtgttgaatgccatttaaatttggattaagattctagtttcattgtctaatgctttgagtgtgttccggccatgattagagcaggtacaatagcatgctataagcgagttataaacatattttaaagagataaaggaagagagagaagagcagcggactacggatctatagccagctgcagcacggactctaagacttaatgtgtgtatgacaagtaggactatgtattaatagtatagtaagcaactattgtatgaattggctattatattggctatagataatttggagctagtagttgactatactattaaacttgctcttatctgtagaaaaaaaatacatttgcatatgtaaatttatatttgtgttgatggtgttctcctataatcataggctgcgaacatcccgaagaagtatactccgaccattggaatttccgtggaccaccgccgcaagaaccgctcacttgagggctccaggctaatgtctagaggtttaagacataggccttgtttagttcacgaaaagaaaatttttgagtgtcaatgtttaacggatatcggaatgggttttcggatacgaatgaaaaaaataatttaataacttgcatgaaaaccgtgagatgaatcttttgagcctaaactaattcgtcattagcgcatgtaggttactgtagcatttatggctaatcatggactaattagacttaaaatattcgtctcacgatttctccctaaatgtacaattagtttttatttttatctatatttaatactccattgtccagagattcaatatgatgtaaaaatttctggggactaaacaagggcaaggtatggctgcagtttgttgtccctgactccttgtatatgtttatcgaaggtattgtcttctagatctggttttgagcttgattgtgctagctcttgtgtcaggctggtgattccactgccgaggagcttgccactgccacccaggtccagggtgattaattacatgcctattgctcgcggtgagaagcgctcggttgaggctgtgaaggtcaccgatgagatgaaggcgttcaaggcctacgctaattaagctccgtgttgagaggatgaaccagcgccatgttggtgcccgccagaaggaagagaagtgaagtgaccggacatagtatctgtttcgttatattcagcagctagtggatgctatcaggcactaaatctaaattttgtttttgtgctggaaatagagaccagcttatcatcattttggtgtcatcatacccttctgtttgatactccctccgtttctaaatgtttgacaccgttaacttttcagtacatatttaactattcgtcttattaaaaaaatttatgaaatatgcaaaactatatatatacatgaaagtatttcaacaataaatcaaatgatagaaaaagaattaataattacttaaattttttgaataagacgaatgattaaacatgtttaaaaaaatcaacggcgccaaatatttaggaatggagggagtatttggtactgatttgcatgctctgctatcgaatgagattcaatagatgtgttgtgtcagattactttgcgctgtgtgtggaccttcatcaatgttgggtaagatgcattatgcatgtagtagaacatatacatgctgtgtgcatagtgatgtaatgtgagtatagatcattctactagtgcacagtagcatatgctctgtgactactgtgaaaaaccttgtgctttgtctgcaagtgatatcaactgagattagtagtttctatctgaccttgactggactttttgacaagccttgcatggtgcatggtttgagttgactgctgtaatttgtgcagattatgcaatcattaggtgctatcctgtttgagtggaatttcattgtttctatttggctggtagctttgtgggaataagttgtttttagaaaaggaggattgctaggttcagtgtgtggattgtggaccttggaatcgattgttgcttgatgctctaaaaaagaaaaaaaaacataaatgcactgaattgtagccactgctgggctggcaatcttgcattgtggtaatgtggcatggcatcttcggatctgatctaatcttgtagagattgaaaggggatgatattctgtgcccactcttgcaccacttgggaaaaaaatgactgatggatttcctgccgttcttttcggctggactgctgcattctcttgctagaatatgttttcaattgtaaaattgatcaaaaagttttttttgtctgattttgcccatcatatgatctgatctctttgggcaacgtactcgaatcatacatcatatgtatttatcagttcacgagcttatcatacaacctggatatatatatgtcttggaaagggatcctctgacttaactgctgtgcagttgagtcactgacatatgggccatagcaaagtgggactcacatgtcagtgactcaactgcatgtgcagttaagttagaggatctactttcatatgtcttacggtgaccaagatagacatgtaggatgtagctagctttgcccatacaacaatgacttacaaaatgaataaaataaagaacgaaaaacagagaaaatgaatataagaacaggttgcgtcaatcattgaatggagcataagttagtgactgagtaatttattcagtaggatacatttagtggtataatccattgtaggcagagtgctttggctaagacagcagttggcctagatcagcttaactcctgcttgcatgttactgctattagtagagtgtagaagcagttggtgtaggttatattagctgctgctcttcaatacataatgccaaaacagttggctacagtctgcattacactaatgctgcttacaagataattgcatcagtgctgaatataaaatgagaaaacagaacatctacaaacttttgctgaagatctctacgacagttaggtttttatttgaagttttctcatatcattttaaattaatccagcacataaaatttcagttctggtacaagaacagcaacatttatctctctcttaaaaaaaaaaaagaaatcacgctgagggctttcctgaaaaaaaaaataaaattgtgcttcaggctaaggacttgttcataagtagaataaaaatcagggattttggtgctatgctacacattcccagacctcgctataaaacagatccgatcactctcctgatcggcgccggcgttaattccaagaaaagaagaagagaagaatctgaaaaactttaagccgctatgggtctgcaggtatgcagatcactctctcaatccaccagcatcatcgtttctacgcttaataccgctataaagatgaagaaatctttaccatcgtctgctccctcgtttgtttgattgattttattctgtgtgtaaaatgtattgtaccttagatttagcctagaacaattcttgttcttccccttccctttgtggcgtaaaagaaattcttaatctcccgtctcctccgctccttgcgccgccaagacgagtcgctgctgaccaggggaggggcggcgagcagagcaggggagaggatcatgatgagcatcacatcctctttctgattcatctctctctcccatcgggtctggaatttgcttgtgttcgttcgttaaccctagcttctcttctagatctggaagaagctcttcccttaatttcagagccttaaccttaatacaggtaacagtttgtttgttccccgaaaagttagttgatccgcccctggccgtagagactagatctgactcttccctgctattacacatctctcatctctttgtctgattcgttcagtgagtcttgtcaaaagatctatgagatgcaatcttcttgtttaagatgctgcaattgttccgtttgaattgtaattttccattgctttgcggcttaacattacaacttctgaagaaagatttagtgtgacagtgtgactgaagcatgatccgattacaatttgtgactgatatccaattgcaggaggattttgagcagtacgccgagaaggcgaagaccttgccggagagcactagcaacgagaacaagcttatcctctatggactctacaagcaggccaccgttggagatgtcaatactggtatgtatactgaatatttggtattattcagttgttacttctgttttgccaggcatgttctggatgtgtaacacaattcttgagttaatgacttgctgtgtttgattacattcagagacatgggtacagttttacatgccatggattatgatcctaacacaagatctcatagatcaccatgattttttttatcactcccccaaaaaatctgtctgatttgaaacaagaccattctttcccatcaaaatttttgggatgtagtattgagtacttccccatttttgtagagttgtaatttacaagtgcaaccattgatattgacctgcacactacaacatagaaatttgctgcatctagcttctgagttctgatagctgtccatattcagtcttctagtgtgattatgtcctttcacaacatgtttgtgaaatgtcatggtttttatctatatttttggttttgtgctgaaaagtagtagaagttactacatgctagatgtgttttgactatctatttctttgtcaaacttgtaaaatctcactgctacttccaaatttttaactatctattgccctcatgtcccttttgtaatcaattagtcaattcttatatgaatctgatctaccttgccaacagttctttatattaacttgttactgtgttttgtgttaacgaagatatttcacgatgacgttgctaactatttctttttctataatcttctgaagctcgtcctggcatattcgcccagagggacagggcgaaatgggatgcatggaaagctgttgaaggtccatatacttctctctgtccttacataaatatgttttcctgtctgtccattctaatactgttgggctgtttcgccgtgctactgaactgaactttttgcaatcttcgcaggcaaatcgaaggaggaagcaatgagcgactacatcaccaaggtgaagcagctcctggaggaggctgctgctgcagcctcttaagaagttatgaactctatgctacatggcttctgtcagctgaacaactctatgctaatctggttgctgacaacttaccattctatcaattcgggatgtgaactatgtacctctttgtgtactgttgcataatttatccatctatttatgaagactattagtcctatgaatcatattatcttgtaatctttcatctctctggctgtgtactgcacaatagaaaaataatggttgtcaagccagttacatgccccaatttcaagtaaccataagcagtaataaccatcatatcctggatcatattccaatctcagaagacaacacaatctaaagagaaaaaagatctattgatcagaaggccaaaaacatatctatatgaaaaatgaaaatgcttaattgttcatagttagatagatcaacaacaccgcactgcacacatatatactgtttactcatcatgttcattcattctacacatgcatatgatctcatctggcaatggcaagaagccaagaactcctgaaaaaaaaaggatgaaatcttcagagatgtccatagcctaagacctgaccacctgagaagaggttgaggcagagcagggaagcagccagcagcgtccctggaatccaccacctgacaccctcgtcggcgaacatggcgcacagcaccaggcacagcagcagcagcatgtagaaccccagcccggaccagaatccgccgccgccgcaccactcgccgccggcggtgacgccgtacttggcggcgtccgccgggtagtagtatattccggcgaagtaggcgaccaccagcagcaggaccaagaacgccatgatgttctgcagcagcatcacggatagcacgatcgccaccggcacgaccaccacctcgctccggcggctgaggagcacggcggcgagcagcaggagcccgccggcggcgaccagggtgacggcattgtcggccaccgtccccggcaggttcgccgccttgtcgtaccactccgtcagggtctcgttgtagttgacccagaccagggccaccacgatgaggagtggcaccaccggagacggcccaccaccgccgccgcggcggcccagcccccacgccggcgaggtaccccggtagtagctcatgatcacctcttcttctttgagctctttctgcttcttatgctacttctgttcttgctgcttttaagcacactacttagtactactcagttgtaagtagcattagcagtgaaaaagtccaggtttgataatatttagtttctgaaatgtggattagtgttcatcttgttccaactaattttaactacctgcttgtgtcctgatgtcaattgtcttggaatttagttgaggtagggacctgcttaaagctggtagatgaactgattttagagaaagatggcatagaggatagtgatttgtaggtcttgtcattttcatgtatgtgtcattctttgtttttgtttggtttggctggggttattaactggaacaaaatcttctattgcctccatgtagacttgggaggtacttagcttagcaacagaaaatgatggctgatatcattaagtttaccatgggctgcttcaaccatacaaagtaaactgattaaactcagtagttgtggactcagtacaactgcttttattctaatggttatctaagaagattgtaaaaagcttatgcaatcaattggattcatttcagagtttcagattagaaatttcagttcattagcaaattccttgattagtttcagattaggagccatactgacaaaagaaggcattagtacatggcaagatgaaccaaacaaagccaacatatccggtttttt

SEQ ID NO: 58675 - DNA, 1458 bp, Oryza sativa
actgattctctgtgaaagaattgaagtgaatcttacctgttcttcgaaaggcttgggaaggaagtatatgtatccacaatcaaggcaaatgtgtgttgctctagcctgtgacaattcacaactttgcaggttgaggcttaaaagttggaaagagcagacgattgcaggcagcataagctctgagaagcagacagaactatcttgagcttaccttttgtgattccgtcaatttccggccaaatctcggaggcgccggccttttcggaagtcgcttcacatcaacttgtgcacccctgagatggcgcgaaatgacagcaggagatgaaatgtaaggaacttgaaggatccaaagtacttaccatgaaaagtacatatttctactagtattactgtctgaattttgaatataactgcataatgagtgcatgtacaggatttcaaagttacgaaaaaattgtaatgctggggaggataagtccttacctgctaaccacaaagtagacagagtctggctttgcctggatggctgtcttggtgaaccccagcttatctgcaggccatagttcatctccaaagaagctacttgtgtagagcacctggtcacctgatttcaggcctgctcttgccgcgttccctccagaatccacagcctaaagcaaatgccaaatgaactattactagtcactaattataacactttctgcatctccagctctaaggcaagctgtacatactgaaggcaaacagatatttttagcaggaaaagagtttggagttgcatttttaaccgtcgtagtagttcctagcttcaagtcccccccccccccccctttaggcataagccagtctggctgattgctttgtgtaacaaaaactcttttcctgctaatatattgacgtgcaatccttttgcacgttcaaaaaaaaaaacagatattcttgataagtcctaactcatgtagaagttgattcaacaggttgttatagttttctgagaaattaatccactaatggcaaagaactagttttatgaattaggacttgttgaagatattcctaataagtcctaactcatttttcctgaagaaattcttctaaaaatgtaagaatttcttcaggaaatatagtgatcttgagacagcaattcaatgctgccccttttttttctctgttaatggatcatgaagataaaacaagagcagggaatatacagtgaatagcaatctagtatgttcttgatgagacagcaatcaagtggtgaaaatttccattggttgatcatgcagagaaagaagaacaggtggcatcatgcatggaagtatggaagcaagctgtgttatatactgacggtgatgacgacgccgccgccggtcttctggccgagggtgaggccgagcggcttgtcaacctccacctcgatgttcttcgccgcccggccgtcctcgcgttcacctgaag

SEQ ID NO: 58676 - DNA, 1181 bp, Oryza sativa
atgtttgagatttcacaaacaattcaccttttttttttgtttgatgtagaagtctgggaaactttcatgttctaaatgcattctcagtttggttattgatcgaaaatccaaatggacataaaagtgacattctcagtcaaaaccagcaaatttgtggcctgtgaacacaagccaaatatatctcatgtgcaaaaggatgaacatgggtaccagtacaatgcacatttatccgggacgatcacaaaacaagccatagataccatatagaaagcacagacttaaaagaaacagaatgcagctgggaggtaacaaggtggcaaccatatccaacatacggactgcagtatttgtttcacattacagggcatccatctcgattcctggatcaacatcctatctaaaactacacagctatccaacagatgtcttttcactccagcaagtaaataatcatcggatcggctaaaaatctgaaactcaaaggccattgtagagtgcagaattgcattgcatcagctgcaaaaagatttgcagaagtcaagccaaaatgagagtgacagtaggagaaaagtgtgatacagatggataggattctaagagaaccttctcaaggacttgttttcctgcagccaaatcatcatctttcttcaagagttcaattcgagccttcatggcattgtttttctcttcaacctatgttatcgtgtgaagagaaaaggaaattatcacttgcaaaagatgctctttagccaagttaccaaaaatgaaaatgtcttcgcaggagaaatcatctattagaactcagttgttattcgcatagtaagaagagtatcccttgaaaaattaattgggaatagtgtctatatgtctgcagaaccatttccagggtatattacctcttctattagacttttcaggtattcaacttcatctttcttagcctttgatatcatttgcttggtgtcttcaatgttagtcctgcaaccggatcaaccataatcccaaacatggaatgaagaacaagtcaaggaaatacatgttttatccagacagaacagaatatcttgtgtatttatatgctgcagtttgagaacaaataagagagcaatagccatgcttgtccatttgattgtatttcttagaaagtggacaagagaacaacaaaatttcaaaaagatgaa

SEQ ID NO: 58677 - DNA, 1473 bp, Oryza sativa
aaatccaaacaagccataacaaggttgttgtacagcagctcattctggtattcttgaggtatgcgaaggaagaggctttcagcttcagaaatgccatgaactttagctgtgaactccaggagatatgagtaatctagctcactaagcttgtagggcctctctctcatgatccattccatgacctgtggcaataaaaaaacaggagatgcactttcacttcctgaacagcgaagccatggtaaaagaaaaactttagaatctacaagtaatcaacatccattcatcgtgttatattaaatgaagagaagcttgatttcaccatgattaggtaagcaataatccaatcaaaaagtacaaacagaacatattaccagtcaattactcgatgtcaatttcgttcatctctaaatctttatacagacaagcacaaaatatgcaacaagaatgtaggtttatctatctatcaccttcattcagaataacacagatcacaaatctctctaaaaaaacagatcacaattgacacagatgaaatgcagcttcgatagttgatgccaatctcaagcaaagcacagattgcggagacaacggcggcgaagataaatctttgatgggatatatctcagttctcggcctaactcacatcaatcacgaagcgagccgctcatatgggagatttcattggatccgagccaagaacggggactgcgacaagaggtggaagagacgagagagagacctggagggcggcgcggtggaggcggcggcggcggaggcggtgacggcgtggaagacgtgcccgcggtgcacggcgcggccgtcgcccatccacccccggatggcggcgcacaccgacgccgaccgctccacccgctgcgccagcgacccctcccgctccgcctcgtctgccgcaggacggggaggaggaggagggagagctatacgggcgcctcctgagctcgcaaagaaggttgcaacggcgaccgcgaccgcggcggaggggatcggcggccgccgccggcggagcagcgcgcgcagcatggtttggttgcggtgcggcaattcgtcgagcagctgccgttgttctggtgcgcgtcggctcgcccagcgcgctctgtagccgtcggatcgggaatcaacgcgccgaatggcgtcctaccattgaagtcgtcagatcttgttgggcttgctgttttgtgcgtcggaataagttcactgaaggtccctcaacttaacagcgagattttttaaggtgccttaaccacaaaaccagaaatcttcaccactaaactatacaaaaccgtctaatttaggtcccaaggcagtatagatgcatgttttgctgacgtggcatcctagtcagcaaaaataataaaataaatatgtggggcccacatgttattgagagaaaatgatgtgggccccgcatccatttttttcttttatttttctcttctcttctcaacttctcac

SEQ ID NO: 58678 - DNA, 2787 bp, Oryza sativa
tgtttgtgttgggccttggctcgtttggctcgcgagctggctcgttatagctaacgagataaaatcctggctcgacttgttaacaaatccaaacgaaccgaaccatgcacgagtcgagtgagctaaggagtgatgagcttttcgtccagccctatctcattgtgaatgatttgataagcttcttgatgcaattattggctattgttccctaattatttatttgcaaatcagtgatcacaaatcctgcatgtttataaggagatgtcgaatctatattatatcggcaagttagcattccaggttgaacatttaaatggcttacaaaatataagcacctagcaaatgagctgaatatttgattgaattttatcaacattgagtacgtaaatatcaccatatctcacatgcgaccgtaccttaaactacaaaaacggggacaggaatgaaggacataagctcttcttttcccgcttagaacagaagaatatctcctaaaaaacttaaaagatgcccttattttgatccattgcatagcacagaaaaggttttctgagaatcgtcgattgcttgcatcttcttcctccaataatcatcgctccaaatgcttcagcaaacaatgattcagaagcaaatgtgtaatgctgccgcaaacaaggcttttcgaatactgacacctgcatggtgaataaacaggagataagggaacatgaaagctatgggcaaaagctgagcttccagttcttaccaattcaggattcaacatctattgtaatgtactgtcataaaatccattcctgcgatccagaaccagaagctggatacgagcacattagttgacagaaacaacatgccagtgcggtaatctgttcctgtcttccggatgtctgatgacccttatcttacctgtaccctgttataatttgactgaggttgcggtcaacagggacagttgggccaagtatgatctttttttcattattgatgctatttttcctggtaatggcaagtatgatcttttggccaagttaaatgtagagactgatgtcgcagttacaacttgcaaactttgcaggaaataacttcttgaaattattcctgaaaaacataaaggcatcataacgatgaaaacctcaaggagattctatttcaccacctatattttttttttgcataatttatttcactatcatattccatgaacacatgttttgtaatagaattcttgtgagaaggagaaaagccatcagaaaacaggtgattacatttagtgtggatttgaaatgaaaaaattccatcctaattacaatatgcagtaacaatcagtgttatatgcgtttgaagctcatgaatttatcaacttaacaaagctattttcctacttgcccaaaagcaactattaaagatattcatcagcatttcaaaagaacgtttctatgtgcatggaaaattagcatcaattatggaaggcgcacacattacatagctaacagaaagatttacgtgttgaacaaagggtgatgataacaaaccaattacggaattcctgatcaatgctcaaagtttcgggggaaccttgtataaatttgttaagctgcccaaacaagagacagcagactccagcattctctgcaactataagaagttagaaagatggagatggagagatggagatggaaaactatggaaactttagctacccaccttgtcaaattttactagtcaagctttgaatatttgaatgtttttttgacgcaaggaatatttgaatgttgatttatgaactgaatgaattaatcgaaatcagtgaaatcaagagaatggacttaagaagcctgaacccaactactcccaggcattttgtttaagcctctttctgccattatctttcttagcctcttaactttctcccatttgtttgcttctgaatatatgttacccaaaagaatataatatccactctctcctggctcaagttcaaagcacttggaagcaacaatttccccaagctcaacattgttgtgcaacctgcaagcaagaagtagagcaccccaaatgctagcatctggcttcattggcatctgcatgatcagttgatatgcttcatccaattttccactacgtccaagaagatctaccatgatggtgtagtgttccattgaagggctaatcttatatttttctgtcatggaagcaaagcaagcacgggcttcttccattagcccggcattactataagcagacaacaaccccacaaaggtcactgcattgggactaatctttgcatcggacatctccttgaacaaactaacagcttcattgaacttgccattcatcccacagcccacgataatcgcactgtaagacaccacatctcgcatccccaaacctctgaacagatcaaaagctctgtcgatccgcccactcttggtatgcaaatccaccagagcggtgcgcaaatgatcatccagctcaatccccacagaccccatgaaactctcagcccacaagccaaacctcaagtctccaagctgcgagcaagccgagatgactgacgagaaggtcttctcattgggcatcacccacacatgaggcttcaacatacgattgaaaacagcaagagcctcccttgcacagccattctttgcgtagcaggcgatcatcgcgttccacgcgtaaagatctttcttgttctccatccgctcgaataattcgccggcagcgtgaacatcgccggagttggcgtagccggatatcatcgtgatccacgagacgttgctcctcacgggc

SEQ ID NO: 58679 - DNA, 3266 bp, Oryza sativa
aacggcggcgagcgcgaaggggcaggggcggcggcccgagcggagggacgagaggtagagcgcgacggcgcggcgtgggcggccttggtccgcggcggcgcggatggccagcgtccacgtcgagttgacgtctccggcggcggcgggcatgggagcgtcggtgatggtggcaaactagcaatccgtcgaacagttggtgactgaatttgaactcaaggactgacaatttcgcagctcttttttgtttgataggaacaatttcagctcttcatactagtggataaggctgtgtttagattcaaagtttggatctccttttttatcacatcaatctgtcataaacacacaacatttcagtcacatcatcttcaattttaactaaaatttaaactttgcgctgaactaaacacaacctaagtaacatttttcaaaagcttctcaaataaatgtaaactaggaatacaaaagtcccaatttaactgtgctgttagaaaacaaattctggtcacttgaagagattacagttgggactatcttaaaaactaccgcaagtattttttatggaaaactttcaaatataaatatagtataattgtaatataattacaccttaactatactacaaccaattaaccttattatgacttatttcctccttccctaatggtttgacgccgttgacttttttaaacatgtttgaccgttcgtcttattcaaaaacttttgtgaaatatgtaaaattatatgtatacataaaagtatatttaacaatgaatcagatgataggaaaagaattaataattacttaaatttttttaataaggcaaagagtcaaatatgtttaaaaaagtcaacagcgtcaaacatttagggatgcaggaagtatatagcttgtttatgcctgattagttaacaatcatctttgtctgtacggcagtttttattttacttttgctaaaaaaaattctcctgctctctaaacactcctgactctttcaaaaaaaaaaaaaacgggggtgggttgggtggggaagactactgccattcattgttgcaactgttctctcctcttcacaatctttctgcgattgtacaaggcttgaatggatgctacggctgttgccgagtgaaagtacataagttgtattatctgaagaaacgcacagatttttgcatgaattcagttggttcagatcagtcgaaaatattgttcaataatctctctaagaaaaagaagttgccggcatccgaccatttcaatttcagcgatgagtcacaatccaaaagctgaagaccagaaatgcacgtccaggtcctatgcgttcctgaattctaatacaacgcacgtccacatggaccacatgcaaataaattcctcgcaaaatactggatacctgaacaggtgagcaatagataatagaaacaggagcacaaaacattggaacagcatgagtccaaagttccatcgccaaatcaaatgatttcaaggcctacaaggttagcaaacatctataggacatgagccgaagaattggttgaatcagtcgcattaggccaaacaaataccaccatccaacatgccaaccatattttacactaggaataccttcctaccccgcaaaaaagggcaggaacaaaagaacattctctaaggtaccaaccaccactagctcagagctagaaaagctttacaaaggagggaaagatggcagccatctccggcacacactgcggcagccgccaggtgaggtcaagattttctgggggtgggaaaaaagaaccaaaaactaatttagacatgtcatcatcatcatcaatcaacacctgtgctgctgccacaggcaaaaggagatgctgtggacttgatacatttcacctcatcccacaaatctaaactgtttcttctttctccctatctcctacgatcctaccattctttgggtctaacgaatgtcggcactgctggccaagtcactagagggatggtcagacttctggtttgttagctgctgccggagccgctgatattgtggggtgggttccattgtcttgaggaggcgccactccccactttgggtctgagtccaacggctccaccacatgaacagcaccatcgctcatgccgaccgcaatctggttaggctccaagggatgcgcagcgacaaccatggggtaaacacttccaccactgttggaaaagatgcaaaaatgggcatcaacaataacatgatggtcgccaggactaagattaccatacccaacagaaacacaaagcagtgtaggcatgtaggggactatacatacctagacatggaaggtggtatgtatgcagaaggtgctatcctgcatcgcagcctaagagactctgcttcgaagactccaattgcaccatcacaagtccggcgtagatgaggagaccatcacatgagtatattgcacttgaaattggagcagggagtgcttctcttggggaccactgcatgatcaagcaatgaggtcaaattcaactatcataatcaatgattgattgaatggatcacaaatgtttatcacactagcacgatgtaatataatacatgcatatattaaattacggtaatctgagaactaaccgagcgcaagcactctagctttgcatcatagatcgccaactggctctcatgaaccaccaaaatatgtgtttggtcattgtgaaactgcacccttgtatcaccaactaaagcaccagaacgatttgctggagattggatatatcttgatttcttcttttcccaaccatcaatgctccaagcacatagctgcaaaattccattccaatgaccattgattcagaaacaaatatatagtccacttgccaccgcgatcagaatcttttttttttaacaaaacaggctaaaggatggctagacatgggactaacaagagcatggaggatgaagtatgcacacaaagtgacatttaattctgcacaatatataggaaaattcatacctgagcatcagcacctgaagatacaagcatattcattgactgcgaaaatgccagcccagtgatcttttttgaatgtcccttaagcttgcttttaacctatgccatatggttaagacagaaggaatcaattatcactgaaacaagttctcagctgtttaaattttaatcttcagttagttgaaggtcactgagcatttctattgcacataaggtttataagtaaaaaaaaaaatacatatatctaaaacgtcatctacaaaatctcacaagatctg

SEQ ID NO: 58680 - DNA, 2374 bp, Oryza sativa
agtcgcgtgtccgagtcactgtagtcgtcagcgtttgtcgttttgttctgtaactttctttacagctgtgtgtgtgctgagttatccaagagtgtaatcgatacttaatcagcccgatgaggaatgaaagatatgacgaaaaactcaattatctttgtctcataggagtagaatagatctagtgttagggttcttgcggcgaccaccaacttttcccaaatttctactcccgagtgctgaatccgtccatttctgctccctaggtcctgacagctccggcctggcttgactgagggggacacgcaccacctcccaccgaaacaggatgttataaaaccagccctggaatcacatcggaaaccaaaccacggaagaaaacgccataggagatccaaacatgatgacgacaccgaggcacgatatttgataatggagttcagctgaggcctacatctccggggcactgattacgggcgctcctccccgatccagcatatatagcgtatcagagttacaacgactcacggccggtcgccgccggcagccgctccctctcgctatgctaagtcgccatgcggttacaacaggcacgcccctctatttatgagagaacctaggatagagtccgactcttactctaatcttatacctagtacaactcaaagtcctaaactgtaaccgactttgtacacatattcgacacaaactctaacaaactccaccttggcgaatatgccacgccaacctgaatatgttacttgctcgaacctcgtgtactcggacttgagttggttcttccgccgctcacgccgagccgccccgacaagcctccaccaggcttaccgtaaacaagagactcccgctatctctgtaatttcttcctcttgactccacctgcaacagtgctccactttctcacctatcaccacagtcgtcttgccaagcgaaatttgaattccttcctagctgtcacatcatagacttcccgaagaccatgttcacctccatcttccattttcaatttgacttgaactaatccatggctagataacttgtgtcatcaccaaatagataaatcaaactcaccagacatgaagagaaccatttattccttgttgtcttatgaaccgagctaacgaattcaacatccacgccttcccgcatccatagactgaatatccgataattttgagaaaattcaccgttgccttgaatcacccgaagaaattatcaccatagcgctcgctcttcctcttcagtgacgcagatttcatatatccccatcatgtaaaccccacagatcctggatatatcctgtactgccaaacagcccgctgacaccctcaacgatttttacccgctgttgcccgggattttcttcacgcacctttgccccactcctgcaccaccgcagccttgccttcgaatcataacgcagaagccctgatgcacagttattcttgctgtcaattccagccacctagcctccgtgctgatctccacgtccatcgcgactccgagttgataaacaactccgcaaccgtgtcgacctccaccagctacacaaactgcacatcctctgcaattggattccgataccaatttgctgctctgtgaatagacctacacacaatatgccaatggacacccttgccgcatgcatgcacacatccacagccaccacgaaaccaagcttgttcctcgtgactgcatgcgatccatggcaaaagtccaagaagctcctattgcttgatccaattttgttgtgctgctcctgtgcgcaccgtcaccgcctccaatgaccggagccggcccgcgccgaatcccgccggcacctacacaacgaccacaccaagccgtgttcatgccgcacgaagttcgtcgcaaacaaatccgctccgacctccgattgatcagccgaagccgacaaatcgtcatgccgtcttcccagccgccgaacgacccgagcgctacgtctagccgtctccctgtcaaacgcagctcatcaaaaggcccgggccaccccgcccagagtgttcgatccaccgaccgagaacgccgatcgcctccagcttcaatcaacccgagcgtgtggccacacgtctccctgttgagagtagctcaccagaaagttcgagccacctgcctgaagtgtccaacccaccgattggatcgccaatcgcttccgccgccatcaacccgagcaccacatctagtcatctccctgttgattgcagccatcgaacggttcagaccgccgcctgaagtgtccgattccaccgatcaaattccgttgatcgccgccgtgctccaccttgcgtccatgtccgtccctggacaccctgtgtagtcgtcgcggcgtggagcacctccg

SEQ ID NO: 58681 - DNA, 2607 bp, Oryza sativa
acgacaccgaggcacgatatttgataacggagttcagccgaggcctacatctccggggcactgattatgggcgctcctccccgatccagcatatacagcgtataagagttacaacgactcacggccggttgctgtcggcagccgctttctctcgctatgctaagtcgccatgcggttacaacaggcacgcccctctatttatgagagaacctaggatagagtccgactcttactctagtcttatacctagtacaactcaaagtcctaaactgtaaccgattttgtacacatattcgacacaaactctaacacaggagattgacagggacgctgcggcggggagccaggagattgttgctgccgcgcaggtagcgcccgtacctgtcgcgcaggaggacgacgccgcgggcatcgcgaccgccgacgacgtcggagccggagcacgcgacgggctgccatatgatggcgtccatctccaccctgtcgcggtcgcgctgcgcggcgtccaccgagaggaaggggagcggggagccgtaagagtcgggggccccgaggtagcgcccgtaggcgccgcggaggcgcacgtactgcggcagcggcgccgcggcgtcgatcggcggctcgacggcccacaccgcgcagtgcctcgagtcaccgccgccgtcgcgggggaggctgccgacgtagacggacctcccgtcctcgtcggcgtggaggtaggagccgctcttccagatcctcagcgccgcgaactccacctcctggaaaacctccatcatcggctgccgcgcgaggacgttggacaaggactccatggccgcgccgcggtggtgaggcgagcgatcgatgcgcgcgcgcggtggcgaggcgaggcgtagcgagagcgcgcgcgcgatggcgaggcgtggcgtggcgtggcgtggggaggaagacgagagaggcaagtagccgtggaggagtttgttagcgacggttacgtttcgacgccgagggaggcggtggcatttgaaggcgtcgcgactcgcgagaagacgcaggtcgctctctgacaggtgggtccgacggtcagctgtggtcaaccgtagtcaatgacgagtggggcccaagaacacggagtgtagaatttgctcaaaggaagcgcagattcaggattggatttgaaagagtggactctgcaagattcatataaacgagttctgaacttgttctcatctctgcagcaaacaaaacgaatctgcccagtcctttccagtgagtgagtttattgtgaaattttacatacaaaaaacagagttctggacaaaatttgttaggatgatcccatagccaccatggatgcttgatcgcctgaccggttcagtgattcagaactcagaagattcagttacttactgtcatcactcattagaattcagagtcatgcacatttctaacagtaatactatattatattgcaggagtttgatcataaatgcatgtctggtttcattgaacaaatgcagataagtcagaatagtgcggcctcgatcaattggtccagtgattccagaaattcggtgtctgaactagctctcatgacataatcactgcattgaactgcaatgctgcatgccattttgttactttcatgttgattaatttcagtggttctccactatttttacaggcttgcagcaccagaatcaaatagcgagggtaatttaaactagccaaaacatctcagcaaagttcatggaaaatagcaactataacaaagttcaattttaagaaacaatattataactgatgccatgttctaaaaatgacaaactggtttaaggtgatcacaagaacgatggcatgttctacttgttgagctttgatggctcatggctccatgcctccatatgctcattggattttaagtgggtctaattccgatctcttggaggtacggaggttgagagactcggaagaaacagaagaaattcctgatggtgattatgaaccggatgaacctgatgaggattgatctgataaatggtttacagaagaaattatgttatataaagttgatattgataagcacaagtttgttaagatgcgcagcattggggatcgtgctctgttccttcagtggtgtaccttctaacaaaggaattttccctatgttaaaacttgattgtgcttatctttctgatgaattttctgaagaaatgtgtggaaataagattaggcctctgtggcattggtttagttgcttgtagacgtgcctctctgtttggcgagggcacggccaaattagggctatcgtttaattgtaatctcgttatgtttgtcattggctactacatttatgtgtcacaatggtcaaaattgctcggtaaattcggggccagtactatctaagtttggctgacatttagaacgtatgttgcacgtgcacgaatactagaaaactcaaaaggccgaattggccatcattccacgagaaacaacttgatgcttcacaagattcgccaaatttttatcaagaaatcaagaggacaataattcatattgacaaaataaataaataaataaatgcgtcaaaaaaaataaataaaatgtgtggtgctatagctgaag

SEQ ID NO: 58682 - DNA, 7311 bp, Oryza sativa
  unsure (1)..(7311): unsure at all n locations
ccggtgcaggaggagcgcgacgcaggcgctcccctcggcggggctgcaagagaagaccacctggtggtacgcccattccctcgcctgcgccggcgagtacacaagggacgcctcgttgtatgccatgtcgtcgtacaccctgtacctcgtcttgccctttctgctcgtgaacctctcgacgttgtggaggctggtgatcggcgggagggtcgccatggcgccggtgagagggttaacgagaacgagatggaggttgggcgcctcgtcgacggtgaccagccacccctgcgacgcgccgaacacgggccgtccatcgagcagggcggccgggagcgggacacggagggacttgccggtggcggggcagtagagcgcggcggcggcggggccgtaggcgtcgcaggagtagagcaaccacggcggccgtgccgtcgtggacggcaggcggagtcgccggaacgtggcgtacgcggcgcgccaggtggagcagacggcgccggagcggacgaggtcgtcggggtcggccaaataccccattacggtgatgacgacgtcgtccggcagcgccgaccagtctgcgacggcggtttcttcctccatggcggcggatctgccggaggcggccgggagccctactggaaacggatgaattggcggattttttttttcttgctctgctttgcgactgcgatttgcgatgataaaacggccgagtcggagatcgaactgttcagcccatcgcagtgtcagagactgaataattatctggcatggttgtgatctttcctttcctttcccaactcatactctccaatttttcttacgaaaaattgttattgaaaagttattaaaaaaattatattaatctatttttaaatattgtattaatcatgtgctaataagtttgcttgttttccgtgggaggaaggttcccaactccattaaacaacggaactgctatattaatttttttaccgtcgattccgctctaagatttgtgttgagatattttacaatcggatctagaccctctttttacaagttagtcccattatcgcatgtttatggtagatttgttcaagttacattccagttacatactagttacattgtagttacactctaattacattgtaattagattgtaactacagtgtaactacactataactacattgttatctctatataaattggatataaagttgcatatattattttaatacatatatacaagttattattattatagtatagttctagtgaaattatatactatagttagatttgaaagttttccccttaaaaaacactcgacagttttttagctagtcccttaaacaaacgttattgtagtcttaatttgctcttttggtaaaatgttcagcccatcgtcgagtccgatgataaatttgattcatattcgtgaaataggataccggatatctccacctctcaactattaaaatcggtgcaatttgactcccacgatagtttcactgacgtggcgcctatgtagtggtgttgacttgatcttcgactcacgtttttcacctctcttttttgatttgacatggaaatatctcccatcccttctttgactctttttccttttttatacgagaaatgatcccaaatgaaaaatgaataggtgtggaagttataattgtaaataaaccacgatcgaatctatggaagcattggtttatacgttccttttagtttcaactttagggataatttttttcgctatcttcttccgagaaccacctaaggttccgactaaaaaagtgaaataatttaattgaagtaagaagtctncccatctgggagacttcttacttcaattagtcctctgttcttcgaatggatctcttaattgttgagagggttgcccaaacgcggtatataaggcatacccagtaaagcttacaagtaaaccagatatggagatggtgactaaagttgttgtttccatttttatagaatttcaagattacaatggatctacgaaaagatcgtgtatttacaactacaatggaatagtatacaaagtcaacacaaatcattaaatagaatttatggctacacaaaccgttgaagatagttctagacctagaccaagacgaactcgcgttatgtggtgttagaattaaaaaaatatatgtgagacccatttatccgcagagtgactgagtgactggcgcctacctcgggaggccatgcgccatgctgatgttgtcgacatcaacaccgatgagcgcctccttcctcctcccagtcaccgctcaccgacaacatgtggaggaagagaaatggttaggtttgaccgatgttccgtgtctttctccggtatccgacaataacccctcgttgcacactttgcacaatgccgcgtcacccttctgtcttctaagagcaagtttaatagtatagcccactactgactctaattcatctatagccaatttatataatagttgcttactacactattaatatatggtcctacctatcatacacacaatacgtcttagagtccgtgttgcagctggctacagatctgtagcccgctgctcttctctctcatcttttatctcattaaatatgtttgtagccggctaatagtctgctattgccctttgctctaacaacgctttaccctttgctcaacttccttaccttttatttccatcacacgcgttttatcatctgacatcattgcaatatctctctttcgtgcaacacacagatattttgctagtggtaaattaatttcaaatgctcggttggacaatatgtcatatcagggataaaatttgatcctatagcaaaacattattagctattatccctatatcaaactgaaaattttattatgcacaacaagtaaaagaattcatgttttttagcattcaaaaaaaaaggagagaaaatgtaaaagggctagattgatcacaaataggactctaattattatcggcctccctctctagccttcatttcttcgtggatctcttttagcgtacaatgacccatgacaggtatcccaagaaggatgaccaaacagaaaacgatggcaaataccccctcgatactgttgcaccgtggaactaacgggacaacaaagaaagcaagcaacacgagagcaacagtgttcgcgaaccactgcaatatatatgaagaagagttaaaataagaactaatggttagttgaatatataacgaatgtaaacaatagtagctgataagacaacgagacaaaatatacagatatgaactttcaatggtatagctttaatgctctaaattattataagtataggtttgtccttgatcaaaccatttatagaaacagaaaaaaaaaatataacaatatctacaacaccaaattgatttcactaaacccataattaaatatatttttatagtatatttatttttttgaaaaatattgataattctttttataaacttggtcaaagtcaatgatgattttacttgaaacaaactgatggagtacgatttaaagccacataacttatagatggccatctggaccgtccggcacggcacgacccaagcccggccatgcctgggctgaggctagtcgggccggcatggcccgaccgacacaccgggccatgccgtgccagcccacgggcggcatacacggcccaatactactcgggccggcccgaaggcacaatggctcatcatgtttcctcatagaaaaagtctatttttggtccctcaactctgtgggttgtgtttaaatggctggaaagtaagtctattttatatacctcttgtcttgggccttgccttatacaattatttaagtctttgcatccctatattttttttatttgatcgggttgtgctaggccggccgccatgccgagggtgcagcccaggcacaacccggctgtcaggccatgccatgcttgggctgggccaaaattgcatgtttcgagccaggtcgtaggcctcgggccctatggccatctatacacacactcaaagtgggagagctgattagcgactgatcgcgcacggtcgtaggcgcgtggtcagtccagccccttaagtccctcctatatactactaacacattatcatcctctctttttatactactatactgtgtatagtatttatatacatatgtagtgtaaactttgtattacactatgtatagtgtgtatatacacatgtataaacatacgtatataagatatatatatatatatatatatatatatatatatatatatatatatatataaactttgtatacatgcgtataaaaaaaaactttgtatacgtgcgtaaaaatatatacatatatataaactttatacacgacgtatacagactttgtatacgagagtatacaaactttgtatatgtatgtaaaaatatatacatgtatataaactttatacatgtacatatacaaacttggtatacgtgcgtatataaagtttgtatatgcgtttacaaactttgtacatgtctttatatacgtacgtaaaaatatatacatgtatgtatacaaactttgtacacgtgcatatacaaacttgctactaaaaaaccgaaaagggagagaaaaaaccgaacaaagacgaaagaaaccaacgtagaaaaacgagaaaaccggacaaaaaaaacagaagaacggcagaaactaacgaataaaacgagaaaaccggaaaaaaaaccaacgaaacgaacggaaaaaagggaaaaccggaaaaaaaccaatgctacctaactcctccgcgcgcaatccgccgtcccctctccgcgcgcgccacatggctagtcgtgcgggaaggaacgcgcgcgactagtcgcgtattagcgctttcgcactcaaaggctgtactagagtgcatctactatataatcgtttaagaaaatagaaaagaaaaacgatagaaggctcgattgcctctaaaaatgtacttcctccatcctaaaatataaaacttttttggtgtatgtgactatgaatctgaacaggaactcgtagttttaagataagttacatccatcttaaattccttatattttcagaacgaatgcagcataaaaaaaataaaaggctttggtcgaacttgtgtatgtcattatgtgcagtcgtacagagaggggtactgaccacaagtgctctgatgccagcaggggcaccggtaggattccatatatctctctcgatcatcggatgatctgaaggctgtgccgccggcggccgtgccggcgaggccagccgcccttgttccagcaagctgcacaggagatcggggccctccgccgccgcggccttctcctcctcctcctccttcttctcctcccccatggcgaattggcgattcgatcgacaatcaatacagctaaactagctatgcgcgttatgttgaggccgtgtgcacgtacgtacgtatatacgtgtaggtttcggatgcggcacgagcaaaagaaatcatgtcaggttcgagttagacaacttcccggggtgtttttctctggttgtcagctagctagctctacctctgctcatcttatatcagatagtgtgttggaatttccaggcgtcaggtaaagatggggtgaaaagggaaaaacacctgacagacattgtgatactacagtgcatagctagtgaatctcatatatagtatatactagtaaaaggtaatatatcccacagggtatgatgaccaattgaccaatcgggccgacaagtgctaatttgtaacacatgtcaggcaagaatctggacaggaaacacatgtcaggggctgtttggttgaagccctgagccaaaagagcctggcctgatatgtccctgagggatatcctgtgtcatttggttggtggcctgatggtttcattccctgcctgacctgaaaaacctgataggttcattagcctagctcaggccaccaaaaacgagcgcctggctcagtctagttacacaaaacaaaacgcgctaatcaagcttgtcctgtcacggacccacgactgtgcatgcaaaaggtgttggaatattttattgttgaatcttggttggtgcaaacgaaccgaaaatacaacatttgcttatatgcgatagattaggatatgagataccgttttatttaaataatatctaccttaaccatgtaattatgaaccatctaatctcaatttagtttcctcaggcttaggctactaaccaaacaacatttgctcaggctagcctcatcaggcaagttttgacaggatagctaatgcctcttaggcatgtagttttcttaggcacatcactcaggtagccaaccaaacaggcccaaatccacaggccaaacaggccaaattgctaacgtgagactatgcctcccggtcacggtcaacaccagtgtagcagcactgcaaattaagaatgccaaattaattattgcaaggactatatactgttaataacgcaagaacaggtaaccgatcgagcagtttatcgtacctttacccaaaagaatagatgtccaaatgaaactagaacaccaataagaccgaacactccttcccatgtcaaccccaatgacggcagcgctagagctggaactgaagctgaatgggtcggatcagcatgtacagccagtagatatatgccataaatcaccagcgctgagaatgtcatgtagagaatatgacccacatgccgactcaagctcttgcaaatcctctcaccgaacatgccacagggaaggcatacattacccagaccccaaacagatgcaaatgcggcgagcatccagccgtcataaccagccggcagaaaaggtcgggcaagaaacagaactgccaaagaggtgctgaggatgtagacgtagccgatttgccttttgttccaaatctcgtcgtccgcctgtgtatacacattaatatttatatagagagagagagttgtggattgttataataacggagcgttgcttaaggcacaaaactggaatgtatttttttcacaagacaaaaattactaaatttcttgaaatgaaaataacacacaaaaaaaaaggtgtagcagtactagagggggggtgaatggtagagaacaccaaaaacacaaaaactgagcctgagaacactgtgtttaaatctgctggcatcatgtcttctttgaatgcatcttcttcgaagtcaaatgttgtgaatgcaaaaccttctgttgatgcaaaatcattgatttcaaaaccatctacttcacaaacttgtcgtgagaagtacccttgttctttttgcggaaaagatggacatttg

SEQ ID NO: 58683 - DNA, 10637 bp, Oryza sativa
gcatatgtacctactggttctattggtcgtgtgactcagtgttggattccaaaatttcttatttctaaccccaacacagaggcctcgacatcttctcgttcgtaggtattttggcggcatactccccatgtgcattcaacgttgagatggcgattgctttttatggtaacatcaatttatttttggattgacatatttttggttctactctctcgattattagctttttatatgctagtgtttgaggtagtaatttttgttaatacaagtggatatatgtcgattcatgagaaccttggtgatatcattggcaattggatgtcttttttaaaatctttgatttcttcttgatttttctttggggagaattggaggttaatttgagggggagtttgtgctttttcatgcattcatgtttattttatgcatttgctctaattttgaaaataaataaaaataagaaaaataagagctttgttttatacctctagtatattcttgtgcatgctagcaaaataattgaggtctatttgttgctatgttagcttgtatgcattttagtctttatatgaagcttagatattgcttttaagtgagatgatgcatgacactaattcttttacttgaattaagaaaatatgcaatattaatgctagcatatggtttgatttttaaatgcttatatatagctttattgaattgttattcctcaaatagctttgtaattgctcattgtgaaaagagaataaaaaatacgaaaaaataaataccgaatccttggaagcagtcttgacgataaggacgtattcgatgtgagcaaaaataatgggtgccgaatccttggaaacagtcttgacgacaaggacgtacccggaataattgagagaaaaaaatatgagcaaaaaagtctcaaggaaagaaaaagttaaaaattctcttggttgttttgtactaaagctaatttgataaacagtaataaatgcaataggtatatatgtatagtgtttatttttcaacctatgtgcttgtgaatatattgcattataaatcatttgaagtcatgagtccttattgatgatttgagcttaattgtaatatctttgattcatgtttatactatgatgcatgcttgttaactagttgatgaatttatctcccttatcttgcaaaacatgatcattaattgcttttggtacatttcaaagctctcgaaaaaaatagaaaatggaaaataaaaatttgttattacaagtggcaagcatgacatcatttcatttgtgctttattgtcattatttctcttttgaattcttgatgaaatcattgtcaaagggggagaaatatacaaaatgcatgcttcttggaaaggggagaattgaactgaaactgtttcgatttacaaaatgcatgcttctcgaaaaggggagaattgaactgatgaactgtttcgatttttaaaaatagtcgattttgtgctttgattgcaaattgatgggagaaattctttcttttaaaaagggggagagtttttctttttctgctttgattgcaaattgatgggagaaattctttcttttaaaaagggggagagtttttctttttcacttttgtgatttttgtttttatttttcaaaaacacaaatttgcattttggagatgttgccaatgtattcatcaagggggagattgtgaaatcattgtcatgattaataattgtgatgaacaattggctatgcaaatgatttaatcaaagaattggtttgaaaagatgtgcgaatgttagtgtgagtgcgtgtgactaatgtgagtcaggttgtgatatctgtgcccagaaacggttgttttgtctgattgtgtgcaggtgacttgaggtcagccttagtcaatggtgaggaccgggactatgctcaagaggagcagaggtctattgcggtcgggataccatgtaagaaggtgactagagctagtattcttggaggtcaacttcggtcaacagtggggatcgggactaaactcagggaggagttgaggtccagacggtcgaggatatcgggtgacgaagttggatacgagatgtcacacggtggatggacaccgtgtgggagagatcttcgcaacaggcttcacgaggtgtgcgtgcaagtgctggtgttcgcgaaggagattggagtgagaaattgagaaaagggtatatggtgctacagtacacgtggtactgtagcatgcgtatggatggtatctatgcatgtatgttgatcatgcatgtgtggctcggtgcgttcttcatgcatgtgtgatggttcggtgggcttcggtggcagctggctggaggccgaaccggtccaggagcagcagcacgttggcccacgtgcgataggcccaagcaggagcaagcgcaggagatcgagtccgatgcggttgattgcggctgtgcgagttttgggaaattgtaaaaggtttggaaattgagggtttgagtcctactgtgaaaaggagttctacacctattttgagtagggggtttttcatgtataaatagagggggagcgtgaggcttcccggtatcgcttttttatcgcttttcagagcgtggagctgatagtttagttagggtttcgagtttagtcgagatttttgtaaggagtgttgttagtgcactttgtaaacacagagagaagcaataaagttgtcatctactttgagagttcttcgatttgtgtttcatcgggttcggcggttcgaccggcggcgtgcaagcggttcgactggcggcgtgcgagcggtccgaccggcggcggcgacaggactacgtcgagatttccatcgatttgagggtaacttttatttccgctaaaagtttttgggttttagttttctctaccattcacccccctctggtaggcttggtttcttgtgttcgatcctacactcttgagggaaaaaaattacatctccatttttattatggtcatctttattgtcaactgctaccttttgaggtcttttggcagttgaaagttgaaacaagaaaacatattactctaataaggtgcaagctagcaggagatctatgcaacaaatagtatctccaaaaccaagctattaaaatcttgcaatactagtaggaaataacatgatttttcagcaggacaactgcaacctaactatgcctttgttacaccatgccattggaaagtatgaaagacagaaagagcagattgttcagcgggactgtacctttgctgtggctgcggtgccattatccgtcaaaggaagggtataagcattgtgaggcgtcgagctctgcggagcagtttcattgggcctcagtgtgatcaatggcaatctgagaccattggagcctgaaactgcatatcctctgtcggaagaagagctgccggagatgtgagaggtaaccgaggcaagtaacaacaatgcattcagatttgggaatagcaactgatcgtcagctgcagcaatagcaaagaaatcatgcagttaggcacaagtaataacagaggcaagtttaaatagtgctgaacaagttggatataggcttgaactggtttcagaccatccattttaaggtgtcgtagaacagagacaagcagtattaacataccattcagctactactggttttccctatctacaatattcagatcatcatctccgaatttccacaacattcagataaaactatcatcaagaaacacaaaataccaaagtactgaacaatttacagtactgaaaactacaaaatccacattattgaacggacaaaagggacctgaaaaacataaacattgcccacaggaaactcagtcaatctagcaagcttggcaatgaaaaaatgccaggcaatctgcaattagtgaactatactagacttactgatgcagttttaacatttcaagaacttgtgcttcaggaaattcagtcactgtcatcacttgtcagaattcagtccctgtcatctacggaatcatcaataatctcaagttatgcagaccattcagaactacataaacaatgttcagagaattcagacacatgcatatcgagctagtctgcttaccttcactgttgggcctgacaaggacgatgtgcagggtctcccggctgcgaggcaggtcgatgagcagaggagttagccgcccatggatgccggcgcggacgcagagtgtaaactcgtcgtagcccagaatgcctgcgagcttctctctcaggagctggaccgacttcccggtgaacacgtcgatgttgccggcggcgcctgcgccggccgtcacgaactggatctgccgcctcagcgggggaaagcacgccgcgacgagattcttggtcaagttgcactgcacaaaatcaacaacagcagcacaacgaatttgataaaaaaaattcacagattgttacatggttcaagattaatctccgacccaatcaatcatcatcaagacttcttcaactagaaccagaacaatcctcttgttgtagaattgcataaaggacacaacacaaacacaagaattgaaggaagagaggggatcaggagagaggaggagtaggaggatctcacctcagtggcgatcgggagctcaggtctgacttgactcggggtgacacgcaccacctcccacctcagcgacgtttcgttgtcgacgtcgctgtggacggagacgccagggcggcgagccaggaaggtctggttgccgcgcaggtagcgcccggacttgtcgtgcagaaggacgacgcagccgcgggcaaggtccgggccggagcacccgacggcgcgccacatgatggcaccgacatccagcacgtcgcggtcgcgctgcgctgcctcgagcgagcagcagccctcgcgctcgcggtcgggggcgtcgggggacccgaggtagcggccgtaggctccgcggaggagcacataccgcgtgggaggcaccccggcgaccacctcctctacggcccacaccgcgttgtgcagcgagccgccgccgctgccgccgcgcaggttgccgtggtagacggaccgcccgttctcgtcggcgtggaggtaggagttgcagcaccacacccgcagcgccacgaactccactccctggaaaacctccatcgacggccgccgcgcgtggatggagtggtacgaggactccatgatctggtcggagagtcgaacgcgcggtggcgagacggtgcgtcgcgtcgcgtcgcgcggccgcgcggggaggaagaggatcgagcgatcgcgacggcgatggccgccgcacaagaggtggcggcgtgcgcgcggtggcgaggcgtggcgtggcgtggcgtggggaggaagacgagagaggcaactagccgtggaggaatttggtggtggtggatttgaaagcgtcgcgaggaggaggacggaggcgcacgtcgcggtctgacaggtgggccctctggtcaatggtcaacctcgtcaatgacgggtgggcccgtgggcaccgtggccacgtaaaacttgggggcgacctgcaaaattcatgcaaacgagtttctgaacctgttcagatcgctgctgcaatcaagatgaatctctccagtttcaaaagagtctgaactctgaagtcacactgtgtctgcatgctgcaatgtttcaaaaaaaaaattgaccaccatcatacaaatcgctcaagataaaacgcaatatactctctttaataatgtcaatctatcggtctgcatgtcaatagtgaactatcctagactcgctgagtcatgtgttcttcactttttgatgtaacaattggtttagggtagataatcaccgtaacaagtaaaagcagctactacctaactagattccacacttgacattaccaaacttcacgagattaagttactgtcatgacttcagaattcagaacatctgaccttaatcaatatttttgtcagaagtgaatttacagaatgaaattagaatctgtccagttattttcaaagaagtgaatttacagagttatgaaggttccatggactcagattcttaacttttggaactaacagattcagcataggacgcagcatctgcaaactggcaccgtcaaagttcctagatattttcgttaagcacactggacaggggcatgccattactcatcagaattcagaacgatggtcatatttctaactagtttagcatgaactgtaatacatattgcaggagagttaagcacacattcttgtcatcaatccgtactaggcatgaagactaattgtcaccaaaaccaatattttcgttaaaaaaccctgtttcacttttaccgggttttcgaagtatgtaaactgcgtaaaaacacccattgtacaccctgacaatttcagttttttcctgtcattctacaactgagagcaacataaaactgcatttccggcatcgactgaaaattctactctatgcctctaaaaccaacacactgatcttcgctcgatttccctgagcctgtcagaaattcagcatgaaaggattcactgaatcaatccctcctccgatgcctatatctcctacgtcacgatgcatccggatctgggaatgtcaaccgatgatccgctgcagtcatagcagagaaatatgcagttagacagtgcccaaacagtactactcctgcaagtaaaaaaaacagtgcaagcaattctgcaaatgaagatactactcggagttcccgtctttcgcactaagcactggacgatcattttcacaacaaattgaaactaccatccttcatatatgcaaaccatctgctgttgcatgataataatcagaacaaagtgaaattagcatccattctatatgcagataataagaactcgaaatggtttcagacaatccattttaggtgacagacccaccacaacaatagttctaggccagatcacacagtattaacataccatttagctactactaattcttcttatctacatattcagataaaatcctattcccaagaaagcatagtacaccaattgcatacaattttcttgtgacgcctgacttgcattccatcaacagaaaattcctcacatttgtcagcaagtaaaaacaattcctactgcaatgttcacttctgctgttctactacaatgttcttcagaaaactcctaactcagcaagtaaaaacatgactgcattttccacaaacagtgcactgagaactggaaaaatctacggtgctgagataaccaaaaggaccagaaaaggagatatatgccattcagaacaacataaactatgttcagaaaattcaggaacatgcatatcgaaatcgaagctaggctgcttaccttcgctgttgcgcctgagagcgacgatgtgcagggtctcccggctgtgaggcaggttgatgagcagcggggtgagccgcccatggcggccggcgcggacgcacatcgtgatggcgtagcccacacggttctcgagctcgtttctcaggagctgcaccgacctcccttggtactgaaacgaatcccagacgatgttgccgtcgccgtcgggcgccacgaactggatctcccgccgccgcggggggaagcatatcttgacgaagagctcagccaagtcggcctgcacaaaatcaagatagcacaaggaatttgatcaattcacggatgatctcccacccaatcagcataacagattgtagcagaacgaagaacgatgacgcaaacaagttgtagaatcgctagaagagaggggagaggatcggaggagctcacctcagtggcgatcgggagctccggcctgcctggactcgggaggacgggacgcacctcccaccgcaactccttctcgtcgtcgctgaggcggccatcgccgacggtgaggctggggcggccaccgcaaaccagggtactcatcagtttgccgcgcaggtagcggccggacttgtcgtgcaggcagacgacgtggccggtcctcctgacggcacgccacatgatggcgtcgaccaccggctggtcgaagtcgcgctggccgacgacgggggcgggacagcagcaggagagcggccagcggcgctcgacggcgtccggggcaccgaggtagcggccgtaggcgccgcggaggagcacgtactgcgtcgggggctccccggcgacggccaactgcaccgcccagatcgcctcgtgcgaggggcggcggcctgggtcgtagtggtagaccgacctcccgtcctcgtcggcggtgatgtacgtctcctcccacaagttccgcagccgcacgaactgcgcaccatggaaaacctgcatcgcggcccgccgcggatggtgcgccggtgatgcgcgcgcggcggcgagtggcttgctactcctcggcttctcggcgtggcgtggcgtggcgcggcgcggcgtggcgtggcgtggcgaggaaggcgagactgcgagagaggcgaggcggtggtgcatttgaaagcgtcgcgaggagaggagggagacgcaggccgctctctgacagatgggtcccctggtcaaatgtggtcaaccgtagtcagtgacggatgtgcccgtgcaaaatgttgaatttgctcaaacgagggagcgcagattcaggattgagtagactctgcaaaatttttaagaaaaaaacgagtttctgaacttgttctgatcgctgctgcaatcaaaacgactctgttcggtttcaaaaatgtatgaactctgaagtcacactgcctctgcattcagctgcagtgtttcaaagaaaaaaaatggtcaccaccatacaaatcgctcaagataaaacgcaatatagcaaacttggcccttaaaaaaaatgcatcaatctgttttgaaaggaggaagtaatcagtctgttgttcgcttctagagaactctcttgtcatatttttttttactttttgatctaaaatttggtctagggtagacaatcaccgactcaccgtaacaagaaatgtagcatctccaaacttcaggagattcagttactgtcatgactcttcagaattcaaaacatttggcattactaactgtcaacttaatcaatatttttgtcatgactgaatttacagagtgaaattagaatctgtccagttcttttcaaagaagtgaatttacagagttattaggaagattccatggatgatcgatccatcagtccttcagccggttgttcttaacttttggaactaatagttggtttagggtaatcacaggaacaggtaaagaactactctactagattctgcatagcaaagcagcatctgcaaaccggcaccgtgaaagttcccaaatagatggagagggacacgctattactcatcagaattcagaacgacgtgcataattctacctagtttagcatgaactgtaatacatgttgcaggagttaagcgaacattcttgtcataaatccatactaggcatcatgactaaattgtcaccaaaaccaatattttcgtcagaaaaccctgtttcacttataccgggttttcgaagcatgtaaactgtgtaaaaacacccattgcacaccctgacaatttcagtttttttctgtcattctacagctgagagcaacataaaactgcatttccggcatcgactgaaaattctactctatgcctctaaaaccaacacactgatcttccctcgatttccctgagcctgtcagaaattcagcacgaaaggattcactgaattatggccctcctccgatgcctatatctccgacgtgatgatgctttgggatctgggaatgtcaactgattatccgctgcagccatagcagagaaatatgcagttagacagtgcccaagcagtactactcttgaaagtaataaacagtgcaagcaattatgcaaactaagaacttgaacaggtttcagacttgaaaccccacaattaaggtactacgaggatgccgaatctcacactaaacactgatttgacaataatcaaaacaaattgaaattagcatccattctatatgcagataataagaacttgaaatggtttcagacaatctattttaaatgacagacccaccacaacaatattaccataccattctgatactaccaattgatgttatccacaatattgagataaaatcctatcaattgcaaacaattttcttgtgatgcctgactagcattccatcaacagaaaattcctcacatttgtcagcaagtaaaaacaattcctactgcaatgttcacttctgccgttctactacaatgttgttcagacaagtcctaactcaacaagtaaaaacatgactgaattttccacaaattccacaaaacttactgaaaactggaaagatctacagtgttgaactaacaaaaaggacaagaaaaagatatgcatgccattcagaaacatcgcccacagcattgccaacaatttcagaacagcataaactatgttcagaaaaattcagaagcatgcatgcatatcgagatcgaaccttcgctgttgcgcctgagaacgacgatgtgcagggtctcccggctgtgaggcaggttgatgagcagagggctgtgctgcccatggcggccggcgcggacgcacaccgtgatggcgtagcccacacggtcctcgagctcgtttctcaggagctgcaccgacctcccctcgtactgaaacgaa

SEQ ID NO: 58684 - DNA, 11003 bp, Oryza sativa
  unsure (1)..(11003): unsure at all n locations
catcacagattgtagcagaacgaatgatgacgcaaacaagttgcagaatcgcatagaggacacgcgacaaacaccaagaatcgcaacaagagatgggagagaggatcggaggagctcacctcaggcacaatggagatcgggagctccggcctgcctggattcgggaggacgggaagcacctcccaccgcaacgccttctcgtcgtcgttgaggcggccatcgccgacggtgagtctggggcggtcaccgagaaccagggtacccagtttgccgcgcaggtagcggccggacttgtcgtgcaggcagaggacgtggtcggcccgcctgacggcacgccacatgatggcgtcgacctccggctggtcgaagtcgcgctggccgacgacgggggcgggccagcagcaggagagcggccagcggcgcacgacggcgtccggggcaccaaggtagcggccgtaggcgccgcggaggagcacgtactgcgtcgggggcgccccggcgaggaccatctgcaccgcccagattgcctcgtgcgccgggcggtggcggtctggggcgtagtggtagaccgacctcccgtcctcgtcggccgtgacgtacgtctcctcccaccagttccgcagccgcgcgaactgcacgccctggaaaacctccatcccgcgcgcgccgccgcggatgggacgacgtacgtacgccggagatgcgcgcgcggcggcgagtggcctgctactcctcggcttctcggcgtggcgtggcgtggcgcggcgtggcgtggcgtggcgtggcgtggcgaggaaggcgagagaggcgaggcggtggcgcatttgaaagcgtcgcgaggaagagggagacgcaggtcgctctctgacgtgtgggccctttggtcaatgaggtcaaaagaagtcaatgacgggtgggcccgagcacagtgaatgggcgtcgcgaggaggagaggatagaagagtcacgggttgccagttgcgcacagccagatagccaatgactggtggggtcaggcacagtcaatgactggtgggcccgaacacagcgggtgcaataggattagccatcgacgagccgtgctaacttgaacggaactacggaagatgtgtgaaatttgctcgaacgaggcgcacatttaggattgaatttgagtacactctgcaaatttcgtacagaacgagttctgaacttgttctggtcgctgcaaacaaaacgaacctgttcaaaggagtgaatttacagagttcggttattctctttttgcttaagggtgattaacatgagttactatgatatgtagaagacttcatcgggctcattaacatgaggattttcttggccgtgttgtttttgcaaaacaaataaaattcgaagtctgaactccaaagtcatacacaacattcaactgcaagtcattttgttgccatttcagtggtacatttgcttcaaggtgatataatatacagtagcaaacttggccacgaaaaaacttcaagcaatatacaagttaatggtgaactgtcttgtttgtgttatgtacggagtagtacttttgcatcaaacaatctgtttagagtaatcaccgcaataggtaaaaactaccaactactcggtacctaggtagtagaagcaattactcctgaaccattatctaaaaaaagcagcatctgaaaactggcaccatccaacatattgctaagtagaaatatattactgctgatgctaaacttggtagaaatatgcatgatgtgactgaattctgatgaatgattacagtaactgaatctcctgaaccattcaggatttcaggtagtatccctttctgtttgggaattttgaaggtactagtttgatatgtggaatgtagttaatttagtaattctttttacttattccagtgattgctctaaaccaattgctggagagttcttgaaaagtttaaacatgcagatttcttgacagtttgtcatggccaagcttgctacactactacaatgtattgtggtgctgctacaacggtgaagaatcactgaacttaaactgaaagtaacaaaatggcatgcagctgaaatgtaccagtacatgattctgaattccaactgaatcttctgagttctgacttctgaatcacagaaccgatcgatcgaacatccatggtttgccactcaaattctgtaaacagagtcgttttgtttgctgcagagatgagaacaagttcagaactctcttcttttgaagtatgaatcttgcagagtccactcaaacccaatcctgattaacctgcgccgcttcatttgagaaaatcctgtaccatgaaatctgccgcactccctgttctcgggcccacccgtcattgagtacggttgacgacagttgactgtgggacacacgtgtcagagagtgacctgcgtcttctcgcgacgccttcaaatgccactgccgcctcggcagaatccaggaggagaggaggattggagcatcgggagcagagatgggactcaaccacaaacccgtgcatcacctatagaaaacctagaaaaaggagaggatgtgaagagcagctcaacccagatcttggaggagggaggcttggcgctgcatctcgctggaggggaaggactggcggcggcggcgaccttcgttcgcgagaggggaatcgtcgctgcggcacgcgagcgacgcgacgagattttccacgtggatcgggccgggaatttcccagctgatgggcttccaaatggtccggaaaattggcccgtggaattttactgcccgggctggccggccagggaataggccgggatccagtattattcaggtggtgtttggatccaggacttaactttagtccctatatttagacactaatttagagtattaaatatagactacttacaaaactaattacataaatgaaagctaattcgcgagacaaattttttaagcctaattaatctataattagagaatgtttactatagcatcacataggctaatcatggattaattatgctcaaaagattcgtctcgcgaattagtccaagattatggttgggttttattaatagtctacgtttaatatttataattagcgtccaaacatccgatgtgatagggacttaaaagttcagtctcatctaaacagggcctcagtctctgactcggtgatggcctgaacagttcgatctcggactcggccgttttatccttttaaataggtcgatgtgcatgcgctagcgcgaccgaaccatccgagcaaatcgcaatcgcaatcgcaaagcagaggaagaaaaaaaccaattcatccgtttccagtagggctcccggccgcctccggcagatccgtcgccatggaggaagaaaccgccgttgcagactggtcggcgctgccggaggacatcatcatcaccgtaatggggtgtttgtccgtcctcggcgacctcgtccgctccggcgccgtctgctccacctggcgcgacgcgtacgccacgttccggcgactccacctgccgtccacgacggcgcagccgccgtggttgctctacgcctgtgacgcccacggccccgccgccgccgcgctctactgccctgccaccggcaagtccctccgtgtcccgctcccggccgccctgctcgatggccggcccgtgatcggcgcgtcgcaggggtggctggtcaccgtcgacgaggcgcccaacctccatctcgttctcgtcaaccccatcaccggcgccacggcggcgctcccgcccatcaccaccctccacaacgtcgagaggttcacgagcaaaaagggcaagacaagatacagggtgtacgacgacatgggatacagcgaggcgtcccttgagtactcgccggcgcaggcgagggaatgggtgtaccaccaggtggtcctctcgcgcagccccgccgaggggagcgcctgcgtcgcgctcctcctgcaccggccggacggctatgtctcgttcgcgcggctcggcgacgagcggtggacgccagtcgcgtacccgggacaggactgctccaccggctgtcgccacgccatctacgatgacgccgatggcctcttctacacgttgcggtacgacggctccgtctacgcgatcgacgtccctcgcgccgcggccgcgtcgtcgccgccggcgacgagagaggtcatgcggagtgtgacgaacgcggacaacggcagcaagtacctcgtcagggtgccatgttccggcgatctcctgcaggtctggaggttcgtcgactacgacgacggcgacgaagtcgaagaggatgaagacgctgaagatttaccactcggcaccaagcacctgcagatcttcaaggtcgacggcggcgagcagaagctcgtggaggcgtcggcggcgagcttggaggatcatgtcctcttcctcggtcacgggttctcggcgtgcttcccggccgagcacttcccggcgttgaagcccggctgcgcctacctcgccgatgaccacgaactcgtcagcgtgagtaagcattgccggcgagacattggcagatgggacatgaagagaggtcagatggaaaggctctccggcgaagatgacgtggcggcgccgtctcagccttggctcaactggccatctcctgtctggatcacgccaacattctactagcgcatctcgtgcctttagttagcacccacacattttatttattttgtcaatacgaattattgttctcttgtgaagcatcaagtagtttctcgtggaatgatggccaattcggtcttttgagttttctagtatctgtgcacatgcaacatacgttctaaatgtcatgtttaaatgtcagccaaacttagatagtactggccccgaatttaccgagcaactttcaccattgtaacacataaatgttgtagccaatgacaaacataacgagattacaattaagcaatagccccatgctgtgtttagttggtggtccaaaatttattttgaagtatacggacacatttgaagtattaaacgtagactaacaacaaaacaaattataaatttcacttgtaaactacgagacaaatatattaagcctaattaatccgtcattagcaaatatttactgtagcaccacattgtcaaatcatagcgtaattaggctcaagagatttgtctcgcaatttacatgcaaactgtgcaattgatttttttcgtccgcatttaatgctctatgcatgtgtccaaatatttgatgtgacggaaaagttaaaagtttaaagcaaaaagtttgaatataaacagggccctaatttggccgtgcccttgccaaacagagaggcacgtctacaagcaactaaaccaatgctacggaggcctaattttatttccacacatttcttcagaaaattcattagaaagataagcacaatctagttttaacctagggaaaatccctttgtacaccgctaaggccttgtttggtttggaggggatcgaagaggattggaggggatcgagtgggaataattccacaccacaataggtgtggaatgaatcccctccaatccctccatcacaggaaatctgggattaaccgcacaagaatttaatccgggtcaggaatgacaagtatagtaagaaatttatgatagatacaacatgagaccaggatttatttcgggccgggaaccaatttactcatgatagggacaataagagatcaggaatcaattcactagttaagaggtataaaactttttgttgtacctagctaatataagtaaattggttcccgacccggaataaatcccgatctcttattgtacctattataaatctcttgttatacctatcattcctggcccggaacgaatccttgtgtaaccgaacaagaacatagcatgatccccaatgctgcgcatcttagcaaacttgtgcttatcattatcaactaaataaggagtataacacataatttcttctgtaaatcctcatcaggttcatccggttcataatcaccatcaggaattgttcataatcaccatcaggaatttcgtctatttcttccgagtctctcaacctccgtacctccaagagatcgggattagaccaacttaaaatccaatgtgcatatggagccatgagccatcaaagctcaacaagtagaacaggccatcgttcttgttatagttgttcctgtgatcaccttaaaccaattcttagatcagcaaggtacacgagatagttcttgaaaagttaatagcacatcaatttgtcttgagtgacttgtattctggtgttgcaagcctgcaaaaatagtggagaaccactgaaatcaacctgaaagtaacaagatggcaatgcagctgaatgcagtgacagtgagtgtgtcatgagggctagttcagacaccgaatttttcctggaatcactgggccaatcgatcgaggccgcactattctgacttatcagcatttgttcaatgaaaccagacatgcatttgtgattaaactcctgcaatatactatagtattactgttagaaatgtgcatgattctgaattctaatgagtgatgacagtaagtaactgaatctgctgagttctgaatcactggaccgatcaggcgatcaagcattagttatgaattctaatggtggctatgggatcgtcctaacaaattttgtccagaactctgttttttgtttgtaaaattcgacagtaatttaaactcactcactagaaagagctgggcagattcgttttgtttgttgcagagatgagaacaagttcagaccacgtttgtatgaatcttgcatagtccactcgttcaaatccaatcctgaatttatgcctcctttgagcaaattattttttgtttacaaatatatcatttcacttattccaacttaaagaacaaccggacgaaggactgatggatttccaccttggaatcctactaagttcctaaggatgtgtttagttcagtgcaaaatttggattttagttgaatttcgagatgatatgactgaaaagttatatgtgtatgacaggttaatgtgatggaaaagaactgaagtttagatttaaactttggatctaaacacagcctctgtaaatccaaatctttgaaaacaagcggatagactctgtaaatcttgaaccttccatcgatcacaggttcactgtgcacgggcccacccgacttcggttgaccagggagcccacctgtcagtgagcgacctgcgtctccgtccctctcctcgcgacgcctttaaatgccaccgcctccctcggcgtcgaaacgcaaccgtcgctaagaaactcttccacggctacttgcctctctcgtcttcctccccacgccactcgccaccgcgcgcgcgccactctctcgcgactcctcgccaccgccttcggaccacgagattccggcgactttatggatgatgaattcgtgggagtggtacagatcgacggcggcggcggggacgggggctggggccctgttggagcagcggcgggcgtcggcgaggtcggcgacggtgcccttcctcccgatgcggtcgcgggagccggcggagccgatggagtggacgagctgcgccaagcagaggcgagactccgaaaactatgcttggagtacaccggcacgggcagcatgccatgcgccggctgctatctccgactcgataaaggaattcctcataagaagtttaagcttctcctcctcaaggggaatggagccaagcgtcatttcgagacagtgcataaanctcgacaatgaataagaaaaatatcgctgcataaaactggcggaagctacttccgcagtaaagaagaattcgagaccataaagaccgaatccatcaataagctcaccgaggtgagctcctccgatccgctcctcttctcttcttgtgttcttgccacggtttggttctaattgtgacgacgatggaggttttccaggaggcgctgaggatctggaagagcggctcgtacctccacgccgacgaggacgggaggtccgtctacatcggcagcctcccccgcgccggcggcgactcgaggcacggaacgatgtgggccgtcgagccgccgatcgacgccgcggcgccgctgccgcagtacgcgcgcctccgcgccgcctacggccgctacctcgggacccccgactcctacggctccccgctcccctcctcccggtggacgccgcgcagcgcgaccgcgacagggtggagatggacgccatcatgtggcagcccgtcgcgtgctccggctccgacgtggtcggcggtcgcgatgcccgcggcgtcgtcctcctgcgcgacaggtacgggcgctacctccgcggcagcaacaatctcctggctccccgccgcagcgtccctgtcaagccctacgtcgtgaacgagcatatgtttcggtgggaggtggtgcgtgtccccctgagtgaagccaggccggagctcccgatcgccgctcaggtgagctcctcctctccgttctcttctcgtgtgtttgttgcgtctcttggagttgatttgggtggcagatcaatcttggttgttgcaagaactaaccgttttgctctgtgaattgatcgaattccttctgctgccgttgttgattttgtgcagtccggcttggtcgcggcgtgcttcccaccgctgctgcgcgtgatcgagttcgtgggcgaagacgacctcgacaacatcggcgagggagaaatctggactttggttgagaccagagggaggtcggtgaggctcctgaaagagaagatcgcgaagcttgtgggctacgacgacttcacgatgtgcgtcagcgccggccgccatgggcagttcacccctctgctcatcgacctgcgtcgcagccgggagaccctgaacatcgtcctcctcaggaccaacagcgaaggtaaacatcccagttcgagtatgaatgttgctgaattttctgaacaatgtctatgtggttctgaattttgctgttgttgacgagaaatcttgtgttatgtagttcagcactgtagatttcctagcattgcgtttctgcctgtctgttgaatttgtggaagatgcagttctgtgtaaaatcttgttcctgcttgttgagttaggaagtgaaattatgtctgaacttatctgataaattttgaagtgaaattatgtctgaacttatctgacaaattttcatgttaggaattaccagaaaatcgtatgcactaattctgtgtatcttggcaataggacttatctgaatatagcagacaagcagaaccagtagtagttaatactatgtgcctctagctaacgactactattgttgttaggcacaactaaaatgcatggtctaaaaccagttcaagcgtttattgtctgcttaacttgctctgaaaatgatcatatcagtagttcagtggtgaagttcaacttgtttcgagtaacattttacttgcagatttacttgcaccgtttttatttgcaagagttgtactgcttgtgtatcatactgtcaatgatttctaactgcgtgattcctttgctatggctgcagcggataatcagttgatattcccaaatgtcagtgaaattgctgtcaaatggatcaaggcgaaccaagattgatttagtgaatccttttgtgctgaagttttgacaggctcagggaactcgacagaagattagtgtgttggttagagacatattgagtgaaatttttagttcagccgattctggaatacagtttcatgtttgctcagctgtagagtggctgaaaaatctcaaattgtcagggtgttcaatgggtgtattaccacggtttacgtactttgtgaacagggttttctgacgaaaatattggcatggtgacaattagtattcattcctagtatggattgatggcaagaatgtgcttaactactgaaatatatactgttcaagataagtgaactttgacgagtgttctgaaatctgatgcatggtgttctgaattctgatgtgtgttagaatatgcatgggttctgaattctgattagtgatggcagtaactgaatctcctgaaggctgaagcattcagggcgtgtccctgtccatctatttgggaatcctgacggtgccaatttgcagatgctgcatgctgtattgctgtgctgaatccagttagttgcttgagtatagttccaaaacttaagaacaaccgggcgaaggactgatggatttccaccttggaatcctaccaagtcctaactctgtaaattcacatcttggaaaagaagtggacagactctaatttcaccctgcaaattgacttctgacaaaaatattgattgaggtgacaattagctatgtctagtatggattgatcacaagaatgtgcttaattcctgccatacattactggtactgttcattgtaaactaggtagaaatatgtgtatgattgagctctgaagagtgatgccagtaactgaatctcctgaagtattcagggggcgtccctgtctttcaatttgggattttggacggtgctagtttggagatgctacatgctatacgtggaatttagttagttagcatcctatccctccatcacaggaaatctgggattaaccgcacaagaatttaatccgggtcaggaatgacaagtatagtaagaaatttatgatagatacaacatgagaccaggatttatttcgggccgggaaccaatttactcatgataggcacaataagagatcaggaatcaattcactagttaagaggtataaaactttttgttgtacctagataatataagtaaattggttcccgacccggaataaatcccgatctcttattgtacctattataaatctcttgttatacctatcattcctggcccggaacgaatccttgtgtaaccgaacaagaacatagcatgatccccaatgctgcgcatcttagcaaacttgtgcttatcattatcaactaaataaggagtataacacataatttcttctgtaaatcctcagggctgcaggaa

SEQ ID NO: 58685 - DNA, 2184 bp, Oryza sativa
catcggcgagggagaaatctggactacggttaagaccagagggaggtcggtgaggctcctgaaagagaagatcgcgaagcttgtgggctacgaagacttcacgatgtgcgtcagcgccggccgccatgggcagttcacccctctgctcatggatgccaacttcgagggcgaagatacgttgctgtgggaggtggtgcgcgtccccccgagtggagacatgccggggctcccgatcgccactcaggtgagcttctccgatccttctccgctctcttcttgcgattcctgtttttttgttttgtgtcttgatgctgatttcgtcggaaattaatcttgatttcttgcaagaattaaccgtgcagtacaatttgtggattgatcgaatttccttctgctaccgttgttgattttgtgcagcccgggttcttcgtcagggcgtgcttcccccagccgctgcgggagatccagttcgtggacgaagccgacctcgacaacaccagcgagggagaaatctggactacggttgagatcagagggaggtcggtgaggctcctgagagagaagatcgcggagcttgtgggctacgacgacttcacgatgtgcgtcagcgccggccgccatgggcagttcacccctctgctcatcgacctgcctcgcagccgggagaccctgaacatcgtcctcctcaggaccaccagcgaaggtaaaaatcccagttcgagtatgaatgttgctgaattttctgaacaatgtttatgtgattctgaattttgctttgtctctgtttctctgattttgttacgtcagtccagcactgtagattttcctgttttcagtagtttgtgcctgttgtggaatttgctgaaaatgtagtcatgatgtgtttgcttgtagagttaggatttgtctgaagaatatactgtagaacagcagaagtgaaattcatctgccgaattttaatctcggccaccaccagacaattctatgcactttgggcttatctgaatgttgtagggtttatctgagctttgtagactttttcacacaatggtctgaatactgtagctgaatgcttgattggtatgtaaatatggtgtgcatctgggttattactattgttgtgactcagaactaaagtggatggattgaaacaagttcaagcctgcattgtctattcaacttgtttcacaatgatcatatcggtagtttagtgtgaaattcgacatccaatatgcatgttgctggattttctgaacattacttatgtaattcttaattttgctctgaaaggaatgcatggcatgacgtgggcagtgcttctgtttttctgggcctttttagctagttcagctcatctttttttgtctgttaggacttgtctgaagaatactttagaacgacagaactatacaagtgaaatatatctgcacttatctgatgaatattcatttcaggcatcatcagacaattgtgtgcaccttgggtttaactgaatgctgtaggattcatctgaatgttgtagatttttcagtgtgaaattcagcatccgagtagcattttaacatgtgaattactggcactgtttttacttgcaagagctgtaattcttgtgtattactctttctaactgcgtgatttgtttgctatggctgcagcgaatgatcagatgatattcccgaatccgaatgcattgccgtcagcagaggccacagatgaagacaatgccacgattgagtgaatccttttgtgctgaagttctgacaggctcagggaactcgacagaagattagtgtgttggtatagggtggaattttcagttcagccgatgctgcaatgcagttttatgtttgctatcagctgtagaatggctgaaaactctgaaattttcagtgtgttcaatgggtgtttttcgacggtttcacatacttcggaaaccggtaaaacagggccttctaaggaaaatattggttttggtgacaattagtattcatgcctagtatggattgacgccaaaaatgtgcttattcctgaagtatattagtgttcatgctaaacttggtagaaatatgcatgatgtctctgaattctgatgaatgatcacagtaactgaatgtctgaatctcctgaggcattcaggcttgctgatgctacatgctatctaccatctagttagtagttctgtct

SEQ ID NO: 58686 - DNA, 2967 bp, Oryza sativa
agtttttacttggcaacttgacaccagcatttccatatcagagtgattcaaggcatttttacataactgcgcgcaatcattcgatgaagtattctcagtcaccgatttggtcagacgaggttcaaacagaccataaggtccataactgtcaccagtgataacaaaaacatatcaattccaaatttacagctgtggcataaaacaaaataggctatcttctccaagtggctatcctcttttcagggagcggggctgcaggagttttctgccattcacaacaaggagagatgagtttcattaggattacagcgcagcaagaaagcaaggtattgcaaaactgccgtctaccaaaattagcttgtaatgctacaataacagctgaaatgttgttaactgcaacaagaaagtgggtgtcattgctggatgacctaacctttctccatctacaatgttgcagatgtgtccaatggctccacagcttgacgatctaaactttctaaagtttctttgctcacctcatcaacttgttccaagaaagacttaaaattatccttgtagcaagtaaactgaagaaggattatattagcaaccaacaattttatcaatgattataggaaatagtcctctaataaaaacataccgcatgtccaatttgttgaaatttagcatatatcagctgtagttcttctgcagcatcagtccttgttgaatcaacttccgcacatagtttagtagcctgtaatgacagaaaaatatgtcaagtatagttgaaataggatcatagtattaacaaataagataatataatctacaggctttagcatattagggagatagtcaggccggtcagcatatgttcctggaccaatactagcgcatacaatgaagcctctttggaacattagattgtattaggtggcatgtggcatgtgaacaccagaaatcaatgattcagagggaaaaagaagttttcaaagacattgagtttgaaccacacaaaatttcaggacgaaatcatcacctttgcaattgtttcctctactttcctttcacgaggttcaagacacttgagtttccattcaacttcagaactcaaagcagccagcttctgattttcgtctgctactatttgatccttttttttttctttagctttaacatgctcctccatttcatgcactaatcaaaaaggtattcatgcaataacgtgaggaaaagagtatttcagaatggaaagagcatacacaaattcagcaatactacaaaaggtaagtacagtttgacaacctttcccatcccattcaataatctttgtgtcagggccataatttcaacactttcatcactaatcttagttttgcgcgctttgacttctttctcaagggctttagttgcagtaacctaacagcaataataaataagagagttactagggtttcatcttaagattaatccaactccataatgaaaaactagcattgcagatgtccatacctgttcttgtaaagcctggattttagtagaatgcttcgacaatttttcataaccctgcaaaatggagacagcatctgcagttattaatggatcagtaggtcaagcatcacaaggaacagtagtaagtagccaagtgccactcttgcaacaagtcagccccaacaaccgcaacaaacagatgatccaaacaatacagtggaatatcaggaaattgaatcaatatgaaacagatgaagtaaccctatatttgctagatattgttacggccaatcggcaaatacaagttaccttctaccttcggtgttttgtaatgaagagtggaacaagactaccttactgtatatctccaaagtggcagttttctcttgtacactttgcgttgctatcttctcagcattctttaattcagcacgagctgttttcttctcttcaagggccctctgtaatacagaataaaatccaaaattagtgatgcaagcttataaagataatttatatgctgttagaagaacaaagtgttgatctgattgattcaaatatatgcatatatttccaaatagcagttgaatagaagcgaggagtattaaactagtgaaagtgtgtcctcgagaatcaagacagagcatctggcaataactgcaactttttaatgaacaaataatatacagagtaaatacgaagttctacggcattggaagaatgtcagttgtgcatgcaaaaataatagtatttacattgtttttcaatttctcacaaactttttgaagagtttagaatggtaaatatccaaatgtccctttaataccagattatgtgaaaaaaaaaacctagatcagcactaaaaactaaacatatagaggacaaaaaccattgcacacgatcactacaaaccatctatgattgtggtgaagtaattcaggtatttaaacaagactgaccatcctgccagcggcaatagagaaaaaagaggaacagatcgaacctgaagcttttctggggactcaacaatttttggcaataacttggaattttcttgtgctagtttcaccaactcaaaatcatttttggcaatctgtataaagaaaataacaaggcgtttagtgagaaatcgtcttttctgcatatctaaaatttcagcatgtcagcgagaaccatttcagtgtagcttaacatatgtcaagagtaaatgatagtgtgttacaatgtaaatgggttttccaaactatttttcaatccaattatacacaaagatcgtcttgtccaaatggcaaagctgcaaaccttctgggttctatccctatttgacctggacgcttctgacatttctaaccaacacaatatacaactggcagttatataatgaccaccaaaagtcggacactcagacctagaagagaatttggcctaatactacagggccaggtgaaacctggtagcaccatatattcaaaagcgcaagtaggattgcaatgt

SEQ ID NO: 58687 - DNA, 5299 bp, Oryza sativa
ttgtatattcccagctagcaattctgtgcgccatgccagaagcatcaaacctcggcaagcttggccttgagctccatgcaccgttcatccaagttggggaactcgtggatgatgggctgcaggagggcgagcttgtcgtccctgtagtagaggaagttgatgagggcgctgaggacttgcacgaggcggcgcgggtcggggcggaggaggtcgcggagcgtgaacccggggaactggatggactcgaggaaagcgctggccctcttgtggaggcggagtacccggatgccctccatgtagtgctccgggttgtcgagcgacgccagcgcgtcgaatcctagctgcccgtcgaggtcgtcggcgctgcaaaatctccacccaacaattacaaacaccgagcgggcggcgccggcgagaggggggagggggaggcgcgcgcacgcacccggtggggtcgacgacggtggcgaggaagttggagatgacggcggggaggagatccggctgcgggttggcgatgtcctccgcgcggaggttggcggtgggggcgaggccgtaggtgtgcagcgcctccgcgatctgctccggcgtcaacggagggaaggagaagttggacgccatcttcttcttcgccgccgccgctctctcgccgccgacgcctttcccccaaatgagaggaatttcgaaggcaaaaaaaaaaaaaagaagaaatgggaggtatttgcccggtttcccgcttcgttttcccgctttgcggaagcggaaaactcgggagcagatgcggcgcttggggagagttctgggcccaaagcccatactcgtgtctaatcttctcgataaaattcggcccagcccaagatgaggcagccagtttccactttccagcccgtgggcatcgcgtcgattggaccagcccaccgaagcaaaattttaggaaattttctggaattttcaggtaaggatgttcgaatctgtccattttagcctgtccacagtgctttgcttctttccacctgtcctgatataattaaaggctagaacattgactaaatggacaagcatgatgggtcctttttggaacaaaaatttccaagaacactttgtattataccccacctattataaagtgactttgtattatatccacctattacaaagtggagttgtcatgtcaacaagcccctgattcattttttgtacagaattacttaaatatattggtcacgtcataacaaagtaacaacagaaacatggaatttatgcagatatgagtacagatgggctgatggtgtacagataaagaagccgatagaagtgtcagcgccaaaatatgtggagttcctaatggactggattgaaggccaacttgatgatgaatctatatttccccaaaagcttggtaatcattgtttgtcacaaacatttgatgttggaatggtcatgtgtaccttagaaatagtgcaggcactactcatatatttgtccaattttgacacaactcatgacactgatatgggtttaattcctttaccaggcacaccattcccgccaaacttcaaggaggttgtaaagacaattttcaagcgcttgtttcgtgtttatgcccacatatatcactccagttttcagaagattgtcagcctcaaggaggaggcccatcttaacacgtgcttcaagcacttcattctgtttacaactgtaagtctcttttgtttgtagattgtaaactcattaccaggattgtttacatttatctcatatttgctcttggttcatagaaatctggggaaagcaaaattcatttgtttccggccttttggtatgtggtgcaggaatttggcctgattgacaagaaggagctggctccactccaggagctcatcgaatcgattattccatactgagaagaatacagggacggaacggatagcgagttctttacatggacgatcgaggaatcagactacttgaaacactgtattactggcatagtagaccttactgttccagatatcagacatagaaaaggacatttgacattgctaatgctatgtttgtgtgtaccgatgttcgttcgtcctgattcggtattgcctttgtacgcgtgcttgtaatgtaataacaggatttgtggattgggatatattgcaaagaaagatctgttaatccaatcgtgagttgcaattgttgcttccttttcccagtaccaacgattcaattgtgtgtgatttcttgtttgttatacacatcaatcaagattggggggaatgaaatgtttgggttaattttatcatggtttagagttggcactaatccaatcaaaatgtaataactgatacaatgaagacgccatagatcatactaactgggagaatggcatcagaatctgagatactatcttgcataccatacacagcccgcaacaatcgagataggggaatgaaatgtttggattaatttaccatgattttagagtttgtactaatccaatcaaaatgccatggttcataaacatcatagtctcatagatcataccgactgggagaagaacaacatcataaatttcagataataagaacacaagatggcaccgatcactgactcatcaggcagcggtttgaaatgaactgtcgatgcaagcaccacgaggcgtggcagatggaagcagaggagaagctgttcctacttaaaacacatacaagctactagaactttctggaagcggatcggtcgatcgggtgttggtgctagagctagacgcggccctcccagaggcacggctggtcgtcggagcagacggcgatgacggcgggcggcggggcgaggccgagcgcggcggcgcggcgccagcgctgggcgcgggtgaggccgaggcagggcccgtaccgcatgtccatgtcgaactcccgagccatcctctcccgcccctcctcctcctccgcctcctcgacgtgcctcctcgcgtcgtcgacggcgcgatctggcgtcgctgcaaaaaaaccgaacaatcgaatcagcggagacgcaatcgatcgaacagtttcgggggcgggagaaaccgggaggagaaaagcaccctgcgacgcgggcttgtggtggtggcggggcagcgccgccttcttggagacgccgccggtgggcttgacgccgccggcggcgtgggccttctgctgccggaagaaggacctgacgtcgccgccgctcctcatggctccggtggactcctctctcgatgatctctatggattgtcgcggcggcgcggcaaggtagggtggatttgggggaaggggaatggatgggaaggggaggggagagagggggagtttatatatggagaggtggtggtgagagggagttgcggccgttgtgacggcgattcgaattttgaaatttgaaaattgggcgtctcgtttcggggtgctaaatccaaccgtccatcccatccatgtcgtgtggaaggctggaaccgtgttcgtttgaacaggttcttggggtgcaaaacgtctgtgccaatgtgccatgaaaccgtgcgtgcattcacacgtagggataaaaaagggtcaggaaacacgctaaaccatttccctattcatattatttttcggaaacggaataaaaacggtaggccggaaacggagatatatcgaaaacataattatttacatgacggtataaattgaaagccgataattcatgtcagaggcaacgaactataacatcacacatttagatagcaatctagcatggttgcatgagacaaattcatcctcactctattcaacacaaatacgtacaaacatgtataatagattgataaatgataatatgatcaagtattcgacaatagttataacttcaatgacatataattgtaagtctataaagcatattaatacgaactaacggtgtgaggaactaccaactaggagcagctctatggtttagcgttatcacaacctcgtgggacactgggactggtatattcaggctaagggaatgggccattggagataacttgggccagagatatttataaaaaaggtaatttaccgaaatatgtaaatggtaattaccaaaaaaaatacaataaccgacaaaacggttggtaaatcaccaaccatttccgataccgtttctgtattttttacaattttcgtttctaggaattaccatttccgtattgtctgatcagtaaacttcagaaacgaccgtccggttggttggtaattactgctaccattttcatccctatttacacaaatagtagtatagtagatatatcatttgtttggttttcaaagatttctagaaaggttctactttttgatttttttttctttgcgaaacacaatgcaagcgcagacaattataaaaacacacacacacactttattttataatcacgtatgaagaccatgctattttccataacattaaactgaacctatgatataacttatattaacctccacgatagaagagaaaactccatctattgcaaagcgcattaccgcttagattgacctaaggaagtacaccttatgttccataaataaacagcttttgaggataaacctgtgtctaaggttgtgctcgagagaagagaaaaggagaagattgaaaagatacgcaaaataaggtgaactattagcgtatgattaattgtgtattaaatattttatgattattaaatattttatgattaattgtgtattaaatattttatgattaattgtgtattaaatattttagacttaaaaattaatttttgagagaagagaaaaggagaagattgaacagatgcgcaaaacaaggtgaacgattaactatgattatttgtttactaattattccaaacttaaaaaaacaaattaatatgatttattaaatcaactttttaaaaaacacaatgttgaatagtttaggaaacgtgcgtgcgaaaaacaaaacaattttctctctttggtgttgctgccaaacgcagccttagatgttttagcccaatatctaaatagcagctttctagtaaatgcttgttctacagttatattttcctaatgcggtagaaatcagccccttcctgtaaaaccaaacatgtagcctctcccaactattaaaatcaatcaaaatacttcgtaatggcactcaaacctttattttaaggagataactaacccgttttgatagtgttgtatttatctgcaataaggaatgaaagaggattataaaccaatatgaaaaactcttttgccatctcactaatataactaggtgatatggtaataagggcatccacag

SEQ ID NO: 58688 - DNA, 7573 bp, Oryza sativa
cacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggttagggccgtcatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctatcattgaattcatccttacggcacgcaagcctactttagggatcgatacaagaaaattggtccgtccatggccgataacaacatagtgtttggcaacatagtgacaaagtacatggaagataaaatcaaaaaggcacggagacatagagttgttgctcaaggcacacaagtgcatcggtatgaaataatgtgtgttgataggagcaggcgtggtatctattacaagcaagccgtgcaggaatgtgtcttgaaggcggatggtggatgtacctgcagttatatgaagccgaagcttatcaccttccttgctcacatgttcttggcttcttgctgctgccggtgattgtggcatatctcccaatgtgtacgtctcaaattatttcaggaaagaagcagtctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctatcgatttagaaaataaaatgctgttgtgatgtgatgagtgttcagactaaatacttctatcgtgtaatttcaattgaatgttgttgtaatgagtaccttcgactattgttgactagtagtattggaactattcggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatagcgtacgacacaccggcgctgttcaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccgtactctacagtcgggcctagcaaggcttggttgctccagttcactgtaagtaaataagttgttattatcatacatgcttatttgcgatcaacagagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgttgtggacttccggctggtccactacgcacggtccatcgcggatgctcagccacaggatgtgccgcagtggagctggggttctgccgtgctagcagccacgtaccgtgccctctgtgaggcgtgaacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagcagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtagcttcctcgcacttgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaattactgaattttttatttccatcttgcataggctgatgccgcacgggatatcagtgccgatatcaccgtagtccaagtgaggttgaacagaggtttgcacttgactgacgttgagcagagggtgaccttcgaccggatgcaggagaagatgcatgcggtcatgcgcgtcttctcctgtcgcagcgccgtggacgtcgtacctccagctggtccgatacaaccacggcctcgcgcgcctaccgtcggagcaggaccttgacctacggcacctgtttcgcatggtactgctcagcccagaggtttcttaagttttgtttctgtttttgtatgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttctacgagctccgcaggggcgttcgccacctcttcgggcgtgttcgccagctcttcctctcacggagcgtcgatccctccccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccatgacgtactaggctcctctcagcttggaggagcaccagaggcgcacactcaggagcagccagaggtcacacctgtacaggcaggacgggttggccgtgctgtacccccggaccgactcacgtactcccaggggcacattagggcgcagggtaggagggacaggggtaagaggcctcgtcagtagtgttctacctcttcaatccttatgtgaccgtttcttttggcttacaaacttgtaaagcagtactacttttgctattactactgcagtactacttgtgtttgtctcgtctacatagttcttttcattcatatggtgctagaacaacttattctcacgacaacacactttcggcgcttcacggtagtgtcagatccagtagcgcgcacagtccacaacagcacacatgaaaagcggcagctcgagttgtcactatcaacttttcgcgctgcctgttgacataaagtgaatcacgcccacgcgtgatcgtcttgtcacatctaatgaataatgtatctcattgagttcacatatatggcagtgaaaacgacgctatataattgacaatctgaaggcaacctcttcatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacacgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggtcaaaggtgtttcgtgtgtccaaacattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactagaggaacaatccattagggttacctaaatggtccgagcgtccaaagtgtgggtgcagagatcgctggcaggtggctacatcctttgctgaacaaacatttggaaggagatattttgtctgccccaatgtagacaacgatttcgttgtatgtctaaccatttacaaaatccgctatgatttgcacaaaattactacccaaactgaataacattactatttttacagggcaatccaaggatgtgtggatttactcgatggatcgacaatatcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttttctacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttataaaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgttaattttcaaaatgaaaaattatttttgtaaaacttttaataaaaaaaattaaaaataaaaaaaattcgtgagttagccggggggttatagttggccatatgggccgcccggcatggcacgggccagacctggtcgtgtccggtacaagatttgtcgggccggcacatcccaacctatatgtcgggccagcccacgtgctccacctctgtgccgtgccgggctggcccgaaggtacgggcaacccatcgtactatttttcaaaataagtctatttctcctccctcttctttgagttgtgacataataggaaaaagtacaccaaaggtccctcaacttgtcattgagttacaaaatcgtcccccaaccgcaaaaccagatataaggcatccctcaacttacaaaaccgtccgctttaggtccttcggttattttgccctcggttttatccgacgtggcggctgagttagcgttggacccacgtggactccacctgtcagcatgacccacgtcatcaccatccttctccctcttctctcccttcctcatctctctctcccttctgtgcggcagtgcgaggcaggagaggaggagggtatcggcagccggcgacgggcgacacgacggcggtgggggatgagctgcggggtgggcggcgagggaggggcggcgtgcgggtggcggcggagcaacgcgcgggagcgggggaaggagcggtgcgcgggctcccccatcggctgccgccctcaaggcccacgaggcggcggcggtgggaggagcggcgggcggacagcgagggaggggcgacgtgcgggcggcgaggagaggagcagcgcgcgggcttccccgccggccgccgcccacgaggcccacgaggcagc

SEQ ID NO: 58689 - DNA, 3633 bp, Oryza sativa
aggaggttgatgacgtgggtcatgctgacatgtgggcccacgtggggtcccacgctgactcagccaccacgtaggacaaagccggggtcaaaaccaccgaaggatctaaagtgaacggtttttgtaaatggcgggatgtcctatatctggttttgcggttgggggacgattctgtaactcgatgacaagttgagggaccttcggtgtactttttccgacataatatatatagctaaaataagtctattttacgtccctactctttggaccgtgccatataatacatctatttatctaacgatcagaaaattgactgaaacgaaataaatttagtgccatatctgatcacgaaacgatcacaaataacaacaaagacacaactcaaaagatcggacacgtattcgtatgattaaaagccattttattatattattgtgtcattaaagcagacctgctattgaacatgataaaacatttatccttcctgatctagctcagttaagagtaaagtagggcctcaaatcattgctttggtcagtgatttgaggcccttggaactaaagtgtcgcatgactaaagcacccaatacatcatttcgctgttgagcttgtacatctcagacctgtgcttcagcatgcggagccctccaccattggcaccaccagcatcgtcgtcatcatcgcagcgctccacctcgacggcggttaacacggcgaacagctcctcgccgtcacggtgatcctcatcggtatggaagaacctggcgatgcagaacttgccgtgtccaaggttcacgaggtatgagctttcaagattgagggcgtcgggcggtgtgaactccagaggaaggcggtgaagcaccggcagcttcgagccgccatcgaggtccagagcggagaggacaaagttcctgctcatgtctctattgctgcgtgagaagccaaaccaaaggccgtgctcatggcaatactcggcgagaccggtaaatggcaacgtccagccggtggccactgtgctccacgcatggctcaccgtgtcaaagcagtagatgccaccgccgtgcgtggacatccagatctccgtgtcaccgacgacggcgtaggagtggacatggagatcggacagcggcggtggcggcggggggagagcgcggcatcgccaatcctcattcaatccatcctcgtagatgagcccatagaagcagccgtcgccgtcgtcgtcgtcatcttcgtggcgcggcatgtcgaggatgtagaggtcgtccccgacggtgacggaggtggtaggcaacctcacctggtagggaagggcgggcatggtgcggacggcgtgctcgccggggtcgtagaggacggtgcggcaggtctggtcgacggcgaccaccgcgttgctgtgattgcctccaaggaggaggaactccatcttctggttcgcaaacaacttggagaagggagggtagaaggtcatggctgggcatggcaggctagcatactccaccgcgtcggcggcgccgacgccacggatggcaccggggttggacgtggcaggaagaagcgctccatgtcaatgttgcgcagcgtatagttgctgcggcggcggccaaactcccccagcaccagataaacaaaccgacgggtgctcatcataaatcgatcgatcgatcggattgaattgctgtggatcttcttctcccccaccacaaacaactaggctgctactctgaagaatcagaagagagatctagatcgatgggtgcctcccacccctttgggttagggttagagacagatcaccggagagaaagtattagtagttttgaacagaaaacctggtatttatttatcttcgttttggactaaaacttcctatcccaagcgaagccaaatgatctttctcgttgcaaatctcaccttagcagagagagggagtggggggagccgcccaaccgctactccgcgagcgaatcggagagtcgccggcggcggacagacgacgggacggggatggcggaggaagagagagagagaggtggggagggagttggctccggcagcggtcgttctggtggcggcgcccggggagcacgccgggtgggaagggaggaagaggacggcttatagttggccatatgggccgcctggcacggcatgggccagacccggtcatgcccgggacaagttttgtcgggctggcatggcccaaactacatgacaggccgggccgtgccagcccacgtgctccacctccgtgccgtaccgggctggcctgaaggcatgggcaccttatcgtgattttttttttgaaaaatcatatgctttaggtccttcaacttacaaaaccatccgctttaggtccttcggtggttttgaccccggttttatccgacgtggcggctgagtcagcgtgggacccatgtaagcactacatgtcagtgtgagccgtgccatgtcatcaccatccttctcacccttctctcccttcctcatctctctctcccttctgtgcggcaatgcgatgttgccgacgtagacaacgcagcggcagcgggcacggggtagtggcacaaccatgctcagagtggcgcgagacggggagagatggagttttgcctcgtgggcttcatgggcggcaggggagctcgcgcgccgctcctccgcttgccgcccctccaccgcctcgtcgcccggtgccgacgccctcctctcccgcctcgcactgtcgccctcgcagcgattctccaccccggctcgcagcgcccgcctcgccgccagcaagctcgccgtaacgcgtgtctcctcctcctgatccgcccccatcctgtgcctaccgccgcggccgccattcgcgatcggccgccaccgtggacgccattcgcaaccggccaccgccgccatcaccgcctcgtgggccccgtggtggtgggcggcggccagtaggggagcccgcgcgccgctcctccctcgctcccgcgcattactccgccgccgcccctcccccgccgctcttccacccaccaccatcgcgtcgcccgttgccgccatcaccgccgccgcgcagcccgtcgccggccgccgacgccctcctcctctcccccctcgcactgccgcagagaagggagatagatagatatatgaggaagggagagaagagggaggagggtgatgacgtgggtcatgctgacatgtggggcccacgtgggtcccacgcctactcagccgccacttaggataaaaccggggtcaaaactgccgaaggacctaaagtgaacggtttttgtaaattgcgggatgtcatatatttggttttgtagttgggggacgattttgtaacttgatgacaagttgagggaccttcggtgtactttttccgacataatatatatagctaaaataagtctattttacgtccctactctttggaccatgccatataatacatctatttatcctccctataaaaatcaatatagcaaacttggccttgaaaagaatgttaagcaatcaatctgcatgttaacactgaactatcttagactcatcaaggtagttcacttttcaagaactctcttatcatctgttatttacttttttaatctaacaattggtttagtgtaggtaatcaccgtaacatgta

SEQ ID NO: 58690 - DNA, 1165 bp, Oryza sativa
ttcctgcagccctgttatttgtctctactccctctttcctcctaatattatttgttatctatgcatattgtaaaggttacaatagttaagcttatatatgtgggtcctatttatatgggctattttttctatatacattatatatattgttgttgctctaagaataaaatgccgtcattaaaaataaggaaaaatgcatagcaaaaattcctcctatttattgacggagtagtacttgtttcagtagcagttaagacggtaaaatatcccacttcactgttgagagctactccaaattttagaatttttagactcacctgcagttgagaaagcgaaggacctgtttctagacggaaaagaaaaaagaaaaaaaaagagcatttacgagtagtttatgcggcgtgtgggcgtgcgacgtgtggacggaacgagtaggctctcctcttttctttcagaagaggcgatcttttgttgtgctttggactgtgtcgtctcggcagtgagtactacctccgtctataaaaagttttcatactattaggagaagtagagacaaagaaaaaagaaaaaaaaagagcatttacgagtagtttatgcggcgtgtgggcgtgcgacgtgtggacggaacgagtaggctctcctcttttctttcaaaagaggcgatcttttgttgtgctttggactgtgtcgtctcggcggtgagtactacctccgtctataaaaagttttcatactattaggagaagtagagacaaagaaaaaagaaaaaaaaaagagcatttacgagtagtttatgcggcgtgtgggcgtgcgacgtgtggacggaacgagtaggctctcctcttttctttcagaagaggcgatcttttgttgtgctttggactgtgtcgtctcggcggtgagtactacctccgtctataaaaagttattaggagaagtagagacaaataatatattttattcgtcttatataaaattattttattagtatttttattattgttagatgataaaatatgaataatactttatttatgcatgtcttatcttttaaaatttttttatggtttttttaaaaagatgaatagttaaacgctagacataaaagtctaataattaagtttattttgagatagatggagtagttgtttgtacctgtcgctgg

SEQ ID NO: 58691 - DNA, 2513 bp, Oryza sativa
gacaaccacgccatggccatcggcttggccgaggatgacgacgacaccagcaaggccaccgtcgtcgtggcgcggtccagtgtctcggcgcggcagaggaggatgagcgggcggcggcgggggaggaccaagaacggcgcggcgcacttcgccgtcagccccgagctgatccagagcaggaacaggatctacctcaggggcaccgtcagcaaggagctcctcacgcacaagcaggtcgtccacctctcccacaagatcaaggatggcatctggctgcagcagcaaagatcaaagtatgcctccattgccacacactgcaaatatgaaatgatcaatccttcatttgaattatcatttcctctcaaaaacattgaaactgttcaagtatattgtttacatttcatcgtcagcttaagcttcggagtgaagatcgattgatcggtgtatgaaattcaccaaaatacttcaaatgatttaagtgatttgattcgtatgattttcagtaatggccattcaaattgctattctgcattgcactcagtgaccttgcatttgtatgccatttcttcataattttttttagctttcttgatcctgatggtttgttcctccattgttgaaccaggctgaaagagaagctgggaaatgagccctcatacaaacagctggcgcattcgctgaagatatcaccgcccgagctacgatcaaggatgcacgagtcgtttcttgcaagggagatgctaacaatgagcaacctccgtttggtcatttccattgcccagaagtatgataaccttggtgttgagttggctgacctcattcaggtaatggaatcagttaattcagctgcctttgcaattctaacagagtctgttcagtccaatcatctgttggacacactaggaggattttgtgtgcttgagacatgtagtaacgtgttgcgatccaatcacattttgcagggtggtctgatagggttactccgtgggatcgaaaaatttgatgcatccaggggctttagaatttccacttatgtatactggtggatacgccaggtaagagttctctgctatcctgtgctcaggcaaatggatggaagttcagaattacagtcagagattaactcaatcgatacctgatacattgtccttatttcattgtttcgatcgataccagggtgtttcaagagcattagctgaaaactcaaaaacattcaggcttccaacttatctgcacgagcggctgattgcgattcgtggtgcaaagtatgagttggaagatcaaggaattgctccaacaatagaagtaaggcatactgcactaacaaaataaaaatttggctagttctgtttccatgaactacaaaatatttacaattgcagttttctttgtgtattttaatcattgtttctttttatttttaaaattaaaatttaaaacgcagatctgacagtttgccaacctttatgatggttttcagttctgtgaactgcaaagtacttctagttgctgctattgtatttttaaccatgctacttttgtttttctttgaaaaagattatataatttgaatgtcgcgtctctgatggtttgctataaccttttggtggttattctcagaacatagcagggtcactcaacatatcagaaaagaaagtactcaatgctacagaggtaatatatcttcatcttgctcggtggaacttcttttgttaaattcctttgatatttctggcattgtcacagacatttttactggttgaaaaatacaggctgtgaacaaggttctttcgttggatcaacaagcatttccatccttaaacggcttacctggagagacactgcacagtgtaagcagctatatagctactttgaaacaccattatacattttcaattttgaaatgtgccacgagattaaacctttttcgccctttccttgttctcagtacatagaggatcaaaatgtcgcaaatgatccatggcatggatttgaggagtggtatctcaaggtaaccacagagatatttgttccagaagataattgcactaattgctactagtccataatcctgttctttctttgatttttggaaataatccatccacaagacaaaagatcattatgactccaagcattttgtttttaaaagttgactccacaaacatattatagctctgagttggtactggtatatggatgaccagacctcattaccttatgtccttagagaatcattgaatgtgctttaactataaacattctactaataccaggaagaagtcaacaagcttttaaactcaactctcaacgagcgtgagagggacattatccggttatatcatggcataggaaaacaatgccatacatgggaggatattagcagacagtaagtattatttcttcagctcttatggaccaaggtcctgtacatgttcaactgcctagtcaagtttgctcgccataaaaaaaaatctaaaacttttccattattatcaaactattcataatag

SEQ ID NO: 58692 - DNA, 1344 bp, Oryza sativa
aatgttactccaacaatgatgattgcccctgcatattcatcaaaagatcctccacaggataatgcacaggattttgaatatcattggcaacacacaagatattgatgaagcccgccgccaccttaaggcagaatttgagatgaaggatttgggtaaaaccagattttgcttaggtttgcaaatcgagcaccttcactcaggcattttagtgcaccaatctgcctatgtccagaaattattggagaaattcaatatggacaaagcacatccaaacaaaacccccatggttgttcgatcactcgataaagaaaaatacattttccgaccacgggaggaaggagaggggatattaggaccagaatatccctatctcagtctcattggagcacttatgtatcctgcaaatagtactagaccagacattgcggttgcagtcaatctattagcaagacatagtgctgctccaactaagcgtcattggaccggcggaaaacaaatcctcaggtacctaaatggcactaaatatcttggcttattctttcagaaaactgctgatcctagcttggttgagtacactgatgctagctatatgtctgatccccacaacgccagatcacaaacaggctttgtattcctccatggaggaacggccatatcgtggaagtcatctaaacaaacattagtggctacctccacaaatcattcagaaatcatcgcactgtttgaagcatcacgtgaatgcgtgtggctccgcaggatgataaaccacattgagcaatcttgtggcatcggttcatcagaatcacctactattatctatgaagacaatgctgcttgtattacacagatgcaaacaggctacatcaagagcaatatcaccaaacaaattgctcctaagttgttttatccccatgagcttcagcaaagtggagaaataaacatcttatagacaaagtcttgcgataatctggcggatctcttcactaaatccctacctacttcctcgttcgagagatgtgttaagggaattggtatgagactactccgagacttgcaagcttcagggggagactctctgaatgatgtaccttgttgaaacacatcacattgtactctttttccttttgtgagtttttaccatctggtttttctcatacaaagtttttaatgagacaatgttagatacaagcttatgccttatctcatgttttccccacaggagtttttctagagataaaacaaggcatggattactccttaaaccttacaggtttctgatagagtaatcaccaatcatattattcctatttttttcccacggggctttttgaaggaattaaacaa

SEQ ID NO: 58693 - DNA, 3908 bp, Oryza sativa
  unsure (1)..(3908): unsure at all n locations
ttcaggatttttcagccattctacagctgacagtaaacataaagttgtacagcatcggctaaactgaaaattccactgtgtctctacaaaattcatgcaaaaagcgagttctgaacttgttctagttcctgctgcaaacaacaggaatatggctgtccagttctgtcaaataggtgaactcacagagttaggagttagcatgtaggatgtagcatttgcaaaccggcaccgtcaaaattcctaaatactaaccttcaaaaaaaattcccaaatactactcttagaaggacagggacaacccctgaatgttttagggcttcagaaaatagcattggagtagttttatgttttcaagaactctcctctgtactttactttttgatctaacaattggtttatggtccacccagctaagtatagacagaactactaactaactagatagtagatagcatgtagcatcagcaaactggaacccatcaaaattctcaaatagataggcaggggcaagcctgaatgcctcaggagattcagacattcagttactgtgttcattcatcagaattcagacacatcatgcatatttctaccaagtttagcatgaacactaatatacttcaggaataagcacatttttggcgtcaatccatactaggcatgaatactaattgtcaccaaaaccaatactttccttagaaggtcctgtttaacctgtttccaaagtatgtgaaaccgtcgaaaaacacccattgaacacactgaaaatttcagagttttcagccattctacagctgatagcaaacataaaactgcattgcagcatcggctgaactgaaaattccaccctataccaacacactaatcttctgtcgagttccctgagcctgtcagaacttcagcacaaaaggattcactcaatcgtgggatcgtcttcatctgtggcctctgctgacggcaatgcattcggattcgggaatatcaactgatcatatgctgcagccataccaaacaaatcacgcagttagaaagagtaatacacaagaattacagctattgcaagtaaaaacagtgctagtaattcacatgttaaaatgctactcggatgctgaatttcacactaaaaaatctacaacattcagatgaatcctacaggcacaaattactgaaaactggaaaatatgcatgttgctggatatgatcattgtgaaacaagttgaatagacaatgcaggcttgaactttcatgactgaaaactacagatatgatcattgtgaaacaagttgatcatagaaaatccagcaatatgcattttcatcaaattccacaacaggcacaaattactgaaaactggaaaatctacagtgctgaactgacataacagaatcagaaaaacagagacactgcccactccatgccatccgttactagctttcacagcaaaattcagaaccacataaacattgttcagaaaattcagcaacattcatattgaacataggctgcttacattcggtgttgggcctgacaaggacgatctgcagggtctcccggtggcgaggaaggtcgatgagcagaggggtgaactgcccatggcggccggcgctgacgcacatcgtgaagtcgtcgtagcccacatgcttcgcgatcttctctctcaggagcctcaccgacctccctctgatctcaaccgtagcccagttttctccctcgctgatgttgtcgaggtcggcttcgtccacgaactggatctcccgcagcggcggggggaagcacgccctgacgaagaacccgggctgcacaaaatcaacaatggtagcagtaggaaattcgatcaatccacatattgtactacacggttagttcttgcaagaaatcaagattaatctccgacgaaatcagcatcaagacacaaaacaaaaaaaaaaaaaaggaatcgcaagaagagaggggaaaaggatcggaggagctcacctgagtggcgatcgggagctccggcatgtctccactcggggggacgcgcaccacctcccacagcaacgtatcttcgtcctcgaagttggcgtcgactgagatgctgcggcggcaagccaggatgctcttgttgcagcgcaggtagcgcccggacctgtcgcgcagaaggacgacgccgcgggcatcgcgatcctcttgtacgtcttcgctgccgcacctggttgccagccacatgatggcgtcgaccgccggctcctcctcatcacggtcgcgctgcgtggcctccaccaagccgaaggggagtcggcagcagcagcagcagccgcagcaaccctcgcgggcgtgtggttggcggacgtcagagttggcggcggcgtcgcgggcggcggcgttgcgggcggcctcgaagggggccgcgtcggtggcgccgaggtaccggccgtaggcgctgcggaggagcaggtaccgcacgggggcctcctcctcgacctcctcgtcctccccctcgacgaggaactcctccacggcccacaccgcgttgtgctgcgaggcgccgccgcggaggctgccgtggtagacggacctcccgtcctcgtcggcgtggaggtacgagccgtacatatggctccgcagccgcgcgaacgccacatcgtcgaaaacctccatccccacccgatgcccgcgcgacgtcccacgtctcgacgccatggcgagcgccgcgaggcgtggcgcgcgcggcggcgagtggctactcctcggtggcgtggcgtggggaggaagacgagagaggcaagtagccgtggaagagtttgttagccgagggaggcggtggcatttgaaggcgtcgcgagaagacgcaggttgctctctgacaggtgggtcncaggtcaaccgtagtcaatataaaaagaacacaggaggagagcgctgcctctcttcttcttctccattcgctcgcggctcgcctcgagctcccacagcctagcgctcgattccattccgctccgctccaccacgctactcaccccctgtccatggctgcccgacgcgccgcgttcacttggtgggatgcactggaggtcaacatcaagaatcaggggacgcagattcttcgggttctagatcatcttgacgtggactcctcgccggagtttcggcggattcgagaggagaggttggaggtggtttcccgcgttctggaggagcagaccggagctcgtctcattgtttgggagcgctcggcgggcttgacggcggtgtccgccaaccactggagcgagccacgcctcggcccggtcctcagttgcgacgagtactacgacatggatgcatctgatcgatggatgtatctgcctcccgcgccaccgaccgcgacgccggcgacgacatcgcccccatccacggcacaggctctcctacccacggcggcgacacccaccctccagcccgcgccaccgaacacgatgacgcctgcgcctccgacgacttccacatcagcggtcaggactccaccaccgtcgacggcggcgactcccattcccagtacgccgcccgcgcccccgacgacgtctcgtccttcatcaccgacacgcccaccgacggaggcgtctcccccgccgatatggagtctctacgcgtttgccgtcttcgtgggagtcatcaccgcagcagaagccatattccggccgcgcacctagctggccgcagccggcgacgtacggcgggacactaatcacacaaacaatacaataggtatttcacaacttgtaattacatttgtttttacaacttgtttgcgtcatcgttgtgctatcattttaattacagagaagattagtttgtagtaaaaattacaaattacaaactatcattgataattagtttgtgctatcattgtccttaatgagtttacattcgcggatctggggctgcaggaa

SEQ ID NO: 58694 - DNA, 11603 bp, Oryza sativa
  unsure (1)..(11603): unsure at all n locations
ggtgggtctgtcacctaaaatggattgtctgaaaccatttcgagttcttattatctgcatatagaatgggtgctaatttctattttttctgattattatcataccagtgttcagtgtgaaattcggcatcctagtatatcttaatttgcagagtttccttgcaacagcatatgttctgaaacctgtgcaggtctttattatctgcatatatgaaggatggtagtttcaatttgttatgaaaatgatcgcccagtgcttagcgcgaaagtcgggaactccgagtagtatcttaatttgcagaattgcttgcattgtttttttacttgcaagagtagtactgtttgggcactgtctaactgcatatttctctgctatggctgcagcggatcatcggttgacattcccagatccggatgcatcgtgacgtaggagatataggcatcggaggagggattgattcagtgaatcctttcatgctgaatttctgacaggctcagggaaatcgagggaagatcagtgtgttggttttagaggcatagagtaaaactttcagtccatgccggaaatgcagttttatgttgctctcagctgtagaatgacagaaaaacaactgaaattctcagggtgtacaatgggtgttttttacatggtttacgtacttcgaaaacccggtaaaagtgaaacagggttttttgacgaaaatattggttttggtgacaattagtcttcatgcctagtatggattgatgacaagaatgtgtgcttaactctcctgcaatatgtattacagttcttgctaaactaggtagaaatatgaccatcgttctgaattctgatgagtaatggcatgcccctgtccagtgtgcttaacgaaaatatctaggaactttgaaaagaactggacggattctaatttcactttgtaaattcacttctgacaggaatattgataaagtgacacttagtattgtcagatgttctgaattctgtcacgacagtaactgaatatcttgaagtttagtaatgtcggatgtggaatctagttaggtagtagctgcttttacttgttacggtgattatctaccctaaaccaattgttagatcaaaaggtgaagaacacatgactcagcgagtctaggatagttcactattgacatgcagaccgatagcttgacaatattgcattttatcttgagcgatttgtatgatggtggtcttttttttttttttgaaacattgcagcatgcagacacagtgtgacttcagagttcagactcttttgaaactggagagattcatcttgattgcagtagcgatctgaacaggttcagaaacaattcttctgatttgttctttcacaaaatttacaatgctctacgatggactggcgcccccacattcctttcactgatttggaagattcagaacatgaatgttccttcaatctatagttaatttcaataggcacatgtcactgccaccattttcatttcctttctattgattcaagtaactaaactgctttcatttcccacttattcagtggaaaaattgaagaataagatatttgctaatggacataaaacttgccacatactccaattatacttatttcaatttcagctgaaattaatgagctcacatactcctattataagtaaaaacttgccacattattatgcagtgttctgaggtcatacaatctgcagttctgcagttactgaaatgctcactcatataccaaattagacatttgcaaccaggttctcatatatccctgttcagcagatcagaactgctgaatcatgtttcaccttttttttatgacaaaaatcaagattacagaatcaatttgcaaaaactcacaatgccaaacaataacaattcacttccaattaggagtctgcatcatcccaggcagcagggcaggactggggcatttccacaacacagaaccacacaatacagaaccacagagcaggggcaggggcatttcacaatacagaaccatacagcctcgggggcatttccacaaacacctcgcgggcgcaggaaacggtgcagcgttctccactggacgaagccgtgcgacggcgtcccccctcgccggcgacgacgtgggcggtcgaccggtgcgggcttggacgctgaactccatcaacgagtcgaggctgccgaaattggaggtgcggcgcgggcggagtgtgttcccaacggccggcaggagcaccgcggcctcctccacgcgccgggctcgggctggggccccgcccgcctgcatcagcgcgccatcagtcctgccggccagccgcctccacgcgcccccggtcgcggcggcagggcagggcggcctagcgcctctccggtcgcggcggcggcactggtgcctccccactcacgtctcaggccgtgtggcctcctgttaggctgaaacggcaattgttttgcccaagtaaagcagccgttcggattcgttttggacggccgagatgcacgcaaagtcaccgaatccgaatccgaatcctcactattgacatgcagaccgatagcttgacattattaaagagagtatattgcgttttatcttgagcgatttgtatgatggtggtcaattttatttttttttttgaaacattgcagcatgcagacacagtgtgacttcagagttcagactcttttgaaactggagagattcatcttgattgcagcagcgatctgaacaggttcagaaactcgtttgcatgaattttgcaggtcgcccccaagtttacgtggccacggtgcccacgggcccacccgtcattgaagaggttgaccattgaccagaggcccacctgtcagaccgcgacgcgcgtctccgtccttctcctcgcgacgccttcaaatccaccgccaccaaattcctccacggctactccctagtttcctctctcgtcttcctccccacgccacgccacgcctcgccaccgcgcgcacgctgccaccccctgtgcggcggccatcgccgtcgcgcgcgatcgctcgatctcttcctccccgcgcgacgcgacgcgacgtctcgccaccgcgcgttcgtcgctccgaccagatcatggagtcctcgtactactccatccgcgcgcggcggccgtcgatggctgcaattcgtacctccacgccgacgagaacgggcggtccgtctaccacggcaacctgcgcggcgggggcggcgcctcgctgcacaacgcggtgtgggccgtagaggaggtggtcgccggggggcaccccacgcggtacgtgctcctccgcggcgcctacggccgctacctcgggtcccccgactcccccaaggccccgaccgcgagcgcgaccgctgctgctcgctcgaggcagcacagcgcgaccgcgacgtgctggatcaggtcggtgtcatcatgtggcgcgcggcccggacattgccggcggctgcgtcgtccttctgcacgacaagtccgggcgctacctgtgcggcaaccagaccttcctggctcgccgccctggcgtctccgtcgacggcgacgtcgacaacgaaacgacgctgaggtgggaggtggtgcgtgtcaccccgagtcaaggcaggcctgagctcccgatcgccactgaggtgagatcctcctacccctcatctctcctgatcccctcctcggctaaggttgtgattggaactagcgctatccgagcccaaaagccaagcatcacaatcagagggtctcttcctgcaattcttgtgtttgtgttgtgtcctttatgcaattatacaacaagaggattcttctggttctagttgaagaagtcttgatgatgattgattgggtcggagattaatctttaaccatgtaacaatctatgaattttttttttgtcaaattcacagagattgaagaaaaattagacaatgacaatgagagcaacggaagagagcaacttgcagacagctgccagttattagtatctaattaattgttacaaattagacagctataagctgtggtgctctgatttacttattctgccattccaatctaaattgtacttgtccaattgaaaattttgacacaagagatgctaaaatgggatatgagccatagtcaatagaatattattagacatagaggtgctccgagtttcagttattgctgtaatatattgtgcagaaatctaaagtgcaactgttttgcttcctatatttattcagttaatatgttctctgtgtaatatgaagtaaaatattggattcactaaggcgtacctattacttgaataaattggggtgatacttcgtttctgtacttttcttcaatttgtctacttttagaaaaccattacttctagaatataactatacttgagtaatccaatttgacagttatagtagatatagtggagattcacttccttattaacatttgtagaacatgaacgacactctcatagcatgccaatttggcaattgtcaaagtacaaaatctttaaccaagcaaaaaaaggtagcaaactgttaagtagcaaacgctctgtcatgtcccatcagctattttgaatagccgcaccactctcaagctgtgcatcagcagaagcatccaggtcctgagggaagaagaacctgcaaggcagagaaatgaaagattgagctcaataacatgatctgatggaaattggagacgtgcagagctgtagcatcaagggcaaaattactcgtgaaatttagagaaattgactgcattagatgagtacttggaccagacagcaaaaagtttcggcatgacgcacggacagcttacctgcacgtgttgtggtacagagttttacttaagccttcaatgtcagaaattcctttgcatccagctacaacctcaagaacttgcctgggattgatgtatcttcagttatcaattttcttggcggaaaaagttaggtgcaagtgtaaagtataaacaaaagaaaaggttgatgaaatcaatttccgttccatcgaaagattcatgattgattatgataagaatttaaattgatttagcttaaaatctgggcaaatgattctgcatcgatggaaaatgctaaccaaataaatatctgcaaaacatcatattgaactgccaatggtcagtattttattagtcaagtaagacatttcaacaagcatgtggtaataacaaaatagtttaatgttctcagaatgatgagcattacttctactgtgtttcctcaggaaaagaaccaagtaaaaggagcatgaaaagcaaataataacttcaggtgttcatgcattgcaggccagtcaaatgcttactgaacaataaccttattagagtttacctgacataactgaattataatggaatgaaaacgttttaattgctactaatatttttattcacatctaattgcccaaatggagatcttcaccaaaaaagaacgaacttgcagcagaaattgaaatgaactttgactacaaatagaagtgttgtggtactcttaagttctataattatcaaggtgcaccacgtgcaaatatgtaacatcaaggggagggagggagatgacctataaacatcttcaaaggaaagaagcttatcacggtcctctgcagttccagtgaaggagtgtgtaacaccaccagggaatctgagatagagaaatatggttctcaggcttgaaaatatgcaaacaattcatgttttatttttctttaaaacatcattgtgtattgttatgatatacggaagttattttcttgcacaatctggatatcgtcataattagggtagtttgaacctctttgcttttatctcaagcttgtttcaacaataggtttgggttaatgatgcctaattattctatgttatccaattgtttataacaaaaacaaaactcacatgttatacaataatttgagttgtattaaataaaggagataagtttccattatcttggaggacttgggaggagaaaacatagtattatgtgaagaatggataacaatgtcacgtgtgattatgatctaaagggagatgaccggatgagtaatcaatgattaaattagatggatgagtagcttcttgatccaacagctgataactatgtactaatgtgatccgatggcttagaattattgatgatgtggcttcttgcatgtcttgctttataggagtaaatgctccttagtgggtaccaactatataggaagataggataagaactacagacaaaatttagtgagcccaattattttcaagcaaaatatatggcaagattgcaataacatttcattataggacacaacttgggaagtctacaagcagatcaaacaaaattcagtgagcccaattattttcaagcaaaatatatggcaagattgcaataacatttcactataggacacaacttgggaagtctacaagcagatcaagcactaccacggcagcatttcagcactttcttcttactattcttctggagaatctagaaacaccgcaatgggtgatcttcaatagcttacctccctcaagaacaagactgctacgacaatgcatttaacatatcaacctttgggcagtgagactaaagcccaatggttgacatgtaatttctatatggaaacaggtactttctgccgccctatatgtcctctaactatttgcatggtcattcaaaaatgacatgccaaatatattatatattcaggactcaggaggggatccccgggtgaaattaaaagaaacatttcactacacaatagacctacaggacaagtgatacacacaccttgcctttcgcgattccttccttcgccagagccagcagcgcctggaaatgcccttccggatctccactctcctcaaactcctagcattcaacaaagcactaattacataaaccaatcgcgaaaggcatgtgccaatctcagatgccagcaatgaaacaggaatgatacacaatccacccctaccccacatctcgtcgggtgcacgcccaccgtgcagaacagcctccctgcatcgtccaagcacatcacagcttctcgggcacattacaacaaacaccttgaaggcaccaagcataacatagtcaaaacaacccgcatccaagcagctgagctcaccgtcagtctcggcgatctcgagcacttctctagattccttcagcgagcctccggtgaccttccgcccggaccaaaccaaagaaagcaagagattaagcacaccaaagctgagccaaaagaaagtagaaacaaagcaagaaagaagcgaaagggggaatggccggcagcaaagcagcgtacgatgatgcggtcgacgccggccgcccacgcgcgggcgatcacggcggggatgtcggcggcgtggcactgctcgccgtggtagatgcccctgaacatgccatcttcagttcgttcgcagcagcaagagcaagacgccaagacgcgagtagaaagcgtgagagccaggcagtgaaacgcgaaaaacgagataagagtcgggaggaggaggaggaggtgggtaccggtgaagttgacggcgatgtctgctcgtcgcggtggcgccggagatggagaagaagatgagaggaggagtagaagaaggccgggtcagtccaggtagcagcatgagagccgcgagcgagagagagagagagagagagagagtagagcactcgccgatgagcttgacgccggtggacgccatcgccgccgccgccgagatgggggagagtccgaattgggccgaggccggtcttcgtgtttgggcctccaaggctccaacaaaacttgagtttcgtctcgttcttttaattttctttaaatttaaatatataaataaatttattttttgagtttacaataattgaaacctaattaattatacactagtagttttttcctttttttttcgcttccaaatattgttcggattcggaattgagcccttctttatatnnnnnnnnnnnnnnnnnnnntgattcgttcaagaacaatactcttcaaaatccaatcctttttttgatcggatcgactgctgagatggccgccgcgtccggcatccgcatcctgtccaagaaattcacgccgctgctgtgcagatcatcggtaagtagtatatactgtagtagttcatgaaatttcttaggctttatgatggcagtacgacaaacagattaaaccctagtaatatttgatcatcggaataattaactattgaccactagtacaggtgtggtaattaaagatttaccactgaacccacataccttagacacataatgatgcacatgttatagactttaagtcttcgagtggcaaatccttaattgttacatcttaaaagtggtaaaaagttaaatgtcccgaattttacaagtggcaattcaacatcatgttgattaccaatgcatgtcccgacatgtcatatgtgactggccagttttccttgcttatttaacttgtggttttcatctttattatgcaggtagcaagaactggcatggccttggctaaaaccaaccacacgagtacaccatttgtgaattctcttaatggggctaagatacctttttcatccagttccatcatcaaggacagccattcgtttcgtcaatcttggcatccaaggactccagagccaaagtaagtaaatcatatactagagcccatgcgctctacttgtttttttctatgttgattgtgtgttcattatgttgctcaagtacaaattttgcagtctcataacatttctctctctttctctttttgtgctttgcagtactgatgaagaatttacgatacaatggaggatgcgtttccttgctaattttctgttcttagtatatgccagtggatttatcgcacataagcgtaggaattaactcataagatgaaattaggagctagcttgcaagcattgggagcccctgcctggccacctgtcctccccatagacagaacagaagagcttgtaatttaagttttggttgtttgatcaacttgtaagtgtttttagctaagtgttactataacggttgtggatgtggtctccatgattgatgtcatcatgtatatatgcaatatatgcatgaacttgatacttattacggatggagaggtcagatggaaagggtctccggcgaagatgacgtggcggcgccgtcgcagccttggccgaactggccacctcctgtctagatcacgccaacattaaactagcgcatctcgtgcctttagctacggaattcccgtgtttagttccacgtcgaaattagaagtttaaaaaaattagaacgatataattaaaaagttgaaagtttctatgcgtagaaaagttagatgtgatgaaaaaattgaaaatttgaagaaaaaaattagaacctaaacagggcctagatgtactaattgcaagctgagcaaacttctacggcagacatgtacagtgccaagcacacctaggctggtttagttcgctaaattttttttcaaaaacatcacatcaaatctttaaacacatatatggagaattaaatatacacaattaggggggaaatcgcgagacgaatcttttgagcctaattagtccatgattagccataagtgctacaataacccacatgtgctaatgacggattaattagactcaaaagatttgtctcgcggtttccaagcgagttatgaaattaattagttttttcattcgtgtacgaagactccttctgacatccggtcaaacatccgatgtgacactcaaaaattttcttttcgcgaactaaacaggcctatagaccccaccccacagttgatactagtacaaggtcaaaatgtagagccaagaagttcgaaagctcaaaattcatactgttgcatatttgaattgattcagtaatctgaaaataaaatccaaacaggctttagagctgcttctcatattttatttccgtaaagcacacattctgaaatttctgctagaatctaagtaaatcccaatttaaaacggccccatactaacactgatatttcagagaagctaagttgagtagactttaccattctcatttctcaatcaagcagggaacaagtagttcagagaaccccatagataaaacaaaacatattcagaattaatccaacgtgctccattattaaaaaaaattaatccaacgtgctcatcatgttcatcagttcatgacatacggctcaataattacgtgattcagatttatcacccaaatgttagcagtacaactgaacatctcctgaattaaactcgtctactactaattgcagctaagcaaactttctagttagctcataccaaccactactacataaatattttttttaaacggagaccctctttagattgcaacggagaccttctttagattgcagacagaccgtaaccggtcgcgtatgcaaaaatcatcctctattttcgtgtacagctccttaagaggaccgcacgcaaaaatcgattcacatatgggcctcttaagggtccacacgcaaaataagcctatttttgtaggcagaccttttagaggactacacacgaaaatatattttcatagatgtgcctcttaaggatccgcctaaagtctgagttacctgctcatttccctctcaacacttaaaaaattttcatccttatccactcatctttgggcctcttaaggatccgcctaaagtctgagttacctactcatttccctctcaacactgtcaaatttttcatccttacctactcatctctctctcaccttctctcctcgtatttcctctccactctctcacctctcctctctcacgagacaggcggcgcgatgcgggtggagtggctagtggcgggcggagggtgcggccggtggcagcgggcggctagatgaagaagtagcaaacagcggagatgcgtttgtgctgtttgcttgctcatgatcacctcttttgtaacccgtatatatatatactacctccttccctaaacgtttgacgccgttgacgtttttaaacatgtttgaccgttcgtcttattaaaaacttttgtgaaatatgtaaaactatatatatacataaaagtatatttaacaataaattaactgataggaaaaaaattaataattacttaaattttttaaataagatgaacggtcaaacatatttaaaaaagtcaaaagcgtcaaacattttgggatagagggagtatatatatataaagtttgtgctgctagatgacatgaagtaaaaagaacaacgagccaagctcagagctaatttgtaaaatcttctcatgtgtttggcagttcatatgttgccatgaatccacaatcgttaaactctagcgaagagcaacaccccgaagattgcaattctttttcatccttgtataccactgaatctcatcataccaatatcagaccaagctacacatcgtttactcgacatatatatacatcgtgccaatgagcataaatgtagcaaattataaaaggtaaatgtagaaaattacaaagatagtcagggtttgttatctactctatccgtttcagattataagatgtttcagattataagatgttttaactttagtcaagggctgcaggaa

SEQ ID NO: 58695 - DNA, 2001 bp, Oryza sativa
aagcagtttgactttgaccaaagtcaaaacatcttataacgtgaaacggaaggaatattaattgatatatccaatcaaattgaaacttcatttattatgcatatatcaaggccttatatgcagagtacatttgtatacacacaagcttcaaatttcaagatcctaggctagaatatgatgatgtcatatatcaagtttatgaccaaaagttgcatacatcatcagatatcttacaatcttcttctactccatgtccgtgcattgggcgaatcaatcttgtctagtactaaaaatatagtgttcgatgtcaaaaaaagacatcctcctagtgtagcaagccagagtgtgcgtgaactttgggagcataaaaatagggaggtcttatcccgattaatatagatgcagtagatatatccaatctcccaaagaactcttcgtatcaaatctgcatccggatcccccagtcgaggcatatccttggatggaagtaatgtctacctgaaagcaagtgggttttagggaaaattaacacagcactctataagttaatttcatacaagggaaaaatcagcactggaagatgccacaagtgtaggccaaaacaaatcattcaagccaatcaaaaagtttgcaagttaatttgcaacagtgatcaggatataaaaagaaattaaactttcccaagaaagaaattagaataaagtagtaacgcaaattagccatgccatgccacggtccaaaccccaatcgcaagcgttaaaccttcttcaacacatcattgcatcgtgagaaaccttggcagacaggtgtaatataaatatgtaaaatctaacacatgcctcatgaagcaatcaattacagaatactcttatcatacatctgaatttaaatttgctgtcgtcttcttgcttggtacacaacatacaaagtgtgcaattaaacccgacaaaaccggaccgaatcacatgaagactcacaaaccacagtgactactctgtctcctcagcttacaaggcatagctccttggctccacgaaatcgaactacaacttaattatgtggaaaccctaggtgctgaggaagtgcaagttcttagcctggctagtagtcaaaatagagtttggacatcggatcgactagctgctaggggacttaagagttttccaacacaaggcgctcacggttatcggcttcttcaaaggaagaagcgaggacctaggcacttgcagacaaggtgactactagaggttttactgaaaattatattaattcccttagtcttatttaagtagtccgtacctagggctgtaaatctctcttccttattcaatgaaataggcacatgctcgtgccaattcgttgaaacccaaaaaaaaaaggtactcagcgaacatctgatcagcttttgaatattgtttatccacccatttgaatatttgatgattgaacagggttaatcatacttggttcttgaatctcggctaatgtggctgacatcgcactatctacttgttgcagcaaaatagcatccatatctctttgtctatcacttaggaaattatgcaatactactacttcctccgtttcaaaatgtaagactttctagcattgtccacattcattaacatctatatgaatgtgggcaatgctagaaagtcttacattatgaaacggagggagtatgcgataaaaggacgttccaaggtccaagagctagtaaaataccctatattgatcttatatatgcctaatagcactgggagcagcacacaaattaaacctcatagtcataggtatggcactatactggtattgcacatcagataattcatttaagacaaatcgaaacaggcaaagtctaccaagaacacaaaagtggcttatactactcaaaatcttaatgaaagaaattgcaacataaaattcccaatattaaaattaagcccttgtcatcactagctagcttttttttttctttttcattaaaattaagcccaagat

SEQ ID NO: 58696 - DNA, 2731 bp, Oryza sativa
aaaaaaaaaagatctgctccagatgctgcaacatagatccatgtaccagacggccacgacagtgtggggagaggaaggtagcgagcaacacgaaggaagaaataaactgtgcaggaggaggacatgcaccttgttgggggatgatgtgcacttattggcggcggtggtgcaggtggggaggagatccgatggcgacggatcggagtagcggccgaagacgcggcgatgagatcgagtttccggacggcgcgacttgggaggcgctgctcgcggcggggaaggggacgaggagacctccgggagattaattcctttttgttgagacgagactcgagacgaatcggatattgcttagggcaaattccagacggaattttgttaggattcgttgattccaattccacgtgaagccaaacaggttcaccctcccgtttccaattccaatcgataaccacggtacaacgggacatttaacttttttttttgccactttttaaaagtgacaattaagaatttatcgggatatttaactttttgccacttttaggatgtagcagttacttcctccgtttcaagttatacggagtaagattctgtgtcaggattcattaacatatatatgaatgtgggcaatgctagaaagtcttataacctaaaatagatgtagtaattatttgtcactcattgtttatgacatgtgggctattatgtatctatgacacgtgggtccagtggtaaatcctttatcaccatccgtaagagtgtcaaataattaatttttttgaatttgccactcgatgtctatggcacctgggccctcatgtgtctatgacacgtgagtccagtggtaaatcctttatcaccatccgtaagagtgtcaaataactaatttttctgaattgccactcgctgtctatggcatgtgggccctcatgtgtctatggcatgtgggtccagtgacaaattatttatcaccacctgtaagagcgacaaatagttaattactcccggtataataactagcaaagtgccatgtgttgttacgggaaaagctgtaccaaatcctaactcgctattttttttttgagaaaaggagggaaactcccccgttttcattaaagaaaatgcaaatgattacaagagttccagagaggaaaaaaaatatcaagttcttacagaaaagacgaggaaaacaaacagttataacaggactagaacattggaatttcaagcatcaaaacacaggtttccatcgtcgtcttcaaaactccttgccattagttttagcctgcttctgtttcccatcctattctttgtctgccgcccctccatccaaattttgagtgaaagatctcatttgctacctgccttagtagctgcgccccccactgcattcttcctctgtcttcctccttgctctgcaaaatactccaagagtttaaatttgagcaaatgttgtaaattatttctataggatcaacaggcagaattccatcaaagcaggctctgtttcttgctttccaaatggtccacaagactgctgtagcccccatcatgatcaacttcccattctctttgccaaatttcaaaacccaggagctaaacatttcccccacattcctgccaggcttcacattgagagcgcattcaacaacactcaaaaaaaaaaatcctaactcgctagagaaacgagaaaattgaataatactacgataaaaataaatgagaatcggattgacgaggatggacatatattattgtttaaattcagactcaaaattagtaagaaacatatcctatacacgtaagtttctcgtgcacaccaactaacaaaatgtcaaaaaaaaaatctacaaaaagttggacatttacttgtagtaatattacacatatatacaaagtctcatattcaaattcattatattttagccataaaaaagtgaaaattttaacagttttaagggtaaaattatgtcggaattttaccttgttacggttaagatacaatgaatatgtgtaatactattcgaagtacgtgttcattttttttttctaaaatttcctatgagatttgctagttgggtgcacgggaaacttgcgtgcacaatatatgttcccaaattagtaactacaccacatttagctacttacatcaaactacgcataaaatatcaatagtcaaatcaataccgataattgatcctgaaacgcaagttagagctattgatttttctgaatttatggacctctgtcatatgtatgatggtagtcacggatggaccatcgacagaagaatctcttatattattaaaacaattttaaaagaaacattcgatccgtttacaatctaaatagggcctcgtatagaaaaatctgtaattagtagatgagtttaattcaggagatgttcagttgtactgctaacatttgggtgacaaatctgaatcacgtaattgttgagccgtatgtcatgaacatgatgagcacgttggatctgaaccagccatgggctcatttgggagccaaaggaaaaagggttaattggatccatgccactgcaaatatggcaaatcaaaaaaatgccactactattcacgttatcggctgggtgccactgaaattttgcaaaattcgagctatgccactccgtcacagcaactgccaatacctccgttagctctgttattgcagatccctttcttctccaactcaggtaaaaatctgggggcgc

SEQ ID NO: 58697 - DNA, 2221 bp, Oryza sativa
aggtcgtcgaccgcgtgaaggaagcgctcgtcttcgtcgtcgtcgagttccgaggccgagccgcagcaacagcgccgcctctccatcgagctcagcatgccggagatgagaaaggagggaggggatgaggatggaaacggagacagcgtgagagaggagacggaaaaaggggcgagagtggcatgattctcattttagaaatttctagtggcatgtagccgatatgaagaatagtagtggcatttttttaatttcacaaagttgcagtggcatagatccaattaaccaaggaaaaagaccctgggaaaaattcccccgaggggattttttgggtgacatgccctaccccctccgagaaaattgacattgtgccatcgtcaaaagtgggtttcgcccaaatgccacttcacagaatggattcgataaaatgccactatcaacacacggctacacgctaaaatgctatgttggaccaaattaccctccactcctcttcttcctccttccaacaccatcggctccacccgtaccgtccgcacaccactaccgcctcaatggccgccgtcttcttcatcctcctcctccttctccccttgctcccgtccaccaccctcgccgttgttggaaatttggtcataattcggcatattttaatccaaaataacaagataataatcatgatatttacaataggatttgatccagtgatagtggtgaatgtaatcaacatgagcatgcttaacgttgaataagcatcaacaattacataatgacacaatgttgacattgcgatgaacattaacagtaaaacttctaattgaaataatgtaataaggttataccccaagaatggtcctccgctggagtttgaggcagtattgcctccgttggtgttgatgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacagccgtcttcccctacttcctcgcctgcggcgccgcctccaacgtctccttcccaggcgactccccagcgcgcaccttcgtcctggacgctcccttgctctcatctaccggccatgtcccggacacggtgttcttcccgaacaacctggtggagccacatcgggaacccgtcgaggcgacgtgctgggcctccttggcgcgcaccccgtggttaccctggtgacgctgcaccgtacctggactttctgcagccggtattcccgacgacgaggtcgcggacggcagcgctgaggcggttgttcgaggggcccgcgaggcttgactcggctggcgtggcgcagcagtcggtgtgctacgacggcgagtcggtgacaagcagtggctctcgccgacggccacattgcatattcgttctgttctaggctagctagtatcgatctgttttagtgtgtatcgaactatcgattataaacgaatcgagtgtgtcctgcttgtgctagctagtatctaccgtgcttgtgttcccgtaaaggctgcaccaatcgacaatggtgggtggaggttgaatcgcggctcgagcgtggtggctgcatctcaaagctgccacggtgtccgccgagcttgaggaccgcgcgagc

SEQ ID NO: 58698 - DNA, 936 bp, Oryza sativa
aaggggctgaagaacgaaatggctgaagtcaagaagctgcttaaggtgatgtgtgctagcttgggtgaaggagatcctgaaaagaggccagaaacgggagaagcttcaaaaagggtaagtggagctcctcatgatgtgaatgccactactgctttggctgatataattgatggttctggtccaatgcttactggtactgctcctatcatgagtcaagggggaggatttttcattgagccaaatgttactcagcctagaatgtccaactgcatggcctcgatgccttttgtagctggaagtaatggaacagggcaagtctttccacaacacataccccacaacacatacccacctattccaccacacaacctcagttcagtgtgtttggacagcattttggggcaggtcctagtgttcctaggatggatcagatgagaaatgttcacctgacgcaatgaggtaatgcggtgtatgctgaagcaatcatcaaaggccctaggctagaaatttcattgtttgaaggagatgatgtgattggctggctgaagcaatgcgaaaagttctatgaattaaccggaacacctcatgaacaatgggtaaatttggctttggctcatttgagtggaagagctgcttggtggttcagaggtgtgggaattccgtggcaactaatctcatggccccaacttgcagccatgatgtgtgaccgattttgtgaagctagtgaccatgaggcagtggagcaattacagaatgtaaagcaggctatcttatcagtaacacaatatattgataagttcgaggaatgtgttgatttggtccggagggaacacccatacttgcaagaacaatacctcaacagttgtttcattgggggattaagaggggatatcaaacatgatgtaagtggccaaaaacctcagggattattgcaat

SEQ ID NO: 58699 - DNA, 1159 bp, Oryza sativa
agttacaattttgcaataatggtctggcaatgagttttattctcttgataagagatttggctaaaccattctgagtgtgaacatacggtacggaatgttggacttcaattcctaaagccatacaataatcattgaaagctttggaagaaaattctgcagcgttgtctaatttgattgattttatatggtgttcaggttgatttgctctaagtctgatgacttgtgcaatcaattttgcaaaggcatggttccgtgtcgataagagacacacatgggaccatcttgtggatgcgtctattagaaccatgaaatacctgaatggtccagacaatggttgaatagggccacaaatgtctccttgaatgcgttcaagaaactttagtggctcagcctttattttgagatatgagggtctcaaaattaatttccccgttgcacatgaggtgcacacaaaatctgatgattttgggaattttctgtcgctcataccatgtccatgtgaattgctcatgatttttctcatcatgccgatgccgggatggccaaggcgatcatgccaagttttaaatgcatccacattgtgaaaaatcactttatatgcaacatgtggtacaagtttgatgtatgtgtagtacaatccagacgggagagaaggcaccttttcaattgtttgtttgccatatccagtatctttggtcaagaggagaaactcctcattgttttcttcatatgtttccacatgaattccattattccggatatctctataacttagtagggtacgtgttgaatcgggatacaataatgcctcctcgatatttatttgtgtacccattggaagtatgatagtggcccttccggaaccgacaatcatagcatcgcgtcccgcgatggtcaaaacttgtccttccctcttagtgagagtttggaaaattttgacttccctaagtatagtgttagtggtacaactgtccactaggcacatctcttcttccatcggattgattcccgtaataatctatataatgcgaaacttaaattcataagaataaaagaaaaatatagaaaacacacataaatatatgtgattattacgtgtataaatggggtagcaacatcatgtcttttattacaatggttactcatgcaaaattaaaca

SEQ ID NO: 58700 - DNA, 3512 bp, Oryza sativa
  unsure (1)..(3512): unsure at all n locations
gtctgtgtatgacccatagacttcatgtacagatcaacaagatgtttaggggttctgcatttcttagcaatatgattgtagcaaccatacctgtagcaggcggttttgctgccgctatcattattgggcttagaattgcctttcctctttttgctgttcccacgttgctttttggctctgttgcgtttgcccttgccaaatgaacttccagtctgggtattcccgctgggaacatttttcttctcattcgcatttacttcaggcaatggtgcagtgcccaaccggcgctggttcgagttccatacagtaagctcatggttcttttatgcctgtttcaatgtctgaatgagtgaagaatagactgtgaaattcttctcacggtattgttgagtgatgatccgttctgatgggagcattgtagacagagtcttctcaattttctccgcttcagaaggttcattcttacaaaaccggagtttagagcatatcttatgaacagcatggttgtattcgtctatagttttaaaatcctgtagatgcaagtgattccactcgtgcgatgcctcagggaggataatcgccatatgctgttcataacgatttttttgagatgtccataaaactcgtgggtcctcctctagcatgtattccattttcaaatccgggtggatatgattccttattattcttaaggctgaaaatttgacgatatgacacggcggagatgatgggtctagccatgatgagggcagaaggccgtgaccacgtccggcatgtccagctgcggtcgcacccgtgcggtccacccatgggacgcacaatggtgtggtgcctccaccaggattctgtccagcgttgtgcacatgcccggcgtcgccggagaccctcggcgagtggcgatggtattggagtcggtgctaccggctccggcgttcctttgggcagccgcgccgttgccgcggcgtcttcctccacgtccggcgaagccaggaggaggagatggggggccacggccggcattgccagcacgacggcccctgccacgtcgagtatgacgcacgggagcccgaaggatcgtctcgagctgctgcaagagacgacgaaggtggcatgcacggagattgcggggaagggaggagtcggcagtgaggggaacatgacgagccattcttaccacgcacgtgccggtgagtcttttcactcttctctcttggtagagctctgataacgtattagagaacaaagatgaacagtgaaaaacagtgaatcctccaagtcttattaatctcaaaatgtccccttttatagtggggatttacatatgcacaagcctaggatactcctaggaatcaagggtgatttaagccactaaatatggctgattatgtgtcacaaattcaccataatatggctgttacaagtcacttgaatcctgccattgttgctctttgatgagtctttgatgagatcaaaaatgtctcatgatgcttttgtaacacttaactcctgcaatttgcatcactgctgaaggttgaaatacgcatgattctgaattctaatgagttatgaaagtaactgaatcttctgaattctgtagcattcaggtcttgtgcttgtctgtctatttggggaactttgatggtgccaacttttgcatgcagaattccagattgcttgaaaattttccattgccaagtttcccatattgattaatactccgtactatttttcttgatcagcttgtatggtggtgatgcagcaatagtaaaatagttgtgtcgctgaaagtagcctgaaataaacgaaacggacatgcagtggaattcggcagacttcagactttcagagttcagacttcggacatccaattttccttttctttttggatcgggctttgttaccgtttacgtcggcgtggcttcgtcttatgagtttccctcgataaactgctggtcttaagctcggtgttcacggtaacaatgtcaggttttcaccggtttcctttaaaataccttataccgttataagttcttttaatccggttccttcaataaacgagatcaactctcctcttcttctaaagcgaaattgcacgttcttttttcatattttccgtttgagcactgctacacgcactaaatttctttttacaaaactcttataaacaatgatctcaaccataatataagtagatgaaagatatataaaatctaaatgtactcataacatgatatgtagtgttagtaaaagttcagtaagataaaattttaataagtataggacttttcctttctgggtttttttttttttttggcaaaaacaaccccgaaaccactggaaatagtagcactgagccacactaaccagtcgtctccctcacaagtcacaactccagctaccttcttccttccgctatcccccagccttctctgccgctgcctccgccgcctcgccacgcggcggccggcaagcagggccccgcagccacggcgtgggcggactcctctcctttccccccgaccacctccgccctcgccttttcaggcctcctcgcgcgcccggccggcgacggcgagcatctcggctcgaatcgaactgaaggtatccgttcttctcgtctccctccctcctctgcgcgccacttcgtgtgctggattgggtagattgggactcatttgaactcgaatcgatccatttcgctccaattagacctcccagttcatccccatttgcttcgtttattgcgtgctttggtgaagcacttactaatggcatttttttttttggaaaaaaattgggggttcagttgaatctgcatgctccaggatggagatcgacgggcaggagcctgggcacgagcacgacgggatgatggagccgcaggtggtggacctcgaggaggaggaggaggacgacagcatcaacttctgggcctcgctgggcgtccatgccgtcgaccagatgccgctgcacggcggcgtccagatcgtcgaccagccgtcgccgccgccgcaggagcaggcgcaatcgcagtcgcagtcggtccgcaaggacctgttcccggtcgactccgacccctgccttgagccccgggttgggatggagttcgagtccggcgaggccgccaagaccttctacattgcctacgcggggcgcgtggggttctccgtccgcattgctcggtcgcggcggtccaagtgtaacgagtccatcatcatgctgaggtttgtctgctccaaggaagggttcagcaaggagaagcatgtcgtcgcggggaagaagacgaggaagcggcctgcttccatccgggagggatgcaatgccatgctcgaggtgctacgcagaggcgatagcaagtggattgtcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58701 - DNA, 703 bp, Oryza sativa
ccccatcatcaaatataataaaaaattttaaatatgcatctagatgcataataactaaaactaaacttgctataagacagaggtagtagctcctttggtctccatctccctggcaactatgcaaacggggacattaccaacttgggtgcttgaagaaaagtttttctccttacgatcgaggaatgtttactttattgtcggttacttctccggacctgattactttggtacaaataatctcaggacatattcgaaggggctgcatataggtagctacatgactaaagacgtgtttctaactgcatgattgaatagataatattgatagagaaaaataactcatatggatgaattgaatatcataaactaacaaatatattagaaaaagatatcttagaaaatattacacttcaaaaagcatggtacgaataatccatgcacccactagttggctccccacgtctttgccatgggttttatagttttattgtcaaagttttaaatggttaggtgcaactctatgtttatacaaaatatatgataatgtagatttatatatgtcttatgttattgaaatataattcatgctttatttttccaagagtaattgcgtattgttataatatatgaatattattttcatgcgcaatatgggtattgttatagtaagacaatttgcatctctctatttcactcaagttta

SEQ ID NO: 58702 - DNA, 1109 bp, Oryza sativa
aataaagtgcctgttacagtcaaggttattccgtgcattaagtagtaaccagcttaatacaatactaaacctctatgttgctgtgcagagacttgatcacctgcaaaatgagcaagaaatgtatgaaattagagtggccacagtaaaccacacacaggaaactcaattctgtaaccccattttaacttgtggtacagggatagacaaatccacaatcaaatgcaattcttgaactgggagatggtcagatgatcagggcactcacgtaaatgaacatctggtacaagcgttccctctccgcatccgtaaacgacgggaaagccctcttcacatcctgcagtgcccaccacaacacgagtcaacaccgcgcacgaatcgatttcacccccaagcactctctcgctctaaatcacgccccccaacatttcacgctggtctctctcagtagcaaagcgcagtggccgcgagagctgagcccgagaaattcgaaggtggggagagaaggggaccgaacctcgcgggagcaggcggtgaggacggagcgggcggcgagcttgaaggacctttcgaggttgccgtacctccccgccgccgccgccggagcggcctccatcggtggtggattccggcgaggtggaggcgccgctcgccgttaggtttcccgattcgaaattccgacgagcgaaaaaaaaaaagaaaaaatggctgcctctccctctcgtctccacgctgcctcgtgaggaaattgttatgtgggccttattgagccgtctcatccagattgaaccaggcccagatatagatggtcctaattgatctaggcccaaataggccgcgtcagacttacaggtgggccgtcaggccgcctaacaaaggcaagactgacacctctcagaaggaaagacacttgttgtccgaacagatggacacgtgtcagggtggcaggcgctcacatcgtgagcggttggatcaacatcctaaggagtagacgaggagtacaatgctataaatatcgtggcaaccacatgctaaccctaggtgtccattcccctaccccctcgccgccgccgcagctctaggatctcttcacccttacatgtgtgccatcg

SEQ ID NO: 58703 - DNA, 5677 bp, Oryza sativa
ttcctgcggcccgttaatattgttgtagaggcttcaatagagagaaagaacacttgtagatgaaagttctcaggtattctcaagaaaacaatctctatactttcttgctcgaggtaaaaggtatttactttcaacgcggatttgataggttcgatgatgataagcataacaaaggaaatggtctttgcagaggcctcatcaaggggaggggcatctatccttcttatcaaaatcgttagatatggtaagcaaatcctcaattaatttcctcttttttcttttggtagaaaaaaattccaattgtctcaacatgatttatataggttggatatgctacaatgctgatttactgttgttttttgccttttttgttgtctttgctattcttcttttatgagctatatataaatctatggtaaatctaatctaaatcttatcattgaatagaaatacctataatgtttacgttggctacgcaacttcgagcattcaaacattcccaattaccatcgcctccctaaacagcaatggtaattggggatgttcggttgctcgaggttgcgcagcatgctgtgccttgaccgtcaaacgaccccattaataatagcaaaagtggacttgtatatgaggtttggtttgcggatagagtatggtgagggcattttacaaaataatgcattgtaaatctaaaccatttctgagattcttatcgaataccagtaataatggtttttatctctgattgtatttttttattaaatgatttccatctgagtggcttatagaagtttggtgctttgaaagacagtggtaatgacgatggtaatgtcaggagcagacttattgctctgatgtacttcctccgttttataatgtaagtcattctagcattttccacattcatattgatgttaataaatctagatagatatatatgtctaaattctttaacatcaatatgaatgtgggaaatgctagaatgactttcattgtgaaacagagggagtatgaggtttggctcggggctagggtatcacaaatgcgttttctcaacaaattcagaatagatatactatttgggtgatattcatgactatgaagtgagacttggagaccattatacaggctagggctgaatttatgatttttcaacttgaaaagatttatgattttcttactagagaatttagatttgcgttattaaatgcatcgtaaatcaaaatcagtatctacatcttacatcttagtagtcatttattggattctaatcaaatttcaatactcttggtttatctttgattttgtatatctttttattaaatgtttttcttcaagtttcgtggttaccaaaaagttcggttttcagtggcaaccacctcatagaacacctaactcgtggcaaccacgaagttagaaaacatttaataaaaataagatatacaagaaaaaaaaataaaaaaccaagaattggtatttaatatgagtacaataaatggcccctatataataacctaaatctaaatattctaaagttagaaatcattaattcatttatttaatataccctacatctaaatcttccaaagttagaagtaataaattcgcccaaccctatatattggcctctaacctcacttcatagtcatcagtcatcacttcttcccaagtaaaaccccaagaagcggctattacttctctcccctgttcttcttcctccacattcccatttcctaaaaaaaaaatccccaaatctccacatgattcctccgtaattcggcgcgccctctcatggcgtccctcgccgaattccccctcccggtgatctctccgacttgctggagctatcggtagcgggaggaatcaatcaatcaatcccccacgctgggtggttcttgagcaagaacggctcatcgccgtgccgatcgatcacgtcggccgacggggaaatcctctggggatttgtgggtggttttgggctaaagattccgtttctttcgagcccttttggtctcgggtggatccgcttagctttggttcttttgctggttggggggcatggcggcggagtcgtcggctgctgctgctgcgggcgggggcgagaggaggggcccgatggatctgaacctgtatctcgcgctccctccgctgccgccgcctccgggaaggctggatgtcgccgccgattacccgtcgctgctgctgaactccgccgccacggtggcgaacgagcaaaggggctcggtggtggtggcggcccgcctccggcggcggcggcgtactcgccgtcgaacgcgctgtcagcgccggagcaggtgctggtagatcctgttgcagcgtggcttgttgatcccggtgagcagcagccggtgccgccgctcgagacgccatcgtacatggccagggcctcgtcgacgctgccacagatttttgcttgtgcagcgttggaaatgcttgtgcagaccggtggagcaatcccacctactggtcttataaggggagcagagattgctgctgcaagccgccctatgacgccggaggatcggctgcggaggttgatccaggtgagcgatcaacacggcgtcgggaatgggagggcggggactgggccagtgagccgcagccgacgggcgaatagcccggaagccgataatctggcgcgggccatccagaggtctcataattctcttgaggcatcaaggaggcagatgcttgatggtgatggcagtgatgccaccaagaaggatgacggttgcggatgcaacggcagcttcgaatgcaatatctgctttgaatcagctaaagatcctgtggttaccccttgtggccacctcttctgctggccttgcatataccagtggcttcatggacattcagagcactctgattgccctgtctgcaagggcgaggtgctcgaagtaaacgtcacaccgatttatggaagaggaggtggcgaggagaactcctccagaaatgatatccaaatccctcccaggccgagtgcgcagaggaccgagagcttgaggcagcagctgcaaaggccagacacaagaggaggcattgcaaacatggtgaggcggttgatgcaaaaccaagatatagtggtaggccaggcggcttcatctgcaccccggccaaggggtaggggtcgaaggcaggcaagacaagatgcgccttctgcaccagcaacacagcagcaggtggtcaatgctgatgctgggagtggcaatcaggctcctttgccacctcctgatgctaatggtgctgcaccggctgctgctgtcgctccccaacagtcatcatctgtggagcaagcgtcgacttctagcaccgtgggtgttatagcgggagggccagcacaaggtaggaggtcaagagtttctgaatccacccctgcaaggaggacaaggaggaggcatcagtaggtaacttagagttgttactgtaatagaacatatacaccatgtttccttgtaaccttgatcatatttaggctcatcccaaaattatgtagaattgtggatgaaatcttttcttttatttaccttgtatccaccattttaccttaggcaaaggaataaagatttcgatttcaatatatatggatggatctctttgtcgctgtgtattccaggataatattttctgacatgatatctgtttctgataatgagtttcagatattctggttgcaccatgtacctttatgctattgtgattcctggtactgaaactcacaaaacttgtggagccaagtcatgtgtatccttttattcagctagatttgtactgttgagatcgaagataggaaccaatgcattatgcttttcaatttaaatttgacactatgactattacaagttaactagagttcagaaaatcactggtactcagagtcaggtacaagtctcttcctttgttttcctctgattgcagctccattttgaatgagagcaaaacttgcagtattcaggtggtcaagtttgtgtcagcatgttattgttaaccattttaagatgtatttttatgtctattttgcagtgacattccataaatgaatactgtagcatacaagatcatgttatgttgaggcctgacagattatagactccttgatctgaacctctcatggggcataatcagttcctgtgtgtcatgaactaacattttgttgcaaatgtaaaagctatcaaaaacatataaaccaattgtatacttgtcaataatcatttacatttcaggtacatctgaacatttgtgttggcaaaaaaaaaacatatatattccccatggctccataataatattgtttgcgaattactctttgaaggtcaccttgtcaatgtaccagcctctgcaacaggatgcacattgattatgcccggacaggatgcaaatgaaattacttgacgaaatcagtcttctgcgtaataatttctatcccactgactcgataccatatggaacatatggccactgtttattgtaacttctttgcatggattctttttgtacaagaacaatgtcagattggtgctatgcaactagctacaacatacatgtctcggtatcaggcatttatcttaaaattattgctccagagtcagatgctcagagcacaagctgcttgggttagacttgcatgctgctagatttgctgccattcaaatggaggttggtactccttgtgtatccagcatttgggcagcgtagcactgtttccttaagctttataatggttatcttgccttcctttatatctcgttccgtcatttgcacattaaaaacaccaggtcgatgtgtgtttcagggggccgaggtgtgaagatggttgaagtagcacaatgaaacctgcaacatgttgtgtaaccactaagcagtggtcattgtaatatcctgactacctttgtttgcttggaagtgtttgtcctccatctgatgcaatttttcctttgcactattcccctactttgaaaatgcagtgtacatcacctgcaatgtttaggtgtgggggtttgtggggaagaaaatgttagattacaacatctggttcttaggattcagctgacctagtttagcatcttatatgcttcttacatagtagaaaaacaggtttcaaatattcgaataattaatgtttttaccttgggcaacaacatatttcagatattcgaataattaatgtttttaccttgtgctagatgttcaggataacaaaggtagctgcgaggcctgcacttcagcaatgatttgtgctcatcttcagacactgatcatgcaccatgaataccagcgataccatcagtatgacaattggaatattgaatgattatgtgccaaaatgttcacatgttaccaccggttgttgtatggctcagttcagtatatatcatttcaaactccttcacagctacaatagctagtttgtgtacaggttcattatgtcttgaactgctctatcaatcccagtaggctgtatgtttcagcatctggcatcgctcctctcaaaatcatcgctcttaacaaatctggctcataaacttttgcctttacatgagctttaagaagggtattatacacaaatgaattcctacagtactttgattcattcagttcgtcaaaaactctctttgcatttaccaagtcgccattttctgcaaagctttcaagtatcatatga

SEQ ID NO: 58704 - DNA, 2125 bp, Oryza sativa
aatttaggggataattcgtactttttcctttagaaacatgccaggggaaatttttcatgtagccaaaaaaaataaaagaataattaaaaaccatataaaatctcaaaaaacagaaatatcgcagaaatatattaaaaaggaaaatctagataaagtgaaaaacccagcagaaaatctagaataataaaaaaataaaaaaaatattcaacaagaatatagaaaatactaagtcatatttaaatgaggtacccttttcacaagatcagagaaaataaaaattgatctatgcaacatactgagatcatgatgagctttataatgtaataaaatatcataaaagctgcagaagtatcaatggcatccatgcatccacacatgcaaataatatatttcatacaaggttataatgtcttgatcaagaaagaatgatgagtaatcaaagaaatagggctgaagtctacagactatagagaacccatactagctagtacatgctagctagcatttgcttatatcacgatgggataaaactctgtacaaaatctcccaaatgttctccaggtacaaaaacttgatgaaatgcatgtgtgccaaccatgtccataaggcatcttgaatctcccaatcatactctgcattataagaataattgttctgcatattcgtttgaaagagattgcagagtgtcataacatatattatgggcacttactgaaccagaaccaatacgacagtgtatagctaagtgaaccaactacttagtatgacagctatttgcttcctgaaacaagcttccgagagataactaaagaaaggatatatgcagagtattatttgtcgaattaaagaaagtatagcgaaagaaggactatctaggaagattagtaaaaacaggatatttacttgatacagtacaggaaactactgctagcaaaacaaaactaatcttccctcctcaatcgaaataaatttagctctgttcttatctccaagttcccaaaccctcttcctcgttttccgcgcgcacgcttttaaaactactaaacggtgtgttttttgtaaaaagtttctatacgaaagttgcttaaaaaaatcaaattaatccatttttgaaaaaaaaatagctaatacttaattaattatgcaataacacttgcttcgttttactgccatatctgatcacaaaatgattacaaatgacaacaacgacacaactcaaaagatcgatcggacacatattcatatatgattccctttaaaaccattttattgtattattgtgtcattacagcagatctacctgctattgaacatgacaaaacctttaatccttcctgatctagctcagttaagagtaaagtagggcctcaaatcattgctttggtcagtgatttgaggcccttggcctactaaagtgccgcatgactaaagcacccaatacatcatttcgctggtgagcttgtacatctcagacctgtgcttcagcatgcggagccctcctccattggcaccaccagcatcgtcgtcgtcatcgcagcgctccacctcgacggcggttaacacagcgaacagctcctcgccatcacgctgatcctcatcggtctgaaagaacctggcaatgcagaacttggcggctctaggtttacgaggtatgagctgacaagctggagggcgtcgggtggcgtgaactccagaggaaggctgtgaagcaccggcagcttggtgccatcgagatccagagcggagaggaccaagctcctcctcctgtctccagtgctgcatgagaggccaaaccaaaggccgtgctcatggcaatactcggcgagaccaacaaatggcagcttccagccagtggccactgtgctccacacatggctcactgtgtcaaagcagtagatgccactgccgtgcgtggatgacatccagatctccatgtcaccaaccacagcgtacgagtggacatgcaaatcggacttgtgagacagcggcggcggcggcggggggagagcgtggcatcgccaatcctcatttaatccatcctcgtagatgagcccatagaagcagccgcaggggacgtttccaccgccgtcgtcgttgacatggcggcgcgacgtgtcaaggatat

SEQ ID NO: 58705 - DNA, 2409 bp, Oryza sativa
ggatccgactcccggatggccagggtcgttatggccggcgtcgctggcgacgggaggacggcgcgtgcggaaggacggcgcatgcgcgacgggaggacgccggcgttgaggtcgatgcgtgcggcgccgtgcagcgggccgacgcggcagtggctggcgccggcgatgcttgccgccggacctcgtgatcctcgtggatgaccgccgatgggggctgctgccagatggatggctgcgttgtgggggacccgactgggacaccggcttgcatggcggcggcggggtcgttgcacgtcgcccgtgtggcggcgctgcaggtgttggccggtggagatgccgccggatctggggtcgagctcggattcagccgcacagtactgccatcacgaccggcgatgacgaggggacgccatgtgggtgccttctcatctccttggagctcctccccttcttgaccgcctggtcgtggggagctcctttgcgagacggtgaagacggcggcaaggttgccccaggttgttatcgatagtgatgggcggtggcgggcactctctttgtaggtgacggcatgggaggaaggctagctggtcgccgaagtgcagcggtggtttggtcgtgctcgttccaacgtgtagctgtgggggtcgcgctggcagcaggttaggtcgcttggagtccagccgacggaggggcgtcgttgctgtagaggccacgtgttgacattgcctgggagttggtgaggtagcggcaagaggggcattggcaagtgctaggcgaaagccagcccaattcttgggcggcaacggcgatgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggctgtgtgttcctctcggtgtggtggtgtgtaggcacgtggcggggtgtgttctcttgtccggttcccctgtcccctgctgcttttgcctttggttgtaaatgtctattttactcctcttaatgcaaaaatacgcttctagcgtattcccgaaaaaaaaatcgatcaatcggattgaattgctctggatctccttctcccccacaacgaacaactaggctactactctgaagaatcagaagagatctagatcgatgggtgcctcccacccctttgggttagggttagagacagatcaacgaagagaaagtagtaaaacttggtatttatttgtcttcgttttggactagaacttcctatcccaagcgaagccaaatgatctttctcgttgcaaatctcaccttagcagagagagggagtggggggagccgcccaaccgctactcctcgagcgaatcggagagtcgccggcggcggacagacgacgggaaggggatggtggaggaagagagagagagaggtggggagggagttggctccggcagcggtcgttctggtggcggcgtgagtgcggcctgcggcggcgtccggggagcacgccgggtgagttagcgaattttttttatttttaattttttttattaaaagttttacaaaaataatttttcattttgaacattgagcgaagtggtcgcctcccgccgtccggcagggcgattttgcacccccgccaccgtacagggcgctcacactgacgtggcagacggccgttcgccctcggacgacggccgtccaggaaatttgcagggcgcccccttgccgccctccgctagggcaaccccgtagcggccggggggccgcctgcaaatgggcagcggggggcctggaattttgcaggcggcccccttgccgccctgggggagggcgatttttgcctccccctataaagcccagccctctctctgaaatttcattatattcagtaaaaatccaaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggt

SEQ ID NO: 58706 - DNA, 1125 bp, Oryza sativa
cacaagagagttcttgaaaagttaagagcacatcaatgagtctaggacatttcactgttagaatgcagatttcttgacatttttgtcatggctaagtttgctatactagcacaatttattttatgatttgtattgtggtgctgcaagccggcaacagtagtggagaaccactgaaatcaacttgaaagtaacaaaatggcatgcagctgaatgcagcgagtgtgacttgagagctagttcagacatcgttttttttttcatggaatcactgcaccagtcgatcgaggccgcactctgacttatctgcatttgttcgtggaagtcagacatgcatttttgatgaacttctgcaattataactattactgttagaaattagaaatgtgcatgattctgaattctaatgagtgatgacagtaactgaatgttctgagttctgaatcactggacccgatcgattagcaatccacggcagctagttctgtaaactgggtcgattgaatcactggatcctcctaattgtgtaaaaactcacagcttgaaaggattggacagatttgttttgtttgcagcagcgatcagaagttcagaactctgcattttgtatatgagcaattctatggttcttgaggaggtactatgagataccaaaattttagtgtaaaattttggtactttatggtacctcgtagtacctaggtatcaagaggtaccaaatttgcaatagaaaaaatggtacctccttaataaccgtaaaattgctctttgtatataagatttgcagagtccactgaaatgcaatcccgaacctgcgccgcgtcatttgagcaaattctgtaccacgaaatctgctgcactcactccctgtggtcgggcccacccgtcattgactacggttgaccaaagttgaaacggggacccacctgtcagagagcgacctgcgtcttctcgcgacgccttcaaatgccaccgcctccctcggctaacaaactcttccacggctacttgcctctctcgtcttcctccccacgccacgccaccgaggagtagccactcgccgccgcgcgcgcgctctcgccacgccgcgctctcgcctcgccaccgcgcgtgcatcgatcgctcgcg

SEQ ID NO: 58707 - DNA, 12404 bp, Oryza sativa
cggtgtgggccgtggaggagttgctcgtacctgctcttccgtggaggagttccgcggaggaggaggaggccgccacgcggtacctgctcctccgcagcgcctacggccggtacctcggcgccaccgacgcggcccccggcgaggccgcccgcaacgccaccgcccgcgccgccgccgccagctctgacgtccgccaaccacacgaccgcgagggttgctgcggctgctgctgctgctgctgccgactccccttcggcttggtcgaggccacgcagcgcgaccgcgatgaggaggagccggaggtcgacgccatcatgtggctggcaaccaggtgcggcgaccaagacgtacaagaggatcgcgacgcccgcggcgtcgtccttctgcgcgacaggtccgggcgctacctgcgctgcaacaagagtatcctggcttgccgccgcagcatctcagtcgacgccaacttcgaggacgaagatacgttgctgtgggaggtggtgcgcgtccccccgagtgaagacatgccggagctcccgatcgccactcaggtgagcttctccgatccttttcccctctcttcttgcgattcttgtttttttgttttgtgtcttgatgctgatttcgtcggagattaatcttgatttcttgcaagaactaaccgtgcagtacaatttgtggattgatcgaatttctttctgctaccattgttgattttgcgcacccgggttcttcgtcagggtgtgcttcccccagccgctgcgggagatccagttcgtggacgaagccgacctcgacaacatcagcgagggagaaaactgggctacggttcagatcagagggaggtcggtgaggctcctgagagagaagatcgcggagcttgtgggctacgacgacttcacgatgtgcgtcagcgccggccgccatgggcagttcacccctctgctcatcgacctgcctcgccgccgggagaccctgcagatcgtccttgtcaggcccaacaccgatgtaagcagcctagttaaatatgaatgttgctgaattttctgaacaatgtttatgtggttctgaattttgctgtgaattctagtaacggatggcatggaatgggcaatgtctctgtttttttgatttttttttgtgtcagatcagcactgtagattttctagctttcagtagtttgtgcgctgtttggaatttcctgaaaatgcagtgatgatgtatttgcagaacttatctttcagtagagttaggatttgtctgaagaatactgtagaacagcagaactgcagaagtgaaatatatctgcacttatctgatgaatattcattccaatcatcatcagacaattgtgtgcaccttgggtttaactgaatgctgtaggattcatctgaatgttgtagatttttcggtgtgaaattcagcattcgagtagcattttaacatgtgaattactggcactgtttttacttacaagagctgtaattcttgtgtattactctttctaactgcgtgatttgtttgctatggctgcagcgtatgatcagttgatattcccgaatccgaatgcattgccgtcagccgaggccacagatgaagacgatcccacgattgagtgaatccttttgtgctcaagttctgacaggctcagggaactcgacagaagattagtgtgttggtatagagtggaattttcagttcagccgatgctggaatgcagttttacgttctctcagctgtagaatggctgaaaaacctcaaattgtctgtgtgttcagtgggtgtttttcgacggtttacgtactttgaaaccggtaaaacagggctttctgacgaaaatattggttttggtgacagttagtattcatgcctagtattgattgatgacaagaatgtgcttaatcctgcaatatattgctattcatgctagacttggttacaaatatgcatagcgtgtctgaattctgatgagtggttccagtagctgaatgtctgaatctcctgtagcattcaggtttgttctagtctatgtattttggaattttgataggttccggtttgcaaatgctacatgctagtatctgctggttctaaacttactgattaccctaaaccaattgttggatccagaagtaaagtacacaggattaagactatgtctgatgccctgaagcattcagggtttgtcccagtccttgtaagagtaattaggaattttagaaaacttatttttgtaaatagtcccttccactcttgtaataggtttttagttctatttataaaataagttttctacaaggtctaaatgtaaaaacaacttcagatatgcttccacatcaggaagtggatttttgtccctcgagaagacatcccatcgttttgtgtatggtgttcaaaaagttatcaaaaaatttgaaaacaattgtcaaaaaaatcaatatatgatatatcttttcacaaacatacaagttaaaatttgacttatacaattcgaaacaaaaataaaaaatttgaccgtgaattactcattctagtcatagtcaaatttattaccttttacagtgtttgcattcctaaaatggcatagatctaaccgctcacgatgaaaggtatcagaggtagaaaggtactaaggattaaaaggtaattgataacagggcaattatgtctaacaacgtatggacgtaccgaaaggtacggtgtaagtggatttgaaggtaccacaaggtaccgcgtaagtagtttttaaaggtaacgtaaaatatgatttatgtggtgggacaaaaattacattctcttctattcggtttccaatcttcggtcgttctgtttgcgtcggttttcaaactttggtccgatttacgtggtacatatcatattcgcatgatcttgataattatttccagttagtcattaatttacatagcaatttggtgaccatcgtttgatgaatgtaatcaaagatcgaaaggacaacaaattgagaagatttacgcacctaacaagaacaaaacaagttcaatgaggaagatttgcgaaaaaaaaactaaacaaatcgtctgacagatcgggaccgtgcggccacttctagctccggcgaacataggtagtcctggaccacttcctcccggtcctcttcctccgccgcccctccctccaaccaccgcctccggccacacgtccaccgccggccctcaattctccacctttcaacttatcgaagaacacgtaaaccttacgtatgaacagaacgtatctaagaacgatgcaacgcaacaggctacaagctaattccttcgataccttctcataccttttcatatgtgtaaaagacacatttgtcattctaatatcatcatatttatattaatgccacctattacaatattttctttccataccttgcccctcgcagatcatcggctcacgtcgccccacctcctttacctcgcaaacatcgtataaattgaatttgaatatgcatgtttgtgaagtgacatatcacatattgatctatcatactttttttaaggaaattttttgatgactttttaagtgacatgtaaaaacggggcatatccaaatagagtttcccttccacatcactgtcctttgtaaaggtgataagctcacccaaggatgctcaaattacatccagcacatccatggccatctcaaacgcaatgaaatttctgcgggttgggattaagttcaagttctttaatctcaacctgccgaaatttattttctttgcaattacccatttgagtaaatttaaagcagcaaataatcatgtttcaagcaaagtgagtgtttttcttgtgcggtaactgaagcctcaatttggtggcggagacctggtggccttctgcgtgctctcaacacagcttatttcgattgcttatccgccaaaaatggtggagcttgaacgaaaaattggagaggaccaatatgatagtttcatttaaaataggaatattatgctttgtttaaaacttgagcatagagagtcaacaaattcagtgtaacttttctaagactgaggagacatgattaaggttagcttctactcctatcgtcccaaaacaaaacttaatgtaagaggagatatgacccctcctaatacaatgaatgtgagaccctgtttagatgggactaaaacttttaagtccctatcacatcagatgtttggacattaattaaaaatattaaacgtagactattaataaaacccattcataatattggactaattcacgagacgaatctattgagtctaattaatccatgattagcttatgtgatgctacagtaaacattctctaattatggattaattaggcttaaaaaatttgtctcgcaaattagctttcatttatttaattagttttgtaagtagcctatatttaatactctaaattagtgtctaaatacatagactaaagttaagtccctggatccaaacaccacctgaataaccctttatccagattcgttatattaggaagggtcacattctctcattggttgagtagagtgatcaaagaaacaccatccggactgtgtattagattggtgctactaatgatgaaacaaaagatatagtattgggtaattttaacatcctcgaaaaagtaccgggaattaccatattttctagtataaaattaatttggtacctctagatactaaatatctcgagataaaaaaaatagtataaaatttagatacctcgagatactttttcaagtacgataaaatttctctatagtattactttgataacgtgctacatcgaaacaaatgctacagtgcccaaaaataaaaaaaacatatgcatgaagccaaacagttgatgaaatatggggatagctaactttgaattcagggattgcagaagtgtaataaatgacctaataatcctggataattaagaacttaaatctagctcgttaattaattatgctttctccttttggcacaaggcacatcatcatctgcaggcgcgtgaccctccccgtcctcttgaccctcctcctcgtcctcgtcctcgtcgtcgtcgttgtcctcctcctcctcctcgtccggtatcgctaacgccggcggcgtcgacggctgcgccggcggctggtggaagggctcgggctggagggcgacgtcgtcggctggggctgggcttgacgttgccggatggtgttggcgagcgcgctcggccttgaggcggtcgagctgctgctggagcttgagaatccggccgtaggcgccaaggatggggtcctcgaccctcgcgtcggcgaggtagacgacggccgccatgctaatcacggtggagccgttgggccggatcccctgcttctccgcctccgagaagccgaggatcctctccatgccgaacatgaggcgcgcgtaccagaagcgcttcggcttgtcggccggggggggggggggggcgcagttcggcgggcagctgcttgccccgtggtgtgcgcacgcggcgcacgcctgttgggtcgtcgtcgtcgtcggcgacggcggcggctccgccattgattaattcttcgtcagcgagggggtcaagaactcgatgaaatttcggcggcgtggcgtggcgtggcgaggcgaggctagtgtggtcggctcgcttcgggcaccgaagcaaaaatatagatatagtgcgagagtctgtgtagtgcacgtactgagcccgattcgaattcactgttaacctcttgtgttggtgggttaattcgtctccatctcaaattacatattcaactgcctctggattatgtgccccaaaacgcgaatattaccactgtaatttcctgctcacatcggcggtttcaactgcggttaaggatgaaaaagttaaaacggaaagtaagcagtcctccacagtaactatcaggtttcgtttcactcccaccgttcgatcatccaccatcttccttcggtagttaactgttcttaataactcattaactagctagtccagttaattctggagaatcgttccattggagcaagcttcaattctgaaactcctagactctgaatcagacctctaaaactctgaagattcagagaacatctgaacttgttctgctcgctggaaacgaaacgaatctgctcaaaggagttaatcttgcgagaatgcgagtcgttgcgcatctgagagcaacataaaactatattcagcatcggcagaaaaatctactctctgtcgctaatcgaccaacgaaacttgtgtcaagtaccaacaaaacaagttcagcacaaaaggattcacggagtctgtctctaataagctgacgaaccttctgtcgacggtcctgtcaagtacccataaacatctggggaaagtttcaggtggaaccccctctttcagtgaaaccatggaacctcaactgagggtgtgtttagatccaaagttttcatccaaacttcctacttttcccatcacatcaacctgtcatacacacacaacttttcagtcatagcagagaaacgacacagttagactcaggcagtgtggtacaatcataaaagcaatagtattcttgagagtaaaaactgggcaagtaattctgcaaattaaagatgctgaatttcacactaaacactggcatgatcattttcataacaaattgaaattaacattcataacatatacaaaaaatattttcctcaaatgaaaatatacagaaaataaagcattgaaggtgtatgagaccattcatttcaggtatactggagacaatgtcaacacatcatttcagctacaattctgtttgtgtacaatattcagataaatcctactcacagagggtattcccaaagtgcatacaattttgtcctgatgagtcctaaacttgtgttgttctacatgcattctcatcaacagaaaattcctcagatgagtcctaaactcaagtcaacagtatatttcgcttgtgttctacaatattcttcagactagtcctaactcaagaatcaaatgcaggattgcatttttcaaaaaattccacaacaagcacaaacaatctacagcgatgcactaacaaacaattacccgcataattgttcaacaattactagcgatgcgttcctttgacagcaaaattcagaatctacagtcatgcactaacgaaaagaacctggagaacggaaacactgccagcatgctaggctgcttaactctggtgttcagaaccacattaacagtgttcagaaaattcagaaagagatcgaactaggctgcttacctgcggtgttggacttgacaaggacgacgtgcagggtctcccagctgcgaggcaggtactcaagtctctgacccatcagcatcaagaattgccacaattagaactcaaatcgatataatctttggcgcaaacgagttcaagaatcgcaagaagagaggggacgaggaggaggagctcacatggcccatggccgggatgtctcgcctgaagagagttgtggggacgggaagcacctcccactgcatcgggatgttgaggtcgccgtcgttgaaggccgcgacgccggcgaggcacgggagccacctctcgttgacgcgcaggtagcgcgcggtcgtacttgtcgtgcagcaggacgacgccgtcgccagccgccggcgcccagcccgacggcacgccacatgatggcgtcgacctcacctcctccctgtcgaagtcgcgctgcccggcggcgggccagaagcagaagggcgcgcccagaagtggctgatggcgtcgggggcaccgagatagcggccgtaggcgccgcggaggagcacgtggcccgggaggaggacgccgtcgccgccctcggcctcggcgttgatcgtcttcgctggcgaggaggtacctgccgacgctgccgtccacccgcgaccgaagccggacggactccacgtcctggaatacctccattgctcccgccgccccgccggtggtcgcctcgcgcgcgcgggcgctcgcgtcaccaagcgggctcctctcctctcatcggcgacggcgaggcgtgggcgcgtggcgtgcggaggaagacgagaggaggagtttgttagcgacggttagagctgggacatgggccgttccgggctaggcacggcccagcgtgcttcgtgccaaatcgggccgtgccagcacggcgtcttcatggacgccgcccaagcacggcccaatggcccgatgggcctattcgtgccgggccggcacaagcacggcgcctgatggatggatgagaaaagcccatcgggccattatcgtgccatggaccatcgggccgtttacgtgccgtgccgcccgtcgtgcccgttgtccaggcccaggcacggcccacgtacgggctgtgccggaccgtgctttctagcgtgccgggccgtcgtgccttgggccggcctgataaagcacggcccaagtcccagttctagcgacgggtgcgacggggaggtgggcatttgaagcgtcgcgaagcacagcacagggctctgtctgtctgtgcaggtgggcccagaaacggtcaagtctggtcaactgcgtaactgacaggtgggccaccccacaactagccatagttcggagtggatgacgagtgcgcgcgctgacgagccgccgcggccgccacgacgacgagttcgtcgccttcgaggccggccgccgctcgacggcttcctccaccgcgcggcacggaggcgccgccacgctcgcgcgccccggcttccctgcgctacgcctccgccacggctgcatcggccaggtcgcgctccgcctccgccacggcctctcctgatctggccgcatcggccagatcaggaaggggctcgacgagatctcccccaactatgccgcctacgacatcgccggcctgggatgcccgtgctccctcttcctcctccgccaccattctcgccgtcaggtacgctctcgaactactcatcgttgtcggggaacagggcgatcgaggagggtggggtggaggtgggctgagtgcgcggcggaagccgtcggggtcggatgcggcggagatagacgagcgcggatcggacggatgcaggtggggaaggagcggcggcggaggaggattgaggtaggagttcgtcgcccggccgccggccagcttgatctgacgaccagcggcaatcccaaaaatttgacgaacctgattttttttcaaatacacccctggtttggattgctgtcattggaagcgacttggaatttctcaaaattgctcgaatgaggcgcagattcagggttggattttagtgaactctacaaaattcatacaacaaagtttgaacgaacggaaaagggagtgtccaattctttcaaagtgaatttacagaaggattttgatggccgccatgggtgctcgatccatcggtgcttcgccagctgtgcgaggaagaagacgacgacgaagactagtaggacatggatgcatcggctacgtgtcgagctcgaggggatcaggggacgatgaggcagaggccgtcttcttggtcgccgtcgtcttcctccggaacggccggcacgccttgacgctgaggtcgacggcggcggcgagcgccacgaacatggcggcgtcctccatgcacgtgacgtggcgcatggcgagctgcacgagcggcctgctgctccgggactccccctccacgcggcagctcatcacgaacccgccgccggcgcacgcctcgcccaggctcgccgcgcagtgctccgccccggcggccagcgccggcgcctgcctgtccatgtcgatggcgaactccccgcccctgtcgctgcggagcggcgtctcggccaccagcatgcacgcgtcctggccgtcggggaggagccgcagccggaggcacaccgtgtcctgcctcgccgcgccgccctgatcccgccacgcctccagccgcccccacggctgccagctctccaccgccgccgacgacgacgtcgaccccggcgccgtcgcgccggcgcgcgcgatcagccacgcgccagggttggaccgcgccaccgtgtcgcagccgctcgccgccacgaacggcgtcgccatgaacgccgcggcgacggcggagccggacaggtcatggatcaccaccttccaccccttcctctccctcctcctcatcatctccgcctccttctcctcgccgccggagctcgaccagtacagctgatccgaatgtgatccactgccaaccaaacaagaacaacatcaacgacatgatcaccaagacgagcacgacggcgtcaatggcgtcctctcaccgtctgtcgcggatgaacttgcagctgaagatgggctgccggttgcggccatggagctggacaacctgcggattcagcgcgacctcgtcgtcgaactcaaagatgtaccggggatcagcctccatcttcaccctcaagtgcagctccggcttggcctcaccgttgccaatgccaacccagccatggtgaagcatcaccggcttgccgtcgcgccactcaggcccaatgtccatcctgaccaccccaaccagcctcttcatcccggtgacaatgccacaatgcccgccacgccggccaacgtacaccgcgacctcgaggtaagacccatgagctccgaaacaccccggtgccgacagcgccttcagttcagattcgtcgagggagaagacggcggcattggtgtgtggatcaaggttgaactctgaataattgatcagagggacaggagctatctggacagggaatcctcggagccggatctcgcagtggaagctccgggccgccttcctcgcattcgcaccggggagtttcagaccaagctgtccaactgaaagtctgacaaaaatctggggatccattcttcgtgtcactgaagattagctacttccatggcacatgctgaaaaattcacaaatcattgaagtcagatataatttgatgtaacaatcaattgtaggaaaagaaatgaattctgcaaattagcactaggtgtgcagctgatcttaaaattcttccaatagtagtgtatggtatgacagtatatgctccaagtgatatggaactatgaaaaagactacatagtagcaaatccagaaagaaatgcatagagcatgtttcagtatcagctatgtgctataggaatggcacatgaaaagtagcaacattgctgttgcatgaagatatcactttcagattccattcaaaaaattacatcacttttacccttgtaggtatgaccaaattctacagaaagtaaaagcctaactccgtagccagattcagctcatcacttcaaaatcataggcttaaagcgccagatagaagctgattgcattagattagaccatagccaaattcagctcatcacttcaaaattacagatcacaggcacaatttctccatctgtaaccaagttttattaggtccacctaatctaaggtttaagatcagccaaaaaaaaacttaaaagtaaaagaactaattatttaggaaataaaaatgatttacttagtaagttagctgttttttttttctcaactcaaagtagattttgccagcatttggaattagcattcagacatgtctttaatcgtgattttgatctaatagaaggtacagttcaccttaaacattccccactaaaaaaagaacacgcaactgacgcctagatgcttgcctttcccccattttttttgtgaaacctttgggatccttgacaaaatttaaagaaagatgaatgttgatcaagtagcatattcttcccctttgacaatccctagtgcaagcactaaaaaaggcaagcattgctaatgccactcaacacctcttagcttaaacaactgaaagggagaagaaaggaagaaagaaaaagaggcatctggtgctttgcaatcatgccattgagtggttatcaatggcaattgccaatgccattagcatgccacctctgttcaaagctcctctcatcagtcaggcactgacagtgtcactgcaactgcaaaaaaaaaaaaaaaaggcttgtgcaaccaaagaaaagcatccaagaagagcagcatcaatggcgcggcgcgacataagctagcccgtgtgtcgcgaaaaggggcggcggccatggcagcaatggtggtgcatgggtgaggtagcccaggatcagaattctccctttgctcccatttctttaaccctccaagcaaagcttcctcctctgtcgtatgatcagcgtgcaaagtggagattccaaaccttcctctccaccaacaagtcctcctccggcgcaggcacgccacgccacgccacggcgtggacaaggccgagcacataaggcggccgccgccgcagccgcagccgcagccgcagccgcagcaaaagcttcgctgcatctcacaatgttaagcgcggcgaacggcggcggcg

SEQ ID NO: 58708 - DNA, 2931 bp, Oryza sativa
gtgctggtggtggtgctgctgctgcagcagcgggcgccgtacctcgccatccggtcggcgcggctcgacgacctcgtctacgaccagcaaggggcgctggaggcggcgctgtcgctgggcgtcgccgccgagaacggcaacgcgaggtcgggcgccaccttctccgacttcgagctccgcctcgtgttccaccgcgtggtcatcgccatccttcgcgccgacccgttcgacgtcccgcccaaggggtcgctgccgctgggctacgtggtgcgctcgtcggggatcccgctggacagctccggcatggccgccatggaggcggcgctcgccgacggcgtcgtgccgttcaccgtgtccggccaggcgagcacgcggtggaaggtgggtggcctcgtcccgttcaagtactggacgcgcctacgctgcgacctccgattcttctggcccaatggcaccgccgtcgacctcagctgcagctccaagcccaaatccaagagcagctagctagctaaccatcaaaagaaaagatacttcatctttcttgctccaatccaagttctccatggatttctgatgtgatcaagattcaagaacatgccactgcctttcttggattaattcttcctttcatccttcctttcttcgttgattcagttcatgtatagattggtcaagaaaatgacaactacacccccaatttgtacaattaattagattgtgtaattgatttgaggtgtgcagattaagatcatagtaggtcctaattaaggggaaagaaagggtagtggaaacagtctggcatggtaaagtaaaaactgattaggaaaagatgtagtcttgttgcaagattgaacaagaccagtgacttcttttcttgcaagctttgttgcttggaggaaacaaattccatggaggggaggaggaaaggggcaaaaggataaaaagagaacaccatgaaaagaagcaaagctactcctatgtaggaaggaaatgtgcttttggtaatggagattgtggccctagcgccatgcatgtgcttcttctcctcctttccatcccttgatccttgtcatgttctttcgcttgcttttgtttcaaggattatctagaagaataagtgaataataaccagtctcagatcccaagaatctccaactcatccattattcaaccacttctctctgaccggatacatctttgatgtagaagttggattgattaattatccttatcggaataaaaatcctctcaaccactctcaagctcaaacaacacactaggaagctaccaatacatttctatgtaaacaaaaaaaaaaaactaccaatacatatacatacatcaacatcatgcagtatatactatagtagattagtaccaatagtaaacccctaaaattgaacaaaagcaataggcaaaaagaattgaaattgagttgaatttggatttcggaccatacctgtcaaaattggttggtttcttggcagaactcagcaacggagaagaagtgaagaacacctaggagaaggaagaagaagaagcagcagcaacaggcaggacaccactagagctcagccaagagacaggcgacagatgctccgattctagacgacgacgacgagctcaccggaatccatcccgccggcgacgacgacccgccctgcgtgatgacctcgccgccgccgaacccgaattccatgatcgattttcagaggccgaatcaatcgcaggtggagaagaagaagaagaacaagagcaagaaccagaagaatacagctgctgctactgttagctactatagcttagctatgcaggagagagtgggaagagagagagagagagagagagaggaagacgacgacgactttatacgccgcggccgctgcccaatgcgattgctcctaccacgcggcaacaaagagaaagtcattagtttaatttagtaactaactataaccatagtaaaagaaattaccactactcactgattcgagcatggataacagtaaagctaaaactaactggtgtggaaaaaaggagaaaaaaaaatgagaggtgttagctctcatataacaattagttctacacgtgttccaatatatttacattaaatccatagtgaaaaaaaaagagagttgagaaaaaaatagagttaattttagagttaatttattactccatccatctaactttaatagtcatatttcatcttgacacatagaccaaggataaacaattctacttatcatccattactagtcattcctcgtaaacaagcgattcattaatatttacatttctcgatgcccatgtagccaatcttgtgtgaaagaatggagagtcacgcattaaatccgaaaaagtcattaagatgataggttgttggcttgaaatatgcctatcaaaaataaatttttcagatttggaaatatgactaccaaaagtagattagatggagggagtatatatgtaaactctaatataaattaatagtcaatagctttactattaaacttgttgttaggaattgagctgattgaataagcaagcaaaggttatgtgccgtgctgttgctgctgctggtgctggtattagaaggggaattaagtgagtagcagtggagctgtgtgcgcgagtaagctaagcgcgcgtgattagactggtaattgcgtgattagactgctagtgacgccgtggtgggggggtacgtacgtccgcgtgatgggcttatgatgcgttaatgatagaagaaggggggattagataggaggagtataatgccggcgccagctggagtccaaagcggcaacttgcgacttcgctttcctgacagccaggcatggacagcaaccctctccaccgctcatctcaaattcccgttttgcccccactattttcttctgttttttttttctcatctcattgctatgg

SEQ ID NO: 58709 - DNA, 780 bp, Oryza sativa
agagaagagagagaggaagagtgagagagaggggggaagaggggagagagagtgtgtatatatgacaggtgggctcactatgttttaaaaaatgaaaatgttgactggactgccatgcgaacgccacgcagaccaaaaccaccgcggattgagtcgagggggtaattcgtccgatttgtatagttgggggtgaagaatgtccggttttatggttcagggggtaattcggacgaccgcgatagttcccggggggaggggggtaattcgtactttttcctttcattaaaggaggggagacagaaaagtgttagtgaaaatattgatttacctctagtttattgcggaaatttagctaataaagatggcttaaagtgaaatttactctttattttcccaatttattgttcttgcatcgaaatcgagcgagaggataatttgttaacaatggtatgagagcctaccacgatgatatggagagttggcgactatacgtcttcgacggtggtcactacgctacgctcagtcgggacgtcgtggcgatatggccgcgcaaattaagcatccaccatgctaccgttgttgtctcaagactcaacgcaactacgcaagcgatattagcaacaccagtataaaaagaaatgcacataaatagtttggatttaactgttctcacatgcaaataaaagttcttaaaacgatgactctcaaaacacgaaattatccaacctaacaaaacgtaagtgtttcaccacatcttgttgtctcatcaaccacctctct

SEQ ID NO: 58710 - DNA, 1131 bp, Oryza sativa
acttttttttcttcaaacttttaacttttctgttatatcgaactttcctacacacacaaactttcaatttttccgtcacattattctaatttcttcaaacttccaattttgacgtggaactaaacacagccttaatttggtttgtacgagtaaagtaatattacctttgtttcataaaaaactaatctatattgacacatcctaatactacgaatgtaacgagattcatagtattaagatgtgtcaacatctactactagattgatttttttacggagtagtactcccttcgttaaagtgtgtgtttttcactcttttaccgtactaatacaaacaaaaatattcttactttatcagattttaatataattatttcttctttacttattttaagtgtatttatctttacttttataaacttgggtacaatgatgatggttaaaaataaatttattttagaagagaccgaacgaggaaaaaaaatggagtaacatatattgggtgatggcgacgttgcaccagctccgggcggtcactacgtggccatcgacgaaccacagaaacgcaatcaagaccgatcatcgataaattcatataccatggattaaatagagtgttgttgtttcgacatacaaatcctcatcgataagaataatttacaaataacactcaaaagcaactactctaaagctagctattttcagagggagttgttacttttatattttttcttaaaagaaacttcaaacgatagcagatttgctggatatgttaggaggaataaaaacataaagtcttacagagatcttttgagaaaggaacacatctaaacaatcaaagtgattagacttagatcaaatcaggtcagtggatcgactatctgtcggcaatcttccccaagtcgagccgactacaaggttgaagcgaaactgccctttcctctcccacggccgaaactttcctctccccatatctagatccgccctgccatcgcagagctgaccggcggtctacgcggcggataggatggcagcggcggggagacagacagcggagaagttgcggtggcggtcggacggccagactcgtgcctggccgcgtgggttggcggcggcaacggaggtggccggg

SEQ ID NO: 58711 - DNA, 1736 bp, Oryza sativa
agcgaatgaagatggcatcagcagaggttctcagcgacgacgcactaggggtggtggtgacttgaagactttcactaacggaatctggccgtttcagcagggtgtggtgaggtgtaggttttctttttctggttctatgttctcatcgttgaggtgtgagtctaagtgctcttgtatctttttggctgtgtatatctttcatggatacaaaggctggataaatgaaaatccattatcacaaaaaaaaggatttacaccaaatcaaacagaccgtagaaaggattgatcacgcttagccaataattcttttattgatctattaagctaatatttttcttaatttggaagacgacttttctttcattttttgatgtttgttggaagattcttctgctgcattccaaccagacgttcctgttaggatacgcataggctacggtagcataaattaaattttttctaccgcgtaaaccaggacccatacatgtattagatcatagatcattatcattcgacgcgctgcgcagcggaagaaagcgataagaaggcgaaggaaccctcaggatgtagcgcgcgtcgatgtagaggaagtagttgaccgcaccagctcgaccttctccttctcgtgcgttctcctcgccgtactcccacgctgatcaacaccgcaaagcagcggctcctctaccgtattcacatgtatagggacggaacgccacgcgcagatgtgctagcacatgcgcgcggctagggttttgctcgaggaggggagtggcggctagggtttctcacgtgatggaatacctccgccggtcacacccctcacaaatatatagaatccatgactcgggcctccaaggcccgtaggactcctattcggatccctatccgaattaagctcatattggatctccatctaatccccttattccggcccattaagcgtgcgaccctgtagatttatgtacactcggctgcaacccgaaaactccttttcggtctacgtgtcaacagcggcccctagcagaatgtattgatcgaccgggcatgcacaaagatcatctcggttaaacctctagtatatacttgtatgaacccctttcccttacgatatcgattaagctcaaggctagatatgtgccatcctcttcgcatggattgaaggctcgctttatcaccttatttgcatatgctttctcctataatattaggtatatgctatttccatataatatgaaccatgtatagcatatagtatatcttactcgtaacaccaacactatcatggagcaggtgatcgacaagaacatggaagaaattaaatggaatcttggagcataggaggagcgaggagtaacggtgatcttgttttctcccctttttttagcaacatttttttatattttccttgttgagaggaatggtgatcctctgtttgctgtcaaattctcaattagaacagaaataaccgcttaggcaatattcttttctcgtcaatatacatattttatcttaatttccgttagcatgttttttcaaaccacgaaatataccatttatgaaaattttatatacaagtcattttaaaaatttagataaatttatttttaagtttatactccatccgtttgataatgtaaaactttctagcattgcccatattcacacacacacacatatatatagatatatgtatatacctagattcattaatatttatatgagtgtgggtagaaaat

SEQ ID NO: 58712 - DNA, 1173 bp, Oryza sativa
gctcgcccggggcaacccgtcgagcaccttgcgcgcgtcctcccgggcgccgagcgcgaggtagagctcgacgagcctggcgagcaggaactcgttggagtcgaggccgtggacgcggaggtgcgcgtggacctggcgcgcgtgggcgagcgaccggcacgcggtgagcagcgcggcgaaggccgaggccgtggcggggacaccgcggtgggagaggtggtcgaggagggcgagcgcggaggggagcctcccgacgcgcgccagcctccggagctccgcggacagcgcgggcgcgttcttgagtccggccggagctccgcctgcgacgacgaagcgccccgcgcggccgcggcggcgccggcgtggagcgcgcgggagaggggcgtcgcgcgggtgaggggcttggggcaggagagcggcttggaggggaggagggggtggtttgcggcggcgagggaggaggacgccatcgccatggatggtggggcggaggttttcgggagggaaggagaaggggttaacggttgggaaggatggtggttgttgacgacagactaaagagatttttattagtttactttttcaatttctttgcattttctagagagtttgtttttgaatttcttgtgcatttttacgaataacattttaaattatgacaaagaaaaactccctagctataaagtcagctaatgctcccttagtagcatccattttgatgaaagaaaaatgtgttctctgcccaaacaacctaaaccgtaagaggccacgtgtctatccttacctatgagtatattgtatacactaattttgtattgagtcattgggatgagagattggggctgaacttggatggatgatagcattgaggttgcgaggataacggagaacgatagtaggtagagagtaactgtcagggttatggataccacatacctaatagtagttgactaaatctcggcaggacccactacataccatgtcttatacggaaacaaccttcggtataggaggagttccgcataaggaaggatgaatagagttctacatggaaacgacaaggactactcggattgtatcaatattggttttcctagttctacttggacaaggggatacctatgggtataaatacaatagatcaagacacaagatcaatatacaagccaacat

SEQ ID NO: 58713 - DNA, 709 bp, Oryza sativa
ttcaattattaattacatctaaattaatactgtgaattgatttcttatggagagtactaaaaataatctataatctatagaaattcatccatttatattttcattaatcctatacttaagagttagtattttaggtatttaattagtaaaatttcatctaactacacttttattaaccctataattaaattctaaaatttgtaaatattttaaatttccctcttaatttttctttctctttttctttccctttttcctctcctctcttttcttttctttttctttctctccctttcttttcttttctctcctggcttcctcctcccttcctctccttctctttctcggctctccctctctttctctcggctctctctctttcccacccgagcggtggcggcggcggactcgagggaaacggagggcgactcaccggcggcggcagcggcgatgacggcggcagcgacggcggcgcacggtggcgcgagaacggcggtgcgggcacggaaacggtcggcgcggcagcacaacggcggcggtgcggcggcactacgatggcggcgcggcggcactacgatggcggcgcgacggcgtggaggagtgggtggtggagacggggagaaggggggggaatagtgaggcctttataaggggagggagagagataagggggaaggaggaggacggaagagggaagaggggaaaaggg

SEQ ID NO: 58714 - DNA, 1560 bp, Oryza sativa
atcatcatttcatgggtactcgtattatggcacccacctatattattcaaatattttaatatttgataaaataggttaataataacttttattttatttgattttaatatcttgtgcataattatttgtaggattaaatatattctcgtaaatcatatctattgcttaaatgtagttcttttctttactttcttagtgatcatttatggtttggcaagcaacaggaatcataacaaccagcatgatgcaaaagttttaaaaagttcgaaattttagtgatttttattgttgggaattttcaggatgttacataggtccaagtttgcgcttcttcgttattggtacattgactttcgccaagcacccccatgtgcgcaaataagaaagtgatggttttctaccaatccatatctcataggtgttttgtcctatttctgttaggaactctgtttaacacatgatttgaggtcaacaatgcctccccccaccatgccttaggcagtcccgcggtgtccaacatggcattcaccacgtcactcagtgtgcggttcttcctttcagcaatcccattagactcgggagaatagggcggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgttgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttca

SEQ ID NO: 58715 - DNA, 722 bp, Oryza sativa
tcctgcagccccaagtcgatgaagacgtagacgcgcatcaacggtgatggcaaaatccaccaatcatgaagatgaagaaaatagtcggcgacggcaaacgcatccgacggtaatgatgattagcggcaacaaagatagccggctatggtgacgaagttgcccatcaacggcagcagtgtaggtatgttgaagaggcttgacaggatgttgatgaagatgacgatgccggcgatccaatcaatagcggtgtagcagccgatgataatgacgaagacgctcatcagcgtttgcgtagtaggtaacccgtgaaggtgaaataataagtcggcgaagacataatcagccattagcaatagcggagatgtcagggccgatgaagcagagatgctagtgatgatgtcagtgacaataatccatcaaactattgagaagatatcaaagctcgagtagtttccttgatgcgagcgtgtgcataacgaagactgatgcaacgccccttgatttataaagatgccagtagaacttggtcttgtagctgttgcagatgcttcacttggaggaaagtatatgctgttgtccaactcaacaaaactgagctgattggttgataactctaaactcccggacatgtagattaaatctcaaacttgatagttgaaaattttagagtaaattgtggcagcgtctagaaatccaaatgccggtgtataattggagtcgct

SEQ ID NO: 58716 - DNA, 1457 bp, Oryza sativa
ggtggtgtgaccaaccacccgtataggcgaagacactagttgcgcgcggatgagggcaagccggtggtgatgttctgactgatccattcctggagcgtaggagataagcttaaagccatgaatcccttttatgcatatctggatctggatcctaaagaacaaacatataggatgagtagtatctgatataaatataatactcgaggaaaatttaagtattttaaaatatttataaatatgtatttctcctcttgtcaattttgatttctccgagcagatgactccttacgtttaaacactctgcctaactagtcatagtccccaagcattgggagtcggcttaggcacttcccaaacatgcatatgagggacatgagttcgtcattaatggaacaaagtttcacggatcagagtttactactcgggtacttttacaattattaagagcagaaaataaattatttatctctatgcttgatttattccgagtaatacttagcaccttgcgttactcggtccatccaacgagcccccggtgctaggaatcggctcaatggcaactatccattggcaaaccaaacggaaatcataggaagatggaactccataactcgataggcacttttgtactcagattatgtcgcgagcaatcaagataaatagtatgaaaattgttgaaaaaatatgatataacatctgtagccaccgactcactagtcaacggcaaaccagttgatgtagtgaggcagagaaaaaagaaaatatcatataaagaaaatttaatgatgacttagctttgtaatattccccttggtgatggcagaggtggccaatgtgggaacaaagtcgtccatcaataacaataaagacaccagttggcggcggcgggagcaagccggtggtgtagatgacgaggtccatcaatggcggcggagtccacaaccgtataggcgaggacaccagtcggcggcgacggaggcaggccggcagtgaagtcgaagacgcccaacaacgacggggtaataggccaaccgtgtaggcgaggacaccagtcggcggcaacggaggcaggccggcgatgaagtcgtagacgcccaacaacagcggcataataagccaccgtgtaggcggagacatcagtcggcagcggcgaaggcaagtcggtcggtgaagccatggacgcccatgaacggtgatgtgaccaaccaaccgtataggcgaggacaccagtcggcggcgacagaggcagaccggtcggtgaagacgtagacacccaacaacgacggcataataaaccagccgtgcaggcggagacaccagtcggcggtggcgaaagcgagccggcggtgaagacgtggacgcccatgaacggtggtgtgaccaaccaaccgtataggcgaggacaccagtcggcggcgacagaggcaggccggtcgatgaagacgtggacgcccatg

SEQ ID NO: 58717 - DNA, 1836 bp, Oryza sativa
ttttaaaaacatgtcaattttgaaacgagcctttgcttatgtactcctaaaaaacatctcttttcttataataaatatgcaggaatttcacagtttctttaaaaagaacatctcaatttataaacaagcctttgcttaggtactccttgagaatttttgttctttttttggtttaaatatgcaggctaagattcaatttttcacagttctaaaaaagcatctcaatttataaacaagcctttgcttatgtactcattgagaaattctcaaaattcctgtgtgtacacccgaaagctatcaaagtcaatggtaagcttttcaatttgctatgtgctgtttagttttttcaaagaagcttcatgaaactttcgatcaaatctatccaagtgtggagcgctttaagaaagcaattttgaaattgtggtccgtatcttgtcaagaagacgtagaagcaaagttgatttgaactgaaagcaaccattctttttgtttgcatgtgtttgaattcaaccatgacaagtacatatttaaattcgaaccaaccaggggagagcaagaaactcaaacttctgagcgaatcaatcaatgtttgatttttgtaatctgatagaaacaaggcttttgtcatgagcccatcgaaattattgtttcttcttacgttttctgcaagatcatgcctaactttgacaaaatctgtccaaaaccttttgaatttcttatgcacggccatacgataagctgatttaaattgaaagccaccgtcttttgatttgtgtagggaatgattccgtgaaaaacaagttactacgtttttaaccaaactatgtttaatatttttatataagcaaggctcttatcacaacaattcaaatgttgtctctggaaagtacgctcaactttggacaaaatccatccgaactttgacatttgcattttggttttggtccataaccatatcacacaagaaaacacggggacaatgctgtccgaattgacaaaatctatatttatgtttgtgtggttccttagttaaatcatcaaaactttggacaaattctgacctctcttggaattttttaacaaaactgagaaagctctggaagttagaacagaaatggccttctttttgtttcgataatcttctattttgaattaaatcatgcagacaacagcatgattcttgcttgccctgtaaggacaagggaggtacaacacaaataattccattgaagtcttagtgcccaaaaaaaagaaatattgaaactaaaataatatcacagtctgaaactaaaatagaggataaaacaaattcaaatagtccatgggtacctgaattctttgtggttgccacgaattcggtacggtaggttaataattgttagtagacgtaccgtctgagaatattgaacatgttatacattggagtatattattccaccaagactcattttactattttcgcacaatcatcaatttaagacctcaagtttacagaaaacgactgatttaatgacacttgaaaaattccaaccatttctataggatcatggtatgctttcagcaattgctgacttttgccctaccttatcacttgagcccctataaatagaggcattatattgaacaaatgcattgcactcatctcaagcttttctctctctctctctctttgcactacattcttgaattcacaacctacaaacaatccaagaagatgtcttgctgcggaggaagctgcaactgtggctctagctgcaagtgcggcagcggctgcgggtatgattttaatgtctcattctctagtctgattcatcattttgtttgtctgaagtttca

SEQ ID NO: 58718 - DNA, 2336 bp, Oryza sativa
gagggggttggcaaggcagcagagtctggtgaggctgcccatggctgcagctgtggctccagctgcaaatgcaatccctgcaactgctaaaggagatggtgatctgcatcagcatgctgatgatatgtacaagtaaataaagaagccatttgatgcaatggctcctgtgtgtgtgtgtgtgcgacagtgtgagtcagcttgtgttcttcatcctgatgtactaatgtggcctgtgaatattgtgaggtgtctcctgctttactctcttgtcagaatgtaattagaggctatatatcatggccttgtgattggagcacctgaagtttttacagacaacattatgtttgtgtaatataatatggtttacttgtgcatgtatatggcatgttctttcagttccatttactgatgcagtcaaccatattgtctcaccgttcctgcttataacccgaaaattgactaacggtgcacttaccaaaaagtagtatacaagtttaagtaggcaaaatgaatgacaagattatgcgcagaataaaatctgattgaacatttggactgtttgaaactcataaagataaagataaaaatggagaatgtaaaatgaggtagatattagcacatgattaattaaattttaattattacaaacttgacaaatagatatatttgatattttaaagcaacatatatataaaaagttttcgcacgaaacacaccgtttagtagtttgaaaaacgtgctaatgaaaatcaaggtaaaatcttaatcttcatgagaaaagagcactagtgtatacacgtcactgctctcatgctagaatagataaatttcagaggaattcaaagatttgaatttttttttttttggaaaagagaaaagagttgaaaatttaagcgatgttccaagtaaccataaatagccaatgaaagctgctgaggtaacctgaagcggctgagccggccggagctggagaagcagaggttcatgccggcgatgctccggcacggcgaggagcgccgccgccgtgaaaaactgaaagcccaatattagctgggcccaaacgtgatcccccacgaacatatcggcccacaacttattgagccgcgaacgggatgggccggaatgtgatgggccgcaaggtattgggccggtacggtcacctgaaacgtgttgggccgtgggccgtggccgtacctcccgccggagataagctgccgccggcgacggccaccgtggttaaccacgcactgcaacgtctcaacctttagtagtacaagaatcaagatgtgcaatagatttcccctttttttttcctcaaagaaaaggatgtgatgatacgccattgccagagccttcagatttctacatttttgtcacaatctccataggagatcccgtcgttcatagggattccaaggggaaaaaaaaaaggaagaaacaattatggttggattatctgtttgaaacatcctgaagtgttctaatccacctatcagattggaacacattagcattgtagtgtactacagttgcttcaccactcctacaaatagggaggccattcttgaggagcaaatgcacctctttcatcaacctcatttttcctcttgcgtacaagttcttgagaggtgaagagtgaagagtcccaaggtagaagaagaagaagatgtcttgctgcggtggaagctgctcctgcggttcctgcggctgcgttggctgctgcgggtactaccgattactcatcgtctctgagggcctcacttatcagcttaaatttaaatttacaatcttaaattggctgattttaaggttttcctttcgaagtttatttttcagcctttgtttttaaatcactaagaacacgaatataaaagttttattcacaaattacttttcgtttataaatatgcacgaataagccaaacggatggggcaattctttggccttacatgcttgatcaaacttaatggtgaaaatttactggaagaaaagctacataaaagatgcaacaatagtactatgagttttcagttattggtctactgaaagctgaaaccttttctgctacttttgccccggacacagaatgatgtaccgtgacatgccagagaacaacaccaccagcaacccaggagcaatggtccttggtgtttcacctgacaaggggtataaatttcagattacaacaaaatatactacaaatatcaggtgcattcatgtgtaatttgaaactgatttgtgtttttcgcaggcgcgtcgaagtgtctgagaaggctgaagaatccggtgagaccgggcatggctgcggctgtggctctggctgcaagtgcaaccc

SEQ ID NO: 58719 - DNA, 2155 bp, Oryza sativa
cctaggtcacgcggctcacgccacagccgcaccgcacgggatgagtggatgacgggaggggaggggaatggatgtggggaggagagagactgagggatgtgctgctagggttaaggatttttttagtgggctgggctttttgggctttctttgatctatattttgaggtctatatgtactccccgggggcccgcgggtcacccgcgggtgaaatcagtcccccgtcccctccccgcccaaatgcggggccccgtccccgacgcacccgcgggtcgaaaatcggccccgcccccgcccccgtaggggcgggtccccgcaggggacccggccccgcgggggaaattgccatccctaattatgtctaattctgcccaacggtgatgtaggctaatgcatattattttaatgttaatttttgttctcaccgtacgtgattatttcaggtggctactccttgatgggttgcattaaagatattccgaccctgaaaggagataactacgcagaatggaaaagaaaactcgaccttgcttttatcttgggagaggtggactgggtgttgactaccccatgtcctatagaacctgctgaacttatcagaggtgaaaatgagtcagatgctgactggcaaaagagacagagggacaatgctcctctcgtcatgtcgtatgacattgaacaaaagaaatggtccttagccaacaagaaatgtttggctgtggtaaagaacacgattgagccaaccatattgggctcaatcccagagtgtgacgcagtctcagattaccttgaaagaataaagagtcagtttactggctcttcaaagacttatgctacacaactgatcaagcagcttgtgacagaaaggtaccatggaggtggtgttagagaccacatacttaggatgagcaacatggcttcaagttgaagccaatggatttgggcataacagatgactttatggtccatctggttatggcctcattgccaaagcagtttgacaattttattgtcaactacaatataagtccagagaaatggaaatttgaaaagctcattgctaattgtgtgcaagaggaggagagaatcaaagagtcaaatggtggttcaataaactatgttaaagataacaagaaaaagaaccacaagtctcccacctcaaaagctaaacagtctcagcatctgcttcagcaacaatagttcgctgttgagaaagatcagtgtctccacagcaagaagacaggacattacaagaaagactgtcctgacttcttgaaaatgatcatggcaaggaaaggtgagaacattattacatttgtaaatgaatctcattatgttggttactctagatccacatggtggattgattctggagcaactattcatgcttgtaattgtttaaaggcattccgttcgacaaggactacgcaaagaagagaaagctccattagagttgccaatggagttgaagaaaaagttgaagctgttggagatcttcctctagagattgcgaatggcttcacacttttacttcgagatgtcttttatgttccttctttgcaaagaaacttaataagtgtatcaaagttggattttgatggatatgattgccgctttggaagtggcaaatgtgaactatggtataataatgcatgtgttggtcttgctgtgttgcgagacaagctttatttgttatctctttctgagaatgtgaatgttgtgtcctcgttgacaaaagaaaacaagaaaaaaaagagaactcccgatgtctcatcgaaattatggcactgtcgtttgggccatattttgagggggtgaattgagagactagttaagaatgaaattcttcctccattggagttctcagacttagaacaatgcatagaatgcattaaaggaaaatttataaagagcatcaaaaatggtgcaaaacgaagcgcaggaattttagagatcattcatacaaatatttgtggtccatttcctgtgaaaagtgtggatggctatgactcgttcataacattcacagatgattactcccgctatggttatatttatacaattaaagagcgatcagaagcattggataaatttaagatattcaaagctgaagatgaaaatcagcatgatataaagattaaagtagtaagatctg

SEQ ID NO: 58720 - DNA, 9048 bp, Oryza sativa
  unsure (1)..(9048): unsure at all n locations
cgctagctcacctccgtgtgtgggggagtcctgtacaaagtatttaacccaaatattgggaagttggatccaaaacagtcagctgccattttattggctatcctgaaagatcaaagggctatcgttctactgtccaaatagttatacaaagtttgtagaaacgagacatgccgtcttcttggaaggcgaaatgattagggggagctcagtagttcgagaaattgatcttgaggagaggcgggtgtctgtacccgctccgtcgactcaggaacctttcttctctctacctgctgatggtgtgcctgcaatgcctgtcattgtggtaccagcacctgttgttacctctcctgtggcaacaataaatgaaaatgaggaacctgttatacaagattcaatagaaatggttgccacaccagaggaggagctgcaacagcctcaaacagataatgtgccagtacaggagactcaacaagagcctcaggtataggatgtgccaaatgtggaggcccctagaaggtctgaaagagtcagaagatcggctatccgtgatgactataaagtttataacatagaagagtcacatatggaggatgatcccacctcatatgaagaggccatgagaagcgctcgcttgtctgaatggttggaagccatgaaagatgaaatgaaatcaatgaaactaaacgatgtttgggatttagaagaaattcctaaaggagcgaaaatagtaggctgtaagtgggtctacaaaaccaaatatgactccagagggaatatagaaaagtttaaagcgtgacttgtggcaaaaggcttcacgcaacgagaggggattaattacaatgaaacattttctccagtctcttgtaaagattccttcaggattataatggcactagtggcacattatgatttggaattacatcagatggatgtaaaaacgacatttctaaatggagatttggaggaaaaagtatacatggcgcaaccgaaaggttttgtcatgaaaggaaacgaaaatatgggatgccgtctaaaagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagatctcggtgaagcttcatatgttttgggcatagagattcaccgagataaaacaaagtatgcattgggactttctcaaaagacatatagaaaaggtgttgaagaaattcaacatgaacagatgcagtgctacacctgctcctatagtcaaaggggaaaagtatggggcatcgcaatgtcccagaaatcaatatgagctcaatgaaatgaaaacaaagccatatgcgtcagctgtaggaagcctacagtacgcgtaagtgtgcacacgacctgacttggcatttgttatcaggttacttggcagatttcagagtaatccaggcccagagcactggaaattggtaaagaaagtcttgcgttatttgcaaggaataaaaggcctcatgctgtcttacagaagatcagaatcgctctagatagtggggtattcagattctgattttgcaaaagataatacaaagtcaacatcggggatatgtgttcaccctggcaggaggagctatttcatggaaaagctcaaaacagactatcactgtagggtctactatgtatgccgagtttatagcatgctatgaggcaacggggcaggtgaactggctaaagaagttcatacctagtttaaaggtggttgacagtattgagaaaccactaaagttatactgcgacaacgaacccgcagtaatgtacgctcacaacaatcagtcaagtggtgctgccaaacacattgacataaagtactatgttgtgaagacaaagtccgggatcaaacaatcagtctcgagcacattaaaacagaaggagctcgcggatccgctcacgaaaggcctaccacccaacgtgttcaaggaacatgtagccggcatgggtttaagggaagccttatgaatcctggactacagggcccaaaagtaaaagtatctgtttctgaatagagatgtgtatagtggctgtcgaatccatcggtgattgagcgtgacgatgaaacatgctatatgtgcaaatctgtgatggaatagaaaaaggctaaaagaaatagtgagatcaagggggagaatgttagatggatctccctccccttgagtcgggccttgacccgcgccctgatcgggggcgtccagcccaatggctggtgggcccccgtcacactgcgccatataaaagggggtggaggccggggcggnncacngtncgaggttcgctgccgccgccaactccaccccacaaaccctaatccgattgagagggggtgcagccagtgacgggaaacgccacctccgtgccacgcctcatcgccgggacatctacgaccgtcattgccacagccgtcatcgccgtcgtcgttgttctctctcacacacttcacgcgggtggagggtaaccaaaacatcaaacatcaaaccctctcccgttttcaatctttatagttcaaacatcaaaccaatagatccacccaactagatctaacctaggtaatcctagagcaaagcctaacatgtgtgtgttctgaatttctgatcacctgatcagaaacctgaggattccaagccacaagtatccttgtgtgtcaaatgttgtgtggaatcaataaaatcaagtttgctgtgcatgtgcccaagaattcaggttgtccaagaaacttcaggttctatatttcaatttgcacatgaattttcaaatcaaattcgtacaagaaaaggtgttatcttagtatgaaaatcgagttttacttttacccattcaaattaaatttgcacaaggacggacacggatctagatctacttaggcgtggtacaaatttgactttttggaaacttaattaaattcagcttgttttatgccagcaatttgaatccaacacgtacacgaaaagtgatcaatttcaaattgcacaataatgcaactatcttaaacaaaaaggtcagcatcatagtattgaagcaagatggaaacagctaagaatttcctcaaattcaatgcatctatcggtaagaaaatttgaattcaattcaatacaaattgccttcccgacctgcttagatcatcctgacatgatcatgcttgacatattgtgcaagctataaatagagggacatatgtgctctgctaggcaattgcactaaactcacctcaagctttctcaacacttcattgcacacaatttcctgaagagttaaacaagagacctaaaaaatcaagatgtcgtgcggtggaagttgcaactgcggtttaagctgcggctgcgggtacttttttcatatgctgatttatcaaaataaactgaaataagctttcagaaatagcagttacttcgttttgttgatttttttttcgctcaaaaagtttggttgattttaacgtactttccatgataaaaaaaacatgctatttccattgcttcaaagttcaaagtttgttcagataaagttacatgtaagatgagaagagattatcactaattcattatcagttactttacattcattttatgtcctgctttttttcttggttcagaaagatgtaccctgatctggcagagaagaacaccaccatcaccacctcagataccatgatcctcggtgttgcacctgaaaaggggtatagccatctagcttatatttcatcttaaagaaactgaactgaagaatctcattagtaccagctgagcttcagatttgaatcagaccacaacattctttctatgcctgaatttgtctgcttctttcttacgcaggcgcggcgaagcggtgttcgaggctgctgccggctccggtgaggccgaccatggctgcagctgcggctccagctgcaagtgcaacccctgcaactgctaagatcaagggattagtgaccgtagcatgcaccagcatgcctatctgtgatgaacaaataaataaaataggccatccagtgtgatgggttcaatcactgtatgtttggctgtgtgaattactggtcatcatcttgccagtgtgccctgtgtaatgttgttcagtgaaatataagatggcttgtttatgaattttcctctctcattatctcttgtttttaccattctatggtagaaattacagattcccattgcttggtcagatggctgctttacctgatcttagcctgttattatattagtgtggtctatgtgtatttctaaattctgttcatttgacctgaaattttcacgctaccatcaggaagcctaccggagggactgaaattccgaaatatcagaaatttcaaatgaatagcattgaaaattactaaatttgattttgtttgctaaattaaaaaaaatccgtccggaagaacctcctacaggcacccacgggtaataacgaaatttcagaaaattagatctgaaattgtaaaccctgatacgatgctgtgagatatcgatcccaacaacttcaaattcagtgaggtatatgtatttgtggtttgattaaaggcacgtatttcaaattcagttgatacatgaacatgttcagagcaggtttgatttggtcataaaatcatcaaactcaaatgcagtctaggtcatgcaataaatttaaattgaattcgtacagcaagttaatcaaatttgatgtgtacaagatatgtttaagtacgtgtctggtgtagctagctagcgccgtggatttgaaggaacgatgatttggtcagtagcttgagggatctgaattcttggcgtatgataaacttgagttcaaaaaatacaagacacatcagttttatatttcaattcgtgtaaaccattgaattcaattcatgcaagggaactgaatttgcatatttcaattcatactcttagctcatttaaattgacatttgcacgatgatgagtgtgccttttgggggtggaactggtataagtttgacttttggggaacttaatcaaatccagcgtggttcaagcaagaaatttgaattcaactcatacaagaaacgtattcaatttcaagctgtgcaataatgcatctatcttaagcaaagggtctgcatcatagtactgatgcatgattgaaacagctaagaacttgatcaaattcaacggtttttcgtgatgaaagtttaaatccagttcatacaagaaacttattcagattgtttgatttaaatatgagcaacaaggcgtcgaccttaagcaaaggttgacatcatggtgtgaaagcaaatttgaacctggccaaaacttggatcacatttgtccagaaacttggttcagattaacagtaattaaaataatgcaacctttgcacgtaagcaactactccctccgttccataaaaaaccaatctagtaccagatgtgacacatcctagtattatgaatctggacatacatatgtccagattcatcgtactagattatgtcacatctagtattagattcgttttttatgggacggagggcgtatataaaaatcgtcaatatttttatattttagggcacttatcaatactatcttcaactaagaatgacgcaattgcaccccaaacaaatatgcttttttaaaactccgggaaatgcatatagaaaactgacgtcaatgaatgataatgatttttcaaggccatttcaaccagctacatctttctggcatgataatgcttgaaataattgtgcagcttattctcaagcgtactactactataaataggggggcatatctgaactgagttcatatcaagctttcaatctctcatttcatccaactatacaagttcaagagtttacaagagacccagacgatcaagatgtcgtgcggtggaagttgcaactgcggttcctgcggatgcggcggtggctgcgggtacgttcgatcttcagctattgattctgaatatgtttgctatgtatttgtcaacataaactgtcataagctttgatgattttgatgtactttccatcatagaagaatactatgttagccccaatagttctgcttacaattgatttgaagttatatcagttgaagccatccataagacaaaaaaaaagttgtcatttctagttactgaattttgcgttctgttttttgttttcttggttcagaaagatgtaccctgacctggtgagaagatcaccaccaccaccactactgcaaccactgtcctaggtgttgcacctgagaaggggtatgatatctctgaatcttttcactgataaaaaacttcactgaagtaaaaaaaatcctacctgagattcagacatgaacaatatgctgtgatctacatctttccatgcctgaaactgttcgtttctgaatttgccttgttgatttgcaggcactctgagggggttggcaaggcagctgaatctggcgaggctgcccatggctgcagctgtggctccagctgcaggtgcaacccctgcaactgctaaggccaaggcgatctatgactgaattgccaatgcaccagcctgtctacatgatgaataaataaagagtccatccagtgtgatggctcatgcctgtgtgagtgtgactgaatccatcagtgtgtgtgtgtgtttgtgtcaaccatgtgtgaatcaggtgtcaaaaatcgtggctggaaatccatgtggtttctagctttatgtaaatgttgtttgtgaaatataaatattgttttgtgtatgtgaattttactctctcatttttctcttgcactcaccattctattatagtaatttttttaagactgtccatatatttgtcgataaatgtttgtttgatgtaaatataatacagtctgtttattccattatctaaaaaagaaaataatacagtcatattgtaattatattgtaactagcatgtaactataatataatttatatgcaacttttaaaaatcccacaattatatacagtaatacactattccacgaagtggaggtcatatgaccaaatcgcttcagctatatgcatgccatgatcttttttcttcctcgctcgcacaaatcatgaagcaaatcaaacgatttaatatcatacgaaagttacaaccaagttacattgtagttaaatgtaagctacaattatactacatttacatttgacaaaatttttagaagaaaatttgtcaacaaatatatactagaatcgttttttttatctgcaagaattcattcgagttgtacacaaacttgtgggattccatcccaaatgggcctcacacttctcatactgggcttaatttcgaagcccatgtggcccggcccaattaaaacaagcccattacatcaataaaaagaaaataaaaaggaatttcccgaggttttagatctcgcttcctctcctctcttcctccaaaaccctagccttcctcctcctctcccggcggcggcggcggcgatggacaagagcatgctcggcgacctcgacggtctcccggaggaggacaagatgcgcatggcggccatggtcgaccagctccagatccgcgataggtccacccgcgccccctcactacatgttaattaacgaatgaattctttcgattgcggctgctctgcttgcatgtgggattcgttcggcggtgcctccttagtttttttttgcggcctcgatggatgggagtgatcgggatggccgatttgcggctactttcttgtgcgcgcgattatactatacggtgcgaggtgaggtttgtgttgtgcgtgcggaaaattctgacagatttgtgtgatcttggtgaacttacacactccaaatccacggggatttagttttaggattctacaatttttcagctgtgcggttagagattgattgtagtgaggattatgtatgttggttattactgtagtgcggctgaaagatgcatccttgtgtgttcggtcccagttttcttgcttgggtttggtatttgcccgtctgattgtagtatcagctaaggatgcttttcatttacttgcatatttctcaaattagccatggtgatcataatctctaataggaaagtatggagtattatatactgatgcctagttgctgttgtgaccaagtgtattctgcgagtagaagcactttattttgggctggtttggcagtattcatttgatggctagttctacacctatgtctcttctgatagctaagttctgttcatggtctgtatgctgtggccagaaatgtaaatgtagatgttatttttcaatgttttgttgttgttgcagagcttgcgaaatctatgttgaagtctattgatgggatggttccattaagttcatgtacatgataactaaccacataggttggaacttggaatattgtctttttagctggtttgtcaccatgcatgacataggcaaaaccaatggagtcaataaacaggatggttctgaagatagagtacaataaaatagctcagtaaaacaatcttctttagtatgtttcatgtgttctttgatgctttttcaatcagctacctcatcactgtgcaatcttaccgttgctttctcccgtgttcatgaaagttatgtcattcattcaatcattcttgatgtgtaaattctgatcaactctttgatttgcctttcacttgtcaaattacaactgaaagatgctgacttttttgggttgtcaacgcacagtttgagaatgtacaactccctcgtggaacgatgcttcacagactgcgtggacactttccgccggaagaccctcgacaagcaagaggaatcctgcgtccgccgctgcgctgagaagttcctgaagcactccatgagggttggcatgagatttgctgagcttaaccagggtgttgccacacctgactaatcaattggg

SEQ ID NO: 58721 - DNA, 28347 bp, Oryza sativa
  unsure (1)..(28347): unsure at all n locations
tgtctgaactttctgtacttcggattactgatttggttcttgatctgttcttttttcctctgccttttggatggacaggttgtcattcttgatgcttggatctgtgtttccaaagcatcaatggccctcactgctggactccagcttttgtttagatgagctgtgtatttcttttttttcgccgagctggcaaaacttgccggccaaagtatattaagaaagaaagcgagaatgtacattatttcctaacgccccaggaacagaactccaggagcagaaaagcagagaaaaagctactaaaacccctccttaaacagggccgccccaaccacagatcactctattggaatcaaccccgcagctgtccaggtctcccattcatccatgatggtcacacaaatgttgccctggaatcgacagcaagaatgacagacttcgagttttcaaccttgcaaatcacataattcacattggtaaagcaattatttatagtgaccgtagaattagaatctcatggctgtaaagtacagctcaacttgaagcaattagagagttcagttcagttcggttcaattcaacatggatgctctccccacctaaagcatctctgttggaagattcaattcataatgcacaatcagctgagcacttctgagccatgattgcacataaatttgcaaaaatttgtgtcttgagccatggcttcccacataatacaaaatactacctccgtccagagggagtaaatcagattcaagaacagagctctgacaaaattatacagctcaaatacacaagtcatcacagcatgaaaactaaacaaaaaggagtcaaaatttaaaaaaaaatgcaaagatcagtttccagttttctacctgaaaacttctaaatttatcagcttattacaagctagtataattacttgacatctgctcatgccaatgcagcaattgacaaggcataatcaaaggaatttgctcaacatctcaaccaaaaaactcacatcaagaaatcaatcaattaattaattattacacaccaaaagaaaaagaaaaagaaaaataaaagctctattcacagttcgtcacaaaagcagccgaaatgcatcaatgcattaatgcacgacgcccaccggcgccgccgccgcggcgtcggcggcggcggcgacgtcgatgctcctctgccccggcagcgcgagcatggcggtgtggtccaggaagtccttgagcttggcgacggcctcgacgacggccctgagctcgtcggcgcgggcgaagccgcgggcgccggcggtgcgcgcggcgtaaacgtagaaggtgacgcagcccttgcggaacttgaacctcgccatctccggcgcgccgggcgccgcgcggatgaagcgcctcccggcgtcgccgagcgggacgacctgcggccacgcggcgtcggcggcggccttcatggcggcggactcgaagacgaacaccgcggccttggagttccttgtgccgaggcccancgtgagggtgtgccacgcgtggtgcgccaggatggcgaagttggtcgggatgtacgccgtcgtcgtcggcgcgaacgccagcggcgcctcccgctgcctctcgtcggcgacgcggaggaggtgcgggagctcgagcggcgcggcgcggcgcacggtgagcgcgcgggtgaccagctggcgccgaaccggagccccttcacgtcgccgcacggcctgaacagcgcgtccagcgacgtcgccggcgccgccgccgcggcgttgttcgccttggccttgccgcctttcgacttcttggacgccgccgccgcgtcatggccatggccgccgctctttgacttggacttgctcttcgccgccttatgctccgccattgtcaacgctcgccaagctctagcttcttgctcttcgaagccacgcacacacactgacacaacagagagagagagagagagaggtttaagctgatggaaggagagaggaatcagaggaagaagaagaggcttcagaggagggagcttgaagaaggtgagggtgggtcactggtcagaggagttaaaagagagcaaaaaagaattaaattaatattttttttcttcttctccttttcttttatttatgtgatgtgaggtgacatatgatttatgatattctctttatccacatcttctttttgttataatgtctgccttttatagggaatcacatttgagtgtgcactgaaaaagtattgctgacaagagatttttcttcaaactttttggttttctgaagaatctgaacttgttctgtctgcatatcatatatatcctgcatcacacttaactaataaacttgtttttctgtctgagtgtatcctgcatcaaactaatgaacttgtctatttgctttggttttaaagttatcagcagttctagtttagcacagttcctaccctacctgatcaacctaattatcaaatccatgacattgcaactggaatgtatcatatcagagattacacctaagctgttgctgcagtctctgtctctttccttttgtttatcaccctgactcctgtccatctccatcaacattaacattacattagcatcaccaaactaaatcaatcagcatgtcctgcaactgcaactctgaactgaaaaaaaaaaaaaacctgcatggcctgaactgaacatacaaattcagttactgtacccagatctgggggtatgtagattgcagattcccagtatcaggacacacacaaaaaaaaagcacatttttttcttggttccttggaagaacaagtataatactaataaagattaacttcatgagtagtataggataccaatggctgcattgcgtcgagttcatcagttcggtttcatgtgcggcaagacctgtgtccatgtgctgctgcttgcctgtaaccatgactgcatgtgagctcccatgatagcttactactaactacaggtaggatggtcacagggtctcttattaggaacagttaattaactttgccataactaaatgtgatctcgtaatttgactgtcagtggaacagttaactttgccatgattttatcagtggttctcttttagaatgcaagaagaggacctgtcggattttttctttaaaagctttgcgtgtcaatatattaaccaaaacctgagaacaaattcaactataaacagcaacctgtgaaaagcaattgttcgttttaaaaggagattttcttaaaattgagagtgtaggttcagccgagaagagttggacaattcccttttctttctttttttcctttttctttgagatgaacaagaatagtgtaattattaagttggacatcttttctgtccgtataggaaggctaagaagcacctaattctgtcagaagcccaggaaagtatcaataaaggccggcccactgatggaaagcccactcagctccaagtattaacaaagttgatttgcctgacgtgtgaattgttcactttccttttactaggacttttgatttttgaactgaacaattgagaccaaattaattaaggtgcaatgaggagtaacctttaactgaagatacagggaactgcaactgtactgcaagtacgttatgttgccccaaatataaggtattcctagctgtatgtatatgtatgaagtactcgttaattaactccaagcaatttaatgtttgatgtagcttttagacctaaaattctactgccataatgccctaactatatggtatgtgcccattattcctactttcctaatgtaccaactatcgaactgtatgttgttcttggcttgaagacatctacgtcccacccgtttttaacatataattgagttgacttttaagcatatgtttcgtttggaatttgtcttattttgtaaaaatacgttattatcatatgttttagatttttttatcaataaaggtattcggtctgaattatattttttatatttgcacaaaataatacctatgaataacaaaaatggttaaatgtgtatttaaattcaacgacgtcatgcattaaaaatcaaaatcgaaaagagtatatattgtcatctttggcacaaattgaggtgtattcctccagccatgaaacaatgatgctttggatctattttttttaaagtctttaagatacaacttaatttgataattcaattgagacatgcacaaactataaataaaatacttaacattatgaaatattttgttataataaacgtgcatgagattatgtcatttttatgactagaacctttgtcccaaatattaattatagttaaaattagcgttcgtagtatactatttagttttcttattttaattaattattaagagaacattaagtgttttctgagaataattcaaaccaacgatcgatcgatcgatcaaattaaattaacctcggtgattgaaattaatttctcccgatttcaatcttgattgctctaaggcactgtttggatcaaggactaaaactttagtccctgttatatcggatgtttggacactaattaaaaatattaaacgtagactaatgacaaaacccattccatataactctggactaattcgcgagacaaatctattgagcctaattaatccatgattaacatatgtacgctacagttaacatgtgctaattatggatgtaatgctaattaattaggcttaaaaatttgtctcgcgaattagctctcattaatgcaattagttttgtaattagtctatgtttaatactccaaattagcgtccaaacatccgatgtgacagggactaaactttagtccatggatccaaacacaacctaagtagcattaacatataattctgcaacaacttagtacaatatatctatcaacggttttctcagccatgcattgattcataattaatctaagccctagaaatatatggaatcctgagctagccatgagcactgtgcacgcacaacactagcaagaactagctagctagccagcagctacacgatgcgccaccaccgccttgctgtcccggccgccgccgtcctcctcctcttcctcatccacgtcgtcctcgtcgccggcgacgacggatacgcgggtgcaggaggcggcgtcgtccacgccgccgtgctgccgctgccgccgcggcagctgctgcaggaggtggcggcgccggacgatcagctcctcctccggccggcggtggtgggcggcagcctcgccaccaagccgccgccgccgcgcggcgccacggggtcgctcatccccgaccggccggcgtgcccgcgcggctgcgccgcccgtgggcgtggggcggacgcctacacccggccgtgcacgtatgccaacgggtgcatgaaggggcggcggccgtgatatggtatcgcgatgcggcggcgccgcccgccgccgccggccggccgggcgccgcacgcacgcacgcatgagatgacgagatcgaccaaacaaattaatcgaataatcgtgcaaattaagctgtagctgtacaactacgtactccatgttaaagcgtgatttgatcatcagtcgactgttatatatatatatatatatatacacacacacgcgtgtgtgtgtgtttcactgtgcttcgatcgggttaattctcacttctcactgcactttgatctctcgatgcctctcgatctaccatatatatgcatgcttttttttcccctaagaaatactcactccttccctaaatgtttgacgccgttgacttttctaaacatgtttgaccgttcatcttattcaaaaacttttgtgaaatatgtaaaattatatgtatacataaaagtatatttaacaatgaatcaaatgataggtaaataattaataattacttaaaatttttgaataagacgaacggtaaaacatgtttaaaaaaatcaacggcgtcagacatttaggaatggagggagtagtacagtgcaaaagttgacgctcacaacacttcgtatacttacccttataaacacacgtgcgtacaccttattcttatgagcacttatatccgagagattttgaaattgattaaattaccacgaccgcttatgctttgcttggcgttgtgtataataagctgaatgtgacttgggggaaattacccatttaatcccccttgagggacaacgacgatcttgtcgcttcttcaaataccatacaataattatgaaaagaaaatactcaaaacatctcataatattcatatactccctccgtcccaaaatgtttgaccgttcgttttattcaaaaaaatttaagtattttttaattcttttcctatcatttgattcattgttaaatatatttttatgtatacatatagttttatgtatttcgtaaaattttttgaataagacgaacggtcaaacatgtttaaaaaagtcaacgctgtcaaacattttgagacggagggagtagctggtgaccaaatagccgagcaaggtagccgctccatcatcttcctctcactttgccaccacacaccccgagccccctccaccactaattccttcttgccacatgtggtcgctgatatgttggtctcacttatcgcatcatctaaaattggacactatatatactatcctaagaccttaagtatattggttttgtaggttgagtgacgcgctatttctggtattgcgtatgaagggcgtaaattcaaactcggcgtcgagatgtgggccgagccgcacagttttgtgggccttgcgctaactaaattgtctgtgggctgctgggcctcttcttcgtgttgactgtgatccgagtatctgacgtgtgtccgttgcatgtgtcgtatgtgtacgtatggtgccacctggtgtagtagcggcgtttcggtgttttgcatcgtaactccatcgatcgtcgtgttgtggttgatcgatggcgatgagggatgaatcacgtcttcacgtgatcgttgtacgtatctgctggatatgtactacttttatattttaatatatgacaccgttaattttttattaacgttagactatttgtcttcttaaaaaaattatataactatcatttattttattatgacttgacttatcatcaaataatctttaagcatgatataaatatttttatatttacgtgaaaattttgaataaaaaaattatcaaatattatttaaaaattcaggcgtcatatatttagcgagtatattattcaattgcatgtctatatagataactcaatatatagttactacgtgtatagttctccgagttatatgtgtgatgatgacgacgacaacgatgcagtacggtgtattgccgctcttcgtcctcgtcgccggcgtactcattgtcgccgccggcgccgggacagctacggacgacgctgctggccgccgccactgccgcgtggtcggcgtcgacgacgacgtcgacgtggctgcggcgctgatggatcacgatcatcatccccagcggcggcggcggctggaggatgaggtggtggtggaaacggagctcccggtggtcgacggcggcggcggcggcctcgccgtccgagcaaggcgacactacggcggcggcggcggcttctcctacggctgcctcagccgggcgaggccggcgtgcccgcgcgccggcgggtgcgccgccagagggcggccctacacacggccgtgcacgtacggcaaccgctgcggccaccgccggccgtgatcgatcgatccggccgccgccgtatacgcgacacatcggtgatgatgacggtaaaccggcggtggtgcaaattaacgtatgtacttgcatttgctaatgcagtaattaattaatctactcctgttgtttaaagggcgtagtactagatctctctcccgtctaagaataaaaatcacgagttaatcttttttacggaggagggtgaaggtttaatattcagtgtggctctgcgagttctctgatcatttatgtgttaattcggtgttaattagaattgatggctaaatctatatggtttaagaccagttggtaataaagaggagttaaaggggtttgtcatattacctatcatctttttttatatgtcgaataaatttatgaatgtgtatcttagatagaaatcggagatgtaaaccatttctgagaatcaagggaactgtataattaaagcaaacattattattcgtacccactttatgcgtgatgcactgggagcaatgttctaaatctctggagagagtggatggggaggagaatagctaggatataccaattttgacgctacgatttatcggccgctaatagctacacttagctggagatagccgctataatagccgaagatagctgcacttagcggcagaaaaactgaaaaatagactcgcaaagttcagcctaaaaggccacaagcccagcccaaaactaaaccataaatcccccactccccatccatactcgtgttctcttctcccctagtccccgactcgcttccccagagtagcggtggcagtctttttggttgcgagatataaaagttgaatttaaacttgtatatttgtagagcgatatatcacatgttaatacatcttctcaatttttttaaatctttttcataactatttgagtgacatgtaaataacgaggggatatccccttgagggatcagaatagtttccgcactcactagcttttagccctaatatgctactgcactcaaggaccaaactacattcgtggcctgatggtcactaccaaagctctcctgtgtaccagtgggtggatccaaaaggcttaagatcaagcttgttaaagggagcatgtataagataatttacaatagagattctagcatgtattactattgaaagtatatgcacaattttttctagaacttatagtgacatttatttgttggtgtgtatggagtgtgcacgtgaaacttatgtgcacagcctatgttctcttctgaagataccctatggaaaaactgaagatatatgtatgagatcgtcggcctctaagaattaagataactaggtcagcttgacaacgatgacttgtgaggagtcacaatagctatgtcaatgcagtcttttttattcgctcttcgtatgggtttttatcggtttttagatgtaagatttttttatccaatttttcaagcccaagggactattcaactccctttttttttcttcttaatataaagtagaaaattccctccctcttgtggttttggaaaaaaagaagaagaagaagattgaggtaactatcgggtagccatgaatttgaagcaactatatgagtggttgatatttgtggcttagttttagcactaaagtgccatatgtgttaatgtactatagccctcaataaaatgggaggccattcctggtctcctatatatgtactagtagtagttgtgtccaaagcagcttgagagagagctttgttaataatggaagcgtgcgtatagcccatatataacagtggctagcttgtatgcgccaggcttgtatcatgcataagtcatccaaacagtaatccattcgtaacagggtagattaaactgtactccctccgtactcgtaaaagaagtcgtttaggacaatgtttaagtcaaaccttgggaatataaatcatgaatagctctcaagttgttgagtttgaaaatgtaaaaattatatgaatagatttgtcttgaaaaatactttcataaaagtatacatatatcacttttcaataaatatttttatataaataagaagtcaaagttgtgttttggagaccgtgtcgctgtcctaaataacttcctttatgagtacgaagggagtattgagtagacccggttctgtttaattaattaattaaaacctttgtgcaattttcagagtttcagtcttgctgtcgttcccctatctggagtccaagtaattgtaagtttgtaaccagtaaaaaattaatgttgcattttcttctaaaagagagcaggatttgtagaactggggttcggtaattttaatttaggtggaattgaaatatcaccaaaattggtgcaatcgtgggtaccacatgaccatattcaaggtgccaatcttatagttttcgtagaggctagtggctccggtagttcaagtgtagtaggacttgggatataatcatcatcgccacgaaatatttatcgtgcgctggcactgatgatcatgatcgattagcaccactgtacgttccagttgatcaaaacatatgctgatgcattgcttatactccctccgtccctaaacagaggcatgtacagattcgttgtactaggatgtatcatatcccatcaaaatcccttacatttaaggacggagagagtattaagcaaacacggtcacttgcaacggcgacataaagctaggataaagttttaaatttagcacgtgtgctcatatatatttagttaatacttcatccgtcttaaaacattgttacgtaccaaatccccgatgaaactctctgcctagactcgttggactagaaagtgtttcattggggactaagtgcacgtatagttgacgacgagatatatgtagtggctttgtcaatctaaatatatattggtccagttttcgaaggtgctcaacgtgtacgtgtgcatgtgttcattgtagcagtgcgtgcacgtgtataattaatatatgagcatatacgtctgtactgtgactgtgtttcatgaaaaaaaactgacaatatataacttcataaacttactcattaattagtagcactaactaattaccctattcgtttcaggttacaagacgttttgatttttgattttgatcaaggtcaaactatttcaaatttaatcaagttgtaaaaataataataatatttttaactcaacataaatttattatgaaaatatattcgattattgatttaataaaactaatttagtattataaatattattatatttgtgtttgtgtataaacttaattaaatttaaagtagtttgacctatgaccaaatcaaaacatctttgtaacctcaaacggagggagtaacattatgtgtgcgtatatatataagcacgcgcccaaagtgcccggagagaaactggatcgagcgccgccaggacgacgacgataatgctcgggagcgaccggcgaccggccggcctcgtggcgcagctgctcctcatcaccctcgccgcccttctcatcctcctcctcaccaccgtggccgcggcggcgccggcggccggcggcgggtacagcgccagggtggtcatcgtcgccgggaagaagagcagcggcagcggcgccaccgccaccgctcaccgccgcgtcgtcgtcgacgatctcgccggcatgatggcggcggcgctggggcggcaacgcctggaggacgtggtggcgccggaggaggagctcctcatcccgggcggtctcgtggttggtgcgggcggcggcgggggcggctacggcgccttggaggcgaaccagccggcgtgcccccgcggcggctgcgccggcaagcagccaggaggggcgtacacccggccgtgcacgtacggcaacacctgcttccggccaagctaagccatggctgcatttgcaaaagataattagcagctgcaagcacacatatctgcctggtgcctgctagctcgatttgtgataattgcatgcatgtattaattaattatttactccacatgcctgtattattatgtactccctctatttcaggtaataggccgtttttattttgatcaaagtcatattattttaagtttaagtttgatcaattaattttatcgaaaaaatagtaacgtttttaacttaagacaaatttattatgaaaatatatttaattattgattgatattgtaaatattactaaattactgataaactttgtctaggcacgttcttgatccctaggccgccattctgtttagccaccaagcagcgcacaacacactgcaagtatcttcgtcataaccataggaaagctgagtttttcgagcgtttctattgttcctttctgtagcgggactgttctgcgtaggacagtattttgggaatcggactgcattggtcgacattcggcgaatttcgttcattttggtgcagcttcagacaagtctattgacctcccactttcacccaccatatatatactttttataaaagagaatagctagtgatggtggtggttttgctaccaacattactaccaattcccaacttttaaaataaataaataaatgatatttagggctagagagtccatatgtcaactactttcatcagtttttaatttttgtgggaaggaaaaaacagtgtgagctaaaaatgtccacatatgagtaacaaatatctacaacaattaagatatgataataacatggtaatgttaattttcttcacggacaatatgctagtttttcttaatgcttattagaaatttggctcaaaggtagccatttttccctgaaatttctgaattttgccaattttgatggggcctttttttttattactatttctttgtgtttgatcgatgcaccgggaaagtgtttcaatttctttgagaagatatccccttatttcttgcatgcatgtcatctaaatagtaataaatttttttaaaaaaatgataagatagattaatataaaatatatcactccacaaatatgtaagttcaaatttagcttctacaagttggaacaaaaataacaaatataattgtgaagttaatttgttcttttttctgtgaaagttgaatttagtcttgcatgtttgtgtaatgatataatttctattaatccatattattaaattgcatcaaactttttttataactatttagatgatactccctccgtacccgtaaaggaaatcgtttaggacaatgtttaaatcaaaccttgaaaatataaatcatgaataaccctcaattgaaaatataaaaattatatgaatagatttgtctttgaaaaatactttcataaaagtatacatatatcacttttcaataaatatttttataaaaataaggagtcaaaattatgttttgaagactgtgtcgctgttctaaacaacttactttacgagtacggagagagtatagcagaaatgagggatgtccatccagggatgaaaatccaattcccaatgcacccaaatggagtatactgctagttagtcacggactcacatgtctgttgttggcacttggagacattttgtaagacagcaacaacttaacctccaataattgttctactccaagcgttcacagctactaccaccataagctcgctcgcgcaattagtatatcgatcggccagaggaggaaaaaatatataaagcgcgggtgcacgatgcgccgccgcgtcgtcccggcggcggcggccgtttccgcccagctggcagccgccctcctcctcctcctcctcctccacgccgtcaccgtcgtcgtcgtcgccggcggcggcggcagcgaagtggccgtcgacaggtacgcggctgcaggcgcgatgctgctgcttccgcggcggcggcggcagcagctggaggacgaggtggtgttcccggcggcgatggcggtcgtcggagctgagcagctgcagcagggcgggtccttcagcgggctcacggcgaacaagcaagtctgcctgcagggtcactcgtgcgccgcgttcgccatgccctacaccggccatggctgcatctacagaaataattgcaagcagtaagctagcttgctatagagctatcgatcttatcatgtagtatactataatattgtttatatagttgtttaattactcattataattgattgttgtaattgaatctcaatgtaccatggactgtactagtactactacttgtcatatcacgctcgtaccatggagcatctttatggtaccgctaggtaccaaaacacatctaaccgttaagtctgggatgggtaggatcgggagagaaaagatgagaaagggttcaagtcattgttcctagcgacgatagagttgacgtccaggcggcggtagcgcaagggtccagattgaagtcgcggcgccggaggaggaacatggcggcgacgggagagggacacggcggcagctctccccttccactgaattatcccattcttcctctttctccacgcccccggctctccccttccacccgcacatggatcaggggcggcgtggcctatctaagctcgtcgttgttaccgcgccctccttcgttgtcgcgccaccaccatcgccattggctctccccttgcagttgtcccccccccccccccccacctcagcagatggagttgtagccaagagaatcagtggcctccctataaagtgcacccaacactgccgccctctccagcccggcctcaagcacccgcttacaccgtttgttgtcctcaggaaaatcaaggtcatatatcacaatatcacgtattgtttcgtgattgggtggtttgctcggttaatgcatttgatgcacgctcgaaattagagccgttgcttgacttgttttttatctttgttccgtaccattcccatgtatgtgtgccaggtgcgggagagccacgcaatcatagtgttttcttaagtagagttagattagattatatatgtgtatgcatgttaattaattagcaacagcaagttaggcatctcgatcgtctctatcatcttcatcgatcacactacaaatggccagctagccccacatatatatggagtaatgtgctatagctcgatctccttaattaagtatttaagtgtaataccccgtatattaaaagatatttagtttttttagtttgggttaacttgttaaaataaagatgttaacagaaataaataaaagaaaaatatctttagaagtgggccaacatgagaaggcccataaacccagcccattagttctccctaaaaccaagagagaggggaaccgactcccacctcccctcatagtgccgccacccctctccctggccggcgcctccttcctccccttctcctatgttcgcatctctcccctctacaacaaattgccctccctagatctccaccttcatagcttggatcaaaaagcgaaatagaaaaatggaacgaggaggaggagaggagtaaaaggagggattagatcagagtctcccctattgtctcctcacaagttctctaaagaaattataggtgaggtttttccccttgttatatcagttgttctagggtggttttagtggtttaatttgtggataaggaaggttagagaaggagttttgtttgttgtggttcgaattggctgttctgcatgttggcagatttacagtgtttcggttttttgaagtttcggagagctaaatgatattttctgcgaaagtgtataactagaaagttgtagataatatttatatctatcttctgaccgaagggcgcgattttatctcaagtggtttagacgatacgaatttttgagtataactgttgtttttatgccataatctggatagtagtagattgaactgtttttggatgggctaaacagtggaacagccaagactcctatagacaaagttgtagagatttttcttagctttccatattggtaaagtacactctgattgggcaagtagaactccagttatgattgttttagtgcggatagtctgaattttctggacagattgtgaagcctgctttcaagcgcaaattagaccattttaatggcataataaaaatataatttccacataagagttgtaggcattgttctgtagatttccaaaatatatttatttgcggtcatagccttttcatatttcaagatataaaggtttgaagcaacaatattgtttatagtgcaagcggcgttccttgttattgcgttttgataggatggggcagtaggttcacctttttcattgttttatatgcatgtttgaatgtgtttgctgaggttttatttgtgattaggtggtggtccttcagatcgtgtatgataccaacccttcattgaaggcaagtgcatgacgaactaagtgtgtgattgatggattgtttgctctatctatttatttccgatatatttctatgtgacatgtgaccgcttatattcatattgttattcgcgccatttaggttttcatgtttatcctatgtttacgatgttattcttgtttcaatattccggattctggttctgggtaaataattcaagttccctgtttgccatgaatgtgcaatatggtttcaatttggttctttgattccggtttcaattattcaagtaccatgcgtagtcatgggagtgcaatttggttctttattcaagttcctgtgggtaagcgttgatcacgcttactcggctttgccggcaaatgctaggatgtattcactattgtccgggatggaaactactattttaattcatgcctgcccgggatgggaactactatcttctttgacttggtgtttgaaaatgtgtttcctattaaagaaagaaagccttctgtttacgctttattgtcaataatgtgtatatgtgttttctagctccatattgtacttgttgagtatttttatactcactattgtgttttaattggttttaggtacatattgagaccgacatgcatgggcgggaagtagcacccttatatacacatttatctgtatactatcaaactatattgcttaggtccataatgatacttaaactatatcatggttcggtcttgtaataatcttttagatttttaatagtttcttccccatggattataaggatggatcgtattgtgggaatgatattgttattagtttaacttataattgcctgtcgtggatgtccatatttacaggggagactctgccaaaatttctaataattttgggagttagcggtttgagtgtatgtttggtgtggcactctaggtacgtggttacctggggtgttacattaagtcaagcaggttttcgcccggaacagtgagtccgattcaaccgcttggtataggatggtttcgccctcaatgaacaaacgtggtggagcgattggatacggatcgagtgtaggacaacgtacaagaatttctacaggaatacttgcgtatttttttaagtagactagaaaagatgtttgtgcgttgtaaggggtagggccaatttaatttatacatatatgtcagtagataaataatcatagctcattattttatttattcatgtgcttatccgaataagttattatcaaataaaagactatttatgtgcaaatcttttatatacatattcttagcgactcaaaagcaaatgctttaaaataaagtacaataagaaaaccaaaaattcaaattcaaaattaagttctaaaatttaaactttggcttataggaataagcataagccaaataacgagacttcaaacacgagctcgaattgtcgtccagctttacttcaaatcgggcaagaaatgatgatggacggaatcagcagcttcgatcatcctttatttcagttggcatattctttttgaaagtaaaattgattcttatggattatttgtaacggtatcctgataatatgtacgagcatgtgtggagactaacttgaaatcatgctaacatgtctaaggaatcgtgccatgtaatacgaatagaatcggatgatctatgcaaaacgacgtacgtgatatccgcacgaactctgcaagtttcattcgcttgtgacggagcgtggggctcctcaccgggagaccgcgcaggcccccctttgccggttcggccgggggcgctgagtgagattcttcaccctcgatctatggaacgttcgcgagagagcaaatgcacaagacacgggcgatgtatacaggttcgggccgctgagaagcgtaataccctactcctgtgttctggtggatctgtgtgtgaaggagttacagagcaaatggagagcaagagagttcaagctctagaatccctctttttccttctcctctggttctttttctccctcgatctccccctcttccttctcctctagttctttttctctctcccccctctttttttctcttcttaggtgggcaaagtcctccttttatatctcaaggggataccacatgcactacttctatctactcttcttttgggtggggacccaccctatcttgaccaaatattcactcgcgcctccgcctggaagctaaatcaccgcttgtccttgagtgatgcccagcgccgtcactcgtcggacacaggggatcaccctgtcatttcttcattaatgggaggagatctgcaatggccgctgtctgaatgaccctccgatgggatgggtcatacctacctccactccgccggaagcagatgcaacgcgggagcacggttgtctgccgatgacgtgaccggcatcagcccagtcacagaccggtcattcttctccaccacgcgtcagtttagcatgccgcacatctgcccttcttcatacagtgacttccttgcaatggttgcgatgaagcctggcatgaatcgagccgggactgacgtgctaactccaggagttaccacgccggctccagctagggacgagtgccaagaggctctcatcatttcgacgggacggggcgaggcgtgtgacaggccgcctgctgccacctaacccgcgatctgaccggtctgtgaccggtcacacactgcgaccggtcacggaccggatatgcgtgcgccgtgctgcattaaatgcggcgtggcgcgcttgtccattccgcaataaatgtggtttggtgagcgccgctgtgcccacctaacccacacacgtggcgccaataccacagggggtcggggcgccccagccctaggggccgaaacaggagcggcccgacccctcggggagacagaggagggggtgggcacgtctccctcgggcccgaccccccgagggggtcaggccacgtgggtgaccgcggctgcccaagcctctagtcatgatactcccggtcccatgtcaccgacagcttggtatccacatcgtacggtctctgtttcacagtttgctcgtgggtgcgactttgcaatgaatgttacgcgtgacgggaatcggatacggattacgtaccatagttttgacaaaaaaaacattcaatttttgaatcgctggcgagggcgacgcagtcccactcggacatgtggcaaggcaaattacactcacgagggcatcgcaggcccaatcggacatgttgaaaatcacgagagcgagggtgttgcgggtccaatcacagcggcgcacaaaggcgcgtgtggaaaacagactctgtcgcgagcccaatcactgcgtacggcaaggagcgtgtgaaaagatgctggcccaattaatttgcgcgcgtcatagcggcgtaagaaaaaaaggaaatgatttgacagaaacataaaattaaaaccgattcaaacacggatgacgtaccaaaattccgatgaaaatattttcaattttcataatagtagagatacattttaataaaccgtaccaataaacacatttttttcgcgaaggcgcaaaaagattacacgtcaatatatatgttagaaaaagagaacaaaatttgattacacaacgcacactgtcaaaaggccattgccaggggtcaagaaaaaaaaacagataaaaaaagataagataaagaaaaaaaaaactcctatcgtaagggagggtggggtagggtaccactacactccggcctgcctccggagcgaaacgatggaaccatattcaggaagctcgatcagcccttccatcgctatttataggagtgatatcacacgcagcaaagtcgcggcaggacagcagcaaaccagaacggaagctagctagtagcaagcaacgacgacgggccatcgaaattgctcatcgccggccggcgcgcgtgatgcggcggcttgacctgccatcgccgccgccgcgcgctgtcgtgatccttgcggcggccctcgccgccgccgtcgccaccggcggcgtggaggctgcaggcaacatgtacgcgtcgtctgcacgcgcgaccaccacctcatcatcttggggatcatacgccggcggcgccatgcacggcgccgaaatggcgctggcggcggcggcggcggtggaggacgaggtggcgccggagttcttcccggtgggcctcgtcgtcggcgacgggcacggctcgtatttcgacgggctgaagagggatcagcctttctgcccgccggacaagacgtgcgccgccaacggcggcacgccctacacccccggctgccttacgatctaccaatgcaacaatgggcggggctagaacagaatagtggagggtgccacttacttaatttactttactttatattgagtttaagctgatacgggtgtctaatttagggcctgtttggcacagctccagctccagctccacccctcctggagctgaagctcagccaaacaatttcagttccaccaaaactaggagtggagttgggtggagctctcacaaaatgtactagagttgtggagctgggtttagacaactccacaactcaactcctggagttatatttaggagttggaactgtaccaaacaggccatttgtattaagagtggtgcacacataataaaaataaattaggtacagctaaaaaattttcttaaccgagttcctgggcaccccctaatatatactctacctccacccctcacaatggcggaggttgagcccaaattcaagaggaggccagatactatagtgaaaactagcaaacctcaacattttaagtgctcagttggaaatctcccctttctccaaaaccgatcgtgatactgctgaggcatgacgagacttgcatgtggatcaaataaaatctgaaagaaaagttggttatatagattgtaatgctatgaatatatacaaacgtgcaagtcagagggtgtcttaatttctgctaaaactcttaaaaaacacttatattttgaaaaaaaaataaaaggagcatacggtccctttgaagacaccctctgaaaatcctgcatgtgcgttgtgcaggtctgtgagaactaagcagccattggaagcaactctatatagttccctttttattgagagaactctataaactatatagggtgtgtttacttcacattaaaattagaagtttggttgaaattggaacgatgtgacggaaaagttgaaagtttgtatgtgtaggaaagttttgatgtgataaaaaagttggaagtttgaagaaaaattttgcaactaaacacaacgatagttgatatatgtatatctttagccctaaagtaaatgctatttgctagtgcactaaagccctaagcaaaatggctaattgatgacaaggctggccactcctgctagatggtccaaaggagcttgagatcgagcttgttaatggaagccatgaagtcgatcgtactgtagccactagcttgtatgcgccagtcctgtgtcatgcataagtcagccaagtgcagtaatccttaacagagtcttaattatactccctcattccctaaatgtttaacaccgttgacttttttaaatatgtttgaccgttcgtcttattcaaaaacttttatgaaatgtgtaaaactatacgtatacataaaagtatgtttaacaataaatcaaataataggaaaaaataataattacttaaattttttaaataagacgaacggtcaaacatttttaaaaagtcaatggcgttaaatattttgggatggagggagtagattggaagattaattaaactggatttggcagagggttcctgtttaacttcagtatttctttttttctagaccaagtcacactggaggggagtttaatttcagcagttcagcataagaccccatgcagttttcagagtttcagtttcgatcggtgtttgatgttgttccaatgttcttgtctggaatccaagtaataattgactatagctcgattaaggttcaaaaactaagtaaaatacattaagtggaaatcaatcaccaagattaatttggtccaatcgtttgttggtaccacacacattccatatgcacaaggggcatgccagtcttatattaacttttgtagaagctagacagctagtggctccggtagttcaagtgtagcactcgcaaatatgatcatcatcatcgccacaaaattatttatcgtgcgctgccactggtgatcagggcatgatcgaagcatggggcatggattttaaacgccccacgggatgtctctttgctctttacgtgttatttaaatagttataagaaaaattagtagtatagattaatatgtgatatatcactctataatcatacaagctaaaagtcgacttctacaatttacaataaaaagataaattaaattataactagttaacgtatatttgtagttaaatttgtttctttttgcaacttgtataatttaatttgatttttttatgtttgtagagttatctattatatagtattaatttatgttgttaattttttttgaaaaaatatataaccatttgaaaacaatccccaagaatagtttctcttgacgcatgcttatgcattgcttaggtaattaagcaagctgcaccggcaagaagcatggggaggcctacacccagtcgtgcgcgtacaggagcggcattgacgccaagctcatgcaggggcagagctataataaaatggaggggttccagtcgtttgctttactctcgtttaaatcaaatttagcttaatacgagtgaagtttaaactaacagggtatatatggtaaaaatagataaactatagttaatatttttttaaccaggttcctggacacccccagctatacatagctccgcccctgtgctcatgctcacttcacgtgtactcccttcgtaaaaaaaaatgtccaacctagattaagatgatataacctaatacaatgaatctgaacaaccatctgttcacattcattgtatatatcatatcttatttaagttaggttttttttgacagagggagtaagcacgtgccatcatacgtgtgccaatgtaataaatgagagtgatgttcatgtcaactctggtcaagtgtctaaattgttttagaaactagatgatgtcccgcgctttgctgcgggatatatgttatataatggagaaatgatgaaatgatttggattgaaatattatgaaaatgatttgcgaatggtgatttagcatgtgtatgtttagttttacaatgaaataaattgctgatatgattactatatgcttacatgttgagctttatgtatttaatagattgatgtggcatccttgcatgtaggttttaggaatgctaataaatactatgcttgcatgttgagctttatgtgcttagtggtcattagggcatgtacaacggtctttattagtagtctctctctattgccatacaagtaaatttgatgacatggaagaaagagaaatgagtatagttgttatgcatgacaacagctcagagtcgactcttagcatttattagagcaaattttattgcatggtggtgaaaggaaggaaagaagagtaagaaaaaatatttgaatacattaatgattagagaccatactgtctctaactgttgtaggatgctagtctttagataacgtagagcttatatctgactctaactttgtacatggccttagctttatagaaagaatagatgttatgatatttggtaaaatatcttgagttatctaaatttataatagaaatatttagatatctaatatttaaggtatgaaatgttgtattataacatacatggatcgtaaaattacctaaagtgatatccttagattgtctcaacttcatcctcgtgtattctcgggccctgttcaatcgtttcctttcaaggcatggtcgaatggttatattgctaggatactccaatacagtcggtagcatcgtgaaacaatatagatgttgttagttcgtccacaaatagaagtaccatatacaattttattatgcaagttccgtatacaccaactaacatggcggtttcactaaaactttgagagaatattttgcacgtactttcaatttcaataatattacatctatctataaagtataatttcaatttcattatattttagcaagataaaattctaatagatatgttactttttttatggctaaaacataacaaatatgaagttggtacttaatttatatgtgtatgcaatactattgaaaatacatgtatattgtttatataattttttatgatatatattatctggtgggtacatagtgtgtaaatttatgtgtatatacgatacattcccccacaaatataagcatttatatgagctttagcagagaataatgtttagcatttactagtaggggaaaatcccactcgaaatgtagcatttataataaaatgtaagaaacaatggcatatgatttgattctgttttgttttgtcagttgattttctctcaatgtatctatcttctttcacttccctcggatgcttggctattattttttatactctttggtgctttcatgtccacgagcctccctaatttcaccaccatcatctttaatttatatgccttatctcgcctcacctatcccccctgtatctggcagctcatgtgccacacgtctactagccactccgatgaatcgtctccgtctccaacatcgactcaacgcactcctctatccccatggcaatgttgggctatagtggcaccgctggtgcatagctgcccaccgcttgctagccactccgacgaatcacctctgtctccaacattgatccaacgcactcctccagccccatggtattggtgggttctggcggcaccgctagtgcatcgccatccactgctagtcgtcccttaaatccccaccccctccccgaaattcaatggctaatgtaattgactgatgttttttacaattaactgctgaacaacaaaggtaaaaatttaaacgctataaatcttatattgctggatgaagggagcaatatataataataaataaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaaggtccaatttgtaaaatttaagtttttatcttacatgtgtatggtggttattgaagttgaaattgattagtttttaaggagtatatggtccttgcaatttttggtcatgctcacatcttcacctagcaataagccctagcagccgttgcaagcaagtcggccactgccagcgttgagctcgacggcttaaacaagctgctagctactcgtattccctaaccctcagccagtcgccatcttcaagcaaccaccagccatcgttgtcaacaacattgaaatagcagttgcggcgcatggtcgcgcaagcctgccgtcgtcgctattttcatggcgtgcgcagcctctagtccaagtgctctagcgcaagtgcccaacctagtcatgtgtaaatgcagagaataatatggacaaattgatctttctctgtccctactcatggcgaaaaactttgattagacctgtagttgtgacggaaatacaacggataaaataaaaacaagtggaatatacttctgatcgaaggtgggaattttgtgtgctattttttggataccgacatgttttctatgttatagatcgaattttctcaataaaaatataatacaagaggaagggtaatggaccaagtattgagaaataatttttctaataacatgaaaactacccatacgacgtatgtatcctcgagctacagatacgctggtccttggaattttttttaaaaaagaaatccaaacatttcagtaaaattcatctaaaatttcttccaaacacatcactccggcgccccctgatttctccgttcgctcgcgccgccttccgccggagtaagctctccgccgccgtgaactcgccgttcttcccgccgccgtcctcctccgcttcctcctcccctacagtggactggcgtggggtggagatcccccctatccatcccgaccgactcctttcccccggtgaggaagccctagctcgctccgaatccgctctcccaatcctcttcttcgcggtgaggtaatccaaacccgaattgctctgcggtgaacaggaatccggcgccctcgctggcggcggcggcggcggagttggaggcgatggacatctacaatgtcgaggccgccgagatcctcgccaacgaggcccaggtgagctctcccccctccccccgattcgcctcgcttcgcgaccgagttcacttgagctgggttgcactgacgagctcaccacggtgttgcgcgcttgcgctccgctccgctccttccttgtctccagctgctcccaatcggcgaggccgctcccatctacgagaagctgctgtcaactttccccactgccgtgagtccagttcgatttcgactcgatgttttgcttgctttggggttgcatcgtatatctatatataggttcgtctggttcatctagtgatgccatttcacttggcttcacctgctatatgtgtatgtgcaggcgaagtactggaagcagtatgtcgaagcttacatgtccgcgaaggatgatgaggccaccaagcagatattcagcagatgcttgctcagttgcttcagattaatctctggtgagtggaggccatatttggagattgtacattaggcacacgttgtagtatgcatatgtgggatgtgttgaataaattgctttactgtcattatgtgaattatcattgttatcgctggttgtgtcactgaactatattcctaccgtgatatgtgtggtttgggattgaacttctgtgtcaaatcatgcatgtaaatcatcaaattcctaagcagtctctgctcatttaacctgatggtctcattagccactagttccctgttatgtgatctcatttgtgattgtctgccttgtttttgttgctcttagttttgcctattcccttggatctagtattagtatgttttcaagtgcatcattaacatttccctatttgtctgggtgtaatttgcaggcgttgttacatcaactttatcaggagagtgaacgataaaaggggttctgatggtttggaagagaccaaaaaggcttttgatttcatgctgaactatgttggtaagtaggcacttaattatatctagtgcctggtgatgatgtgacttcctaagtacatttttttaacataattttgctaaaaaaaatatggcgtcacatatttggcttgatttcagtcacttttttttcactgcattattgataactaccctttatattacatgtaactatacttgtatttctcatctctctttcttattgacttttgtgtttgtccttctacttatgtgttaatttgcactagtacctttttcaatgattcaaatagatgatcaacctttttcgtagttctcttatatagggaatgataaaaatatagagtgtaagatttgaaaattacactgtaaatatatgaaaattacattgcagatatggaatttacagtgtaaatactggctgaaaggtttgactgttttttggtgaaaaatgtggtgccataagtatagataatccctctttgttttttctttaacttggacacttaaactttccaggcaatgatgttgcttctggccctgtttggatggattatattgctttcttgaagtcaatgccggtttgttttcttccttcttgtttcctgtccttccccatgttaacattcatcccttctattattctgtgtaaatatttctttgcatactcttcaggttgtgacaccgcaggaagaatcacatcgtagactactgtacggaaagtatatcagaaggcaattttagttccaactaatcatgtggagcagctatggaaggattatgagaattttgagaattctgttagccgcaccttggtaattgtagtttccatttgaatctttgatctttgtgaaaattagctagcaaacgactctaatcgctgtctggtaaaacatatggtgctgtagttcttcatgaacatgacacttgcagattcagtgcatcctcattgtatca

SEQ ID NO: 58722 - DNA, 1015 bp, Oryza sativa
attgaaaacagaacaatgtgatttttgtagaaaaacatgataacagaggtttttctttgagtacattttcattctcgaattttaatgatgcttcttttccaattgctggcagattctacattttctttaaaccatatagctgctgaagttctaataaccaatgaacccctttttcttaattatcagttgcattctagcagcagaagtttatttgctgtatatttcaaattatgtgattaatattgaaaagagatggttcattgtatttgtgtctgtatgagagaaccaaatgaaaccttctgtccgtagtttgttctatacttctatatttgagcacagattacatagtgaactcttcttatgacttaacactagtgtctttcactggaggcctggacacagtttgttgtttggtttactggtcaagctttagacacattgggtattttcctgtcaatgtctctccagcattataatttaaaatactatgcttatttttgttatgtactctggtagatgcaaatgaccagtatttaactggcaggtaactcattaagttatttcacaggaagagcaacagtgtatggcatggaaaagacttttggcatttgaaaagtgagtaaacatatgcatgatctaattcattaagagtcacggtatctctttgctgtagttatataagctaatctttgttttcatgttctttttctaaaaccctgtcccaaccaagtaaaattgtgtatgcttcttgaatttattcaataacttgagcctcactggtcactacctggtgcaattaagcatatgagtttttcaccagccttcaggccctaggaattcttgtttcctgcttaatttctaacttgcctatagctcagaaagaccgaaactatcccttcaaattcaaaatatgttccattgcagggggaaccctcagaggattgatgctacaactgctaataggcgtgttacctttacatttgaacaagtaagccattttcttcctgtatgctta

SEQ ID NO: 58723 - DNA, 15585 bp, Oryza sativa
ctaagttctccaaactgtgaaaatgctgatagaatcatgtagaaccttactaagtgtattactacttccttcattgtgctttcggtacgcaatcgccttcggcatttgcaaccgctggttcagggcaaggaagttgaacaggccttcaaggcagcctgggctctgtgtatcgaaccgcttgctctccgccatcattccagacaaacctgacgacaatgtataggtaaattaagtccttgaaccctgcagctagtctgaacctgagaatattattgggcattccagcccattacacataagaagttatgagactagagattatgtcaataaccgtaaatgctctaaaacgcgtctaatagggtgtatattaggttgcatacaaggaacaggcggctgttaccaacttacagtataattgatgactacaccgtatgctcactaccatcagggtgattagtgaatactgaataatgcttatcgatttttagaaccatgatatccattatttactgatttttagaaccatgatatccattatgtttccaagacttagatgcatgaattcaaatgtcaatctttaagtttctcaaaaataaaaatgttaacctttagttttaacatagcaaggcaatatatattccatggaaatcatgcagcacagcatgcaccaatatacattttctcctggaacaaaagcagtgaatcttggggtttcatcttagattatagatatacatttattatgagtaatttgtggggaaagaataattctgcagcttccaatatcacccaagcgttgatccatccataaaccagattctaaactttcaaggatgagacaccacaggaccaaatgcaatcgaaacatcacacaatccctaaccggttagcactaaagattcaaggccagaaatcacatggcaagaacaagaacaaagatttgggcccctattacaccaagaaaaaaaagggagggagagccacaggaacagatcgtaccaggggagagagaaagattgctctcttcttggaatgcgcaggggaacaaaaggggaaatggagctcctcctcccctcctcctccatgagctaatgcctctctctctctctctctctctctctctctcgtttctctctcctccctctcgtgaaacggactaaactgcgagtgcgaggagagacgaagagagaaatccgctcctcctctctctctcttcctctatctgtctgtgttctatctctctgggccgattgggccacatgttttgggccagaatctgaaaaatgctactctctatgtcccatataacaacctcctactggattcttaataccgggatatattttatccaatactttctccgtttcacaatgcaaatcattctagtattttccacattcatattgatgttaatgaatatacatagatatatatgtctagattcattaacatcaataaaaatatggaaaatgttagaatgacttacattataaaatggagggagtactatattcagtggcggatctagaaatttttttagcctggacaaacctaacaatggataacaaattaacaagaaaacacaaatacctataacattttatcatggatagaagtaaaattgggctgctgtctaatgactaagtatgataattaataccaatctaatgatgcatgtgcagctaggctaatggctaagcaccatatttagttctaatgcatggatgtatgcagcatagccggggcgcttgcccatactggctgggccttggctccgccgctgattatattatattttagaacagaggaagtataattgtttctaaatgtaaacaattgtatcaatgcacataaatcccttccaataaagtttgggtaaaaaagctccaatctctttgtcatgccttcacaagcattttacaaatctaagacttcaggtatgataatacatacttactctattccaaaatataagtattattagactctgacacggttttccgagatgctactttgaccaacaatatctataaaagtaaaatgttttcaataaaaagagtatatattatgatagtttgtttaatgataaatctagtaacatcaattttacatgagtgatctttttttttatttttcctactaatactcaaagttgaaaatgtttgacttgtcattatgctaaaaatatttgtattttaggacggagggagtattagagttccaacgatggattatgaatgaaactgagtttatgacaattactcgaggacacaaaaacgaacgatgtaagtattagaaagttaaaagatcgatttaagaaagttttctaaaaaaaaataccaatgacaaaagcttttttttcccttttgagaaaactgtactatttaaagcatagggataatcgtgtccgcgataatccataattcgtaagagaaaattaaggattttttctttcccaaaattatcatcaccatacatgtagaactgcctcatctttctgcatcaattctttgtgttgtatgctgtaaccaacttaaccattaatttagaacaaccaatttaaccatggagcatcctttagacctttagccttgcccataacaaaatttgacatgttacatcggatttacggacacacatttaaaatattaaacgtagactagtaacaaaacaaattacagatccacctgtaaactgcgagacgaatttattaggcctaattaatccgttattagcaaatgtttactgtagcattatattatcaaatcatagagcaattaggctcaagagattcgtatcacaatttacatgcaatctgtgtaattagtttttttatctatatttaatacttcatgcatgtgtcaaatattcgatgtgacaggatgaaaagttttggtttggaaactaaacagtgccttagcttctctctctcaaaaaaagaagaaaaatggaaaaaagagaagaaacatctttcggtttcttcagatactacttgcgtttcttcagtcatcagctcgccgccggctatgaagaagacagcagcaacaacgccgccgccgccgccgacgacgacgactccatcctcccatggcgaccgaagctgaacgggtgatcctccatctccgcatcgttcacccgcttcgccccgcggcggcgcgtcaggaacggctcggactccaccgcggccgccggctcgccgtcgccgccgctgcccttcttcgcgggccagcgccagaattcaggcctgctcacccgcagctcgtcgcaggcgaagatggattccggcgaactcgtcgtcgtcgtcttcggatcctcttcacgtgccacgaggaacagcgctgcttccgaggcaggtccaggattcgattcccagctcgtctcgtcgccgtcgggctcctccgtgctcacgagctcgtagcgtgagccgctcctcacagctccgccgccgccgccggcgacctcctccgccgtgatcctgatcaagaaacacggtgatcgaggtagtagaaaagattcagaaacgagcaaagctaagctagctatcactcacagctccgccgcgccgccggtgagcgccagccacgccgcgtgcagccaccggccgccgccgccgcgccttgcagcagcagcagagctcatccttgactgaatcagcagagcaagtagagatcgattcgattctgcttgatctgaatcgatgattaaactggaggcgatggagctagcgggattggactttgatgagatgatttgatttcatccatggcgtggcgcgcaagtggagtgcgggtgggaaagcacttcgttcgcgcgcgatttgagctgcacatttttaatatatatatttttttctagtggtcaaaagtctcgcagaattaggcagagacaaaaggaattaaactgaagttcagaacaaaattaggcaggaattaatctgatcttttcttaatttttctgtgtgcctatatgtttaattttattttcgttgaaaacataatctttgattctccatgagaattaagaaactttggtccacttgttatatccctgattatattagtagtaggttttttttttttggatattatccatgggccatagaacttggcaaagtgcaggaaaagtgaagtgaaaatagatgggttaggtcatggcacaatatgaaatgagagattgacctaactcgttagtgcattggactattggtacagtggccatagaacttgcagacattgacatttctcaaaataagaaatggccttttctttagtacttaataaatgagcttaagttcaaatcatcacaagtgataaagaaagatcatccttccatgtcagtccaggtagggcacccatataacagaaacatttacagttaagcttagggagaattaatttgcatatgcattttacaactctgccattacatgggctccacctaataggcccaggccaaggtgggcccaatttcttgtaaatctgtgtgggccacattgtgtggcccagaaatgctgcgatgtctgctcttggccagtgatgtcctcaaaattttctgcagctttccttggaaaccaccagctgcagctttcttattcagaggcctctgtgatcatgcaggccacagttatcttggcagaaatgccaggatcagtacagtggttctgattctcgaagggacatgaaacaatattatgattggtggattgcatgatagtagtgactagtgagtattagtctttcatatcctaatcacatttcacaaatttgatcagtttgtgtcaattttgcgttttctccctgttctgatatgagttatgtgttgcattttttcccttatgttatactgtacagtgtacattgaaccaggatactgcatgagtacaaagtacacactatgctcgattataactaatcgagaaaagtaaaaaaaaatagataccgtgtagcttcagcaattcagaaatggaagataaaaaaaagaagaagaggagaacatgtttgagcttcttcaggtacttttcttttcttcagacttctatcagcagctagcagggtttctcttaccgcgcggttaccgggcttaccgcgggggtacggtaatataaatatcgcggtaacctccttaaatttaaatacatttaaaaaataatttaaatttttgataaattttacacgattttgtatggtttttcagggttaccgcggttaccgcgcggtaaccgtgcttaccgccggggcacggtaacccccaccccggcggtttgggaaaccctggcagctagctaccgtcgactgacgatcaaatcgaagctcatcgatggatgatttatccgtgacctgaatattctgatatttcctccgcctccatgaattcagacgcgctgttgctgttcatcaaattcacaaggccagctacagaatccagacaaggtggtaaccgtttctgttcatgaacagttcatcacttgtgagaaaagtcttcagtcgaatccaatccaccatcgtaattttggcccctacttcccttaaaagaactctgcaaattgcaataaggaaaaagggagaaaagtgcattggatttggtcaggttgtactaatggctagtactgtactagtatacgcgtatgcattggtatggttggcaatttgagtttgccaaaagtttatagcctgagagtttgccttcttctttactgtcgccgtgtttagttccaaaataattcttcaaacttctaacattttcatcacattaaaacttttctacacacacaaatttttaacttttccgtcacatcgtttcaatttcaaccaaactttcaattttgatgtgaactaaacacagccacagggattgctgctcgtgtactaattctttctgtgtctcttttcctaatatgaaatagcagagctcctgcctgcttcctctaaacaaaattctatttctacgattttctttgttcctatatttttataatcctgagtttcgaagaaatccttggctgataatcctattaattaagcactaaactatcacaaatgaacataattttactgaactttttccatgttttatgatgtactagtacaacgtatatatatactatactagtagctagcacacgtgcatgtgagtacaaagtacgtactatactcggttgtcggtgtgattaattcagagttgagcatgcatgccccactgaacgtgaagatctctgtccagatccttcacttggaatttactattcagcaccctagaaatgttaaatgtatatcgcccagaggctgagataatcaccaagaatagtacaacactggccactcgatcggccaagcttcagaaatcagtatatttttcatgtgaggaatatctgaatcgtaccatgcatcgatccatccaaagctaaaactttcaaatttggacttgagttgtctaattaacgtgtgaaggtgtattgtccaattaactttaaaccctgttattttcggctatttaatttgccggccgattattgttgtggattagttatttgcatactcaatgtctaaaaatatatttactcagaatgtttaacttgttctaagctatttgttaagtttatttttcaaatatttaatttcttcctggataatatgctataataatcagtgtattttttttcaaattatatactcatgcatgtgtaacaaaattattttctacaacagtattttcttttttaaaaaaggcaaacatatactgtggcctctatccaaaacggtggtagtagtaattaatacggtgtgtgcaaataatatactccctccgtcctaaattataagagattttaaacggatgggacacttcctagaatagtccagattcatcgtactagaaaatatcccatctgtccaaaatcccttacattttaggacggagggagtactattttcgccgtttctccatctaaccaacatatggatatataatccatgtactcccaccgtcccattataattgcagccataagtttctgtgtccaacgttcttatttgaaaaatttatgcataaaacactattcatattttatcatctaataacagtaaaaatgctaatcataaaatatttcaaataaaacagatggttaaatttggaccctgaaaccgacagatacgcttattatgggaccatctatttaaaacccaaaacattttacagtctgaaatttcagagatgtcactgacagagactgacagtcatctgcatgcataggatgcacttatggaatttacatgcgcgcatgcatgcatattgtcggcgacgtggtacgaaaactgtgcgttgccgttacgttggagacgacgacgcgaaagatacgcgtcgatcacgccctcgctccacgacgagcgatctcgatccgtccatcgatcggacggccacgcatgcacgctagctagcccatatatgtgcagcaactacgacaagtacttaacgtacaagacaaagacaggaaggatccaatgcattattgcattgcatggcgacatgtacatatactaggcactagcttatagcttcatgcatgcatgctttttgcttttgaatttcctctcttccatggcatgcatgtgtgtgtgtgtgtgtgtgtgtgtgtgtatatatatatatatatatatatgcatgtattacaggtcacactcatgcccctgacaaagttccttttttttgtgtgtagtagtgtgttttggagatggattttattaatcatacacctccatgttaattacctcctttcgtgttttacatgccattttaatagacataaaaaaaacttaacaacatagattaatataaaatatatctcgactattataaaaattgaagatgtttttgccggtattttggtacgtcatatgtgtatgagtcggtttttaacttcgtttgcttttggaaatatatatccgtatttgagtcaatgtttaacttcgtttgcttttgaaaatataggcgaatttccacagtgtatttcaccttaacgaaattaccgtataataacaataagattaaaataacgtttacccattgcaaagcacgggcattttttctagtcacttaaaaaaatgcaaggtggaattcgacttctataaagtattaaaaaaataaactgaaaatagttaacatgcacttatatttgtatttttataacttgtggaaattaaatttgagtgatatattttatattaatatatcatattaattgtttttaaattatttaagttattttataactagtaagaatcgagaggatatcccctccagtaaagaaaacactttcccatgtgttttgtagctagcgtggcatgcaatgcatatataggatcagctcggctgggttagatctagatgacatgcatgtatatatatatatatatgccaagtgaattttactagctagctttgttcaatgaaatggtagtagcatgattgacattgagatcatcttgttactcggctgttttcttcaatgatatgagaatagagttagattccagacaagaggttcacaaattcagaatgcaattattccctcgattctcttttagtacttggcactgttgactagtgtgatttttttactatagtaaaaacttttaaattatgatgttttgatgaatgtatgcagtatatagttatatttagcatgaaaattactttgataatatgatatttttaagtatttgtatattgtcaacgggggatacccgtgcaccggataaatagggtattgggtatattggtacgaggatctacacgatacaacatcaagacaaatagagagagtacacagatattattatactggttcaagccccttataaggtaatagtactaatccagtttatatgatattgatatggataccacagagtacacagagaacagatgaatccggcgttaccggcgagatcctagtcgagatggttcgacgagattccccggcgagtaggcttcgcgtcctccggcttcgtaaactatggtgggtgtgttggcgctatgatttgatgatatgatccccttaaggggtgtgccttttataccgtgagttgccttagttttcaagtagaactcggagacaatgaaccatgcacgacatagaataaacccaaccctctccgagtaagactctgttaatcacagcccgtgaggatattttccataatatcttgtagatttccttatcgcatacggaaatatatcgtatacacgaaggtataccatatccgtatattccgttttataggatagaaggtatgtcttatccatagacatatattttattatttttttataaaaagacaagctgctagagtgtgttaaggaatagtatagtgacatgtaaataagaacagaatgtccttgtatgtgagaggggggggggcgtaaaattcaacaatcaaatgctggattctcttttgtaaatttgaatcaagtttatcaaaatttagaatttcttaaaaatatttcaatccttaaagtcctaaaggcaagtgactttgtataaagtaattttgcaacggcacatgtgcatatcttaactaatccctctcttacaaaaggagataaagatatagctagtacactccaatcttgcaaaaccaacatatagagagatatatatatatgtaatcatttaggccctaaaaggtaagtcactttgcacaaggtaatctacaagttgcaacccatatgtgcatcatatctcttaagttcctagtactcctaactaataattcctcttttttacaagagatagaaaagtaatccaaatatatccaaactctatatatccaagtcgatctccatatatttgtaaccgacttaacttcctccctctccctttataaaaccctaaccgccacgaccccttctccctcctcgccgatcgaatcttcgccgccgccgccgcggacctcgccgccggcgccaagcaaggtatggacacccgagtctgcggcgacgaccaagcggccgaagcggcgccggtgcgcggcggcggcgaggacgcagtcgtcgtcgtcgtctccggcgagggggcggcgtcggaagctggtgctgcctctactacggccgtcgccggcgatggcgtcgtcgaagcttctgcctctgtagacctcaccggcgagaggggacgacgccgcgatgatgaagcgcccaccacggcggcggcggtggcggaggaggaagcttctgccccgccggccgtcgtcgtcgccggcgccggcgacggcgacgacgacgacgaagacgggtacgtgacaccgacgtcgccgcgccaacggctgcagccgccgacggtgtgcccgccggcgccgaaggcggcgcgttcggcgccaacgcggctgcctgcgaggaggtttgagggagctctcgtgatggcggcgtcggcgtcgccgccggggcggaagagggttcaggcgaaccccgactccgagtccgacgaggtcgtcgtcgcgttcattcgcagcctgcggcagcggctgcttccaccggaggacgagaagaagaaccccatgtagactttttaaaaatattttggtttggtttgattaaaggtagattgttttttttttaaaaaaatgaatttagtttatctgaatttcaatttttttggggctaaattcagataaatttgaaactgttggcgggatgcccatcctagctgggacccagctagacctgaaatttccaaagtttgaaatttggatttgagattgtgaatctgtagctcgttgttagatccgaattgtgaatcctgacttctgagcagggtttgaaaattttcgttttgaaaatttacactgggggactcttgaaatttcggaatttttcggaaccaattcttggaaatctcagaatttttgggatcgagtttttttggatatttcaacaaatgttgaccaagtttgactatatttacaacaaaaatgaaaaacttgaaaatttcgggtgacagtgttgtgcagggaattttggaccgaaattgcaacactgatcattttgtaaattatttgaaattcaaaccaaatttgagtgaattttgagcaaattcaccaaaaatgactttttttaaaaaaaatcaggtgaaatagttttatgccaagagtcggaaatttcggaaatttcaaacactgatcctgagtaacggtgaaaaaatagctgccatagacttttcgaaaaagagcatctatgctggcacgtacattaaaaaccttacataaattttgcacgaaaagttaactaccgtatcaatgtggttaaattaagaaggattattgaactcactgatgaactcttgtatgccaaggtttttaaaatgagaatgtagtatcgtctgagacttcgtatttaattcaaattattactacgtgacttaattaagtcaattgtactagtgaaaagtgacatgagttgtacccaagatcctaagttcaaatatctatttaagtgattttcagccaaggtcctacgttcaaatatctgtaaaagcaaattttagattgtattgtttgagagaataaattcccaatttaaaaaggctgtatatacgtagagaccgagtaaaatatacccttctcaaaataattaaaaaaaagttaattgtactcaacatattggcttgatattgacatgaactacaactattacacattatgtaaacagaatgaactacaactataatccgatttggaaatcactttggagcacgcacgcttaattaacaaccgatttggaaatcacttgggattggagcacgcacgcttaattagcaatcgcggaatcactcgagacgatcaatcgatcatatcgatcgccgcgctctcgagttgatcaagctcgctctcgactcgacgtcgttcatggacaatctcgccgcgctcgcagcagcagcccgcgcgccgccggccgttccgccgccgcggcgcgacatcgacgccagcttcgcgctgagccgccgcgcagctcccggtcccgggtacgcgcgcgcgctgcgccaccatgggcatgggcacggcgccatggcgagccagatggggcgggaggtcgtggagcaggcggcggagcggctggtcgacgccgggatgatccagttcaccgcgctgccggagccacgggcgccaccgccggcggcggcggcggcgacggcgagggggcggtggcggtgccgcgtgtgccaggtggagtgcggcggggtggtggggttccgggagcactgcatgtcggacgaacactacgccggcctccagctcttcgccctccactcccacctcttcactgaccaccccaacctctagaccgacctggctgtgagcacaatttctttttaaaacttagattcatgtttgaagctcaaattcaaacaaattttacgacagtttattagacagagagctgattcagttagtgtgtcttatgaatcctatatatttatatagttcatccccactaagtgtagttaatgctatttctctcttctttcattaaaccatatcaactcaattattttagtctttagatgacagatctatggttcaaattatctcttctttcttctctcttaaaaacatgcaatctcaattatttttaggctcaaaactatatcaaattgttttagttttgataatcaaattacatattatttctacatattacgcaacttaattttctgcagcaacgcggcgaggtatttatctagttaatcatattttcccccattttccctagcttgtaataataggagtaagttatacttttactagtacaaatcaagattgactcaacccagaagtactaactaatttgagggtctgcacttctttcgcttcaagtactgtttacatccaaattcagtttattgatctagctgattaagaataatttacatccaaattcaagataaaattaaagcacttgaacacacccttatctattacctaccgccaacgacgtcaaacaatgtcgagacaacaatccgtgaaggtgactgctcactgtcatgaactgcatgactcatgcaaatttaggacgacaagttcagaccatcggattcttctccattgtcctgtcccttggagaaagaaaagaaaaaagatccataggattctgatctgcagattattgactctacacgaacaggggctttggtcgcttctgcctgatacatatacactcttttatatgctgtcctttttctgtcatgaaatcggcctaacctcgttcgcgacgtgcgattttattttaaaaaaagaactatttcaacctgtttgtttttaaatttagaaatgaaccacattaaaatttatttttagatctaaatctttttgccacaccagactatgtgcatcacggcggcatacatttttcaataggctctcaatcctctctctcttttttcttttttctttcttttttttttttgcataatctcaaattggtcctccggcccggagcgagctcctctgtccctccgactttacgttagaggagtctcgtccctctagcccttcctacctggtatcccgtttagggctggataacaagccagctcggctcgttaatgttaacgagctaaaagactagctcggctcagctcacaagctggttcattaagcttgttaggctcgttaacaaactatatctcattaatattatattaataattttaaatttaacattttattatgtattaacataataataaaaactaactaatataatactcactacatatgaatagttttgatgtaattaaaagacttagtactagtcaagaaacatgaacatatgatgatattttatactaacgagctaaatgagcagctcgcgagctagaaggttagctcgactcgactcattaagactgcgagttcgaatcgatccgagccaagcttgctacgagccgatccgagccgcgagtttcgagttttttgtccacccctaatcccgttggttctttaaatttattgtacaaaccctttctcttttaataaacatggaatgatttatcatcttagctagtcaaaagttttgttgtaaattcgatgttaaatatgtagttttatggtacaccacctaaaatctgtagttttgtaattgtttggtcaaagtatatttagttacctaaaatttactaaatttctctcgatcttagtcaaattatatgggacattggatcctgccaatacattcgtgctagctatcggttgctatccatcttttagccttttcactagcatgatcaattactcccttgctacgttatttttgtctagtttcttttttcagtttgtgtgcataaacctttttatgtggattaaagtactacaactttattttttctagagtactaataaaattacattgtaaggtttaaaatgtacatcgtaagatttggaacttataatgtaaatgtataaatctttacagtgtgaaatatgaattttaatgtaaataatttttttaaattaccatttttattaaaaaaaatggcgctacaaataaatatagtactagtactctcatttgacgcttggtgcgctccaatactaagtgagaagtcggagtacgtatcgaatcgtatggatgggccggaatttcgctaggcctatctaaacgaggcctactaacatgatggccctattattccacggcccataaaccactaattagccccctgcagggcccactttgtttttcttagtatccttatttatgtgattatcttggtaatttgtctgctccatttgaccttgacttttgactgattcatggtaatctgcagataattaagagtaagtcctcttaaaatcagatactacaattgaataattcataccgtcattaatttatctgctatagctaaagtcttcagctgatcgtcctttatcttcggtcctaatcttcttcttttttcttagggttagtcctaatcttcttgagcatgcacagtaattaacaatttgtacagaaaccactttgtggcagccccccccccccccccctttcccactaagaatttgagatcgtgctaaataaaaaaaagagtgaagtgcaccagcggtccctaaacttgtacgggtatgtcatctaggtccctgaactctcaaaattcatttttaggtccctaaacttgtcttgggtgtcatatagatccaaatgggctccgagccgctccatccgctgacgtggcatgccacggtggcatatacgtgtcgatggagccatatgtgggtcccacatgtcggtatctctctctcctccttattctttcctctcccttctcgattcctcctctcctttgctgggctttcttgttcccctctcacatgtgcgcgcgccggagagggagaaggctggcgcgcgacggcgcgggtggcggccgggcgatgtcggcgcagcacagcggcgcgggagaggcggcggtggggatggaaagggaggcgcggcgaccggggcgacgtcggcgcagcgcaacggcgcggccgaggcgatggttgcgcggcggcgcacacgcgggtcgaagcggggcgctgcgttacacggccccgtcgg

SEQ ID NO: 58724 - DNA, 3157 bp, Oryza sativa
gacgggcctcggatggcctccggtctccgtgccgcaccagcctccgtgcagcaggcgacgccgcactcgcctcggacgaggccgcgccctccgcgcggagctccgccgcgaccccgctgcctccgccgtctcaacacaccagcgcatgcctccgtctactccgccggtcgcacagggctcggccgcggcgccgcctccgtcggctccgcggtggagaatggcggggtggtggcgagttttcttgagggggggtgaagtcgttaagaagaggtggcgtcgtcagagttgagggcgcacggggtcggggccgcacggcatcgagcacacccaaggtgctcgtccgtgtgtctccagaaaatatggtttttaatcttatttttataaatatgactgacatgttgggtcctcatcgacacgtagacgccactgtggcatgccacatcagcggatggagcgggtcgaaacccatttggatctatatgacacccaaaacaagtttggggatctaaaaatgcattttgagagtttaggtagctagatgacacacccacacaagtttagggaccgctggtgcacttcactctaaaaaaaaatgagttcttatatgtgatggcgataactagagcgatgttaaagaaggctacccacctacaagtagtagcgtcgatctagctgagtagaaaaaaaaaccgttgcatcaattcagttttgttttactaattaaatgtaaaaatggaatcgtattgcttggaacgcatgttcacattaaaggtagctatgatcatcaaacaattgttggatccgaggaaaaataaaatctcgttatagcctaattcgattgagcagataaagagaaaattttaaaaatagaatgaagaaatcctaaacatatcaaaacacattggtatcgattaaaacatataattttagaggccggccccatattctgttgaggccttagcggcaccttgtctcacacgtgcctaaggacacatgtctgttttgtggtagattttggtgtaatttataattatagatagactcgttttccctaattaacatagtcctacttatttttgcctgcttcatgttcacaaacatcatcggatgttaaaagttatgggtttgatgaaaactttgaacatagtccacatggatagagtgtactaggcggtttgctttcttggttgtcatgtgtactcttaacactgatggggattgattagtggccactatggagtatacaatgacaccccaaccaacccctctttgaccatgtgaaaggtagaagaggtagtagtctaattattcttgcctgatagctagtctccagcaataataagcaaattagtgttttgctggctgctcatgtattttcagattagacatgactaattgcacattattgtatttttctcatgaaacatgtcgtgattttgcatacacgcctttaatttgaccacacaatatgtactatattcgtctatacatataagatttttttctgagatgcgtagtatatataccgtgttgtgtgtgtgtaaggatgaaaattcagtggcaatgaaaggcttttgatggagccatgcatccatcaaaagataaaaattcatttgctttatagcatactagatgataccctacacgttgttgtaggaatcttgataagattaacataagcaaatcgataaaatgatattagaagatattgaatatagaacattaaatcaaataaacatgaacttgaatcaaatcagcatgaactgacaattattgagaaaaacatggcatctaggaactaatgatcataatatgttggtaccatcgataattattgatccatttagcaagccttcgttagtcttttcttgtcagggaatgttaacttgacacatagttagcacaactataaaattggtggctaaacgacttctggattaaatagagagaattatggatgaactaaaggagtaaatgcaagcgatataatatatagcactaaaacaatctgagcgatcaagttgaatccaatggccaatagcaaaggtattttggagtaatctagagagctaaattttgatctaatggatgaaatttgttgaaatgatttaatacatatgagaggagagaaaaatcgctttaattgtacttagtggggatggactttttatatataggattaattttatgcttaattaatgacatgtgaagagaaaaaaagtgatgcatgcatgctcatagcgtgtcgattgtggcactattattgcgttgcattcaagagaccatacacacacaaaatgagaggcagtcatgttcaccgtcacctcttaagtcaacacatcgttgaatgttaagttcattttagttgtgccatctttatttgatgatttggacataatttatagatacatgtgaaagaaagaaagaaagaaagaaaaaatacagttgattcttggtgatacaaccatgtaggcttatgacctacaattccaaacagaacacaaccacctaggcttttagttttgcatatgttatatgtgtgtcttctccaatcgactcaatataaagttttttttcttaaaaaaaaactttctccattacaaaatactagaactttggaggttgaataacgatatcaaggagaaaataaaatgggaaataattgttgcgcgctactcaagatgagaaagtagctaggtgaagaaactgaatgaaaaatggttgtggttgcttaaaagttatatggagggagtctaaaatcatatggagttaccaagacaactatttatatgtgtcataattgaagagtcaaaagtagatggttgcacgggtcaactcccaagtcaatccataatggagtgtactttaagttgataagaaaccatacaacagttatgtcatatatatttaggttgtgtttagttcacgctaaaattagaagtttgattaaaattgaaacgatgtgacggaaaagttaaaagtttgtgtgcgtaggaaagttttgatgtgatggaaaagttggaagtttgaagaaaaagtggtttagtttccaatttttttcccaaaaacatcacatcgaatttttggcacatgcatagagcattaaatatagataaaaaaaataattgcacagtttgcatgtaaatcgcgagacgaa

SEQ ID NO: 58725 - DNA, 2990 bp, Oryza sativa
tttcaaggcgagttatgaaattagttttttcatttgtgtccgaaaaccccttccgacatctagtcaaacatccgatgtgatacccaaaaattttctttccgcaaactaaacagggccttatagcgatattgatggatggaaaagagataaaatgggcagagaacataagaaaaatcttgatgaaacaactataaatatatatttaaggtacaatgcttttttttttttgctgaaattgtatctctctcctcccatcgactttaggtaaaaaagagtcatccacatatgactaaaaggagcgcattatagggtttattagtgttttcttttacttacatggaggatctgaagtcatcataatcataccctctctacttctctagagatggaccaatacatatattaattatcttttaagtatattgtcaaaataaaagaaaaaattacaattgaaaaagtacgactccctctgaattgataatacttttgtttcgaggaaaaaataactttgcccactattttttaataatatatatatagaaatatcaataaatatatgatttaattgaagtaccttttcaggctaatttaggttttcattatttgtaaaacaaatagtttaaatgttattcataatcaaagtttttgaagtttaaccatggttttatccaaaatgacaagtattatcaacctgaaaataatatttaccaactagatttattttagcaatatttaccacttgtgtcgtcaggttttcttcttcttcttctcgcctgcatacatttgtcggagggtgaactcctccaccagagaaccgtgagacccccttttttggttcggccgggggcagcgggtgagattcgatattcctgtgtagatgtgtgaagatggggttgaacccccaaaaaagatctcacccaaggggtttatacaggttcgggccgctcagaagtgtaataccctactcctgtgcttggttgattgagtgtagaacacaagtgcttgaggttgcgagacaagcatgagttcgctaagaagttcctctccctctaccactaggcctggacctcctttcatacctcaaggggttaccacatgggtccaaaaacataacttagtggagaaggattacaatctttgcattaaatgcctgtcttgtctcttaacttgggaagcaagcgcacgtcaccttgatgacgaggcttgtcaaatcttgccgcctgacacggggggtgctcctgtcagtcgccatttaagggacgaagacttctgggctcctgtttgaccagagcggataaaccgactccggctacgatgagagactaaaaagcctaagacttatgggctcctgtttgaccagagcggataaaccgactccggctatgatgagagactaaaaagcctctcattatgatgtgatgggacagagcacgccgcacgccgcctggcatactcacaaggcgggggtactcagccgccgttgcatcggccattcgaccggtcacggactggtcacagatcggttgagtgcactgcagatcgcattaaatgtggcgtgacgcaattgctcaggtcgccataaatgcgggtaggtgggcgcctggaggcggccacctaacccaccgcacgtggtgaccaagagagggggtcgaggggagcccgacccctagtcacaggaaggggcggccaccgtcctaccttgggcccgatccctcctcggggagggccacgtggcgcctgggggtagcctcctccctccagtcttgatcgggatgggcccgacccccaagcgaggagggggcaaccgccactccacctcgggtgctgccccctcggggaagtgtcacgtgggtctgggggcagcctcctccctccaaactcggtatcctaagctaagctgggagggggcggccactgctccacccgggcgccacccttctcggaggcgccatgtgagtttgggggtggcctcctccctccaaacatgatacctccgggcccacatcaccgacagcattaattaggactatgccgtgtccggtacaatctttgttactcatgctgtgtccggctctcttctagcgacgcttcaggtggatctgtccaatccgagacatggacacgcgagacatggacacgctatgtttgaattcacgtgcacgcacaaattctcactatttaccaactagataataccaataatgtgttttgaacacacaacaaactaaacagcctctcaaaaaaaaaccacaaaacaatcactacgcatcacctatattccatccagccctacataaaccattaatttattgtttcaaaccacacgtaattgatacacattaccatcactatcaaccactcctatagagagaaaaaaactctacaataacaattactacctccgtattttaatgtatgacgccgttgactttttatccaacgtttgatcattcgtcttatttaaaaaatttatgtaattatcatttattttattatgagttgattcgtcatcaaatgttcttcaagcatgacataaatatttttatatttacacaaaatttttaaataaaacgaatggtcaaacgttgataaaaagtcaacaacgtcatccattaaaatatggtgggagggagtatgatttaacctaattctccacaccacatgacacggtaataatcccggttggtaggtagccggtggtgcagctacaccgaagaatgtagacggaaatctgccgtggaagacaggcaaaaaaaaaaaaaaaaaaaaaaaacgaagacccattcaacccaacgtacccaagacgctgacctgatcagcgatccatcaccaaaataacactccgcccctccatttccccactatttaccattctgccactagccgaggtctcctcctcctcttcttcttcccgctgcttcgcctcgcgctcgccatggccggcgaccgagcggaggaggaggagggggaggcgccgcctccggaggcgc

SEQ ID NO: 58726 - DNA, 2490 bp, Oryza sativa
aggaggaggagcgggcgctggcgccgctcgccgacgcgctcgaggcggcgctcgcgctgctccggctcggccgcgaggggagcaggatctccttggtatgtgcgcgcgtgtgggtttcttgattttgttcgattcgtggtcctggctgcctttttgggaggaactattattattattatggattggtgatttgatattatgacctgttcttaggtaaaaataaagtgcagctttagttattaagtttattattgactttagtctcctaaaaaaaattaagattcttggatgcaaaaatatgattctgattcgtctactgtgtatccgtgcttaatttttgcttttataaatcgtgtggactaatattaatatatattgatgtgcagttgtttgaaacacaaaacaaattgtaggggtcgtgattgttaagtgagttttcttttgttttagcataggggctttaggatgatttagttgctgttgcttattaatcgcaaaaaagagagagagaaaggtttccataattttattctgcagctgtgttgtatttgttcagctagatttcttgttgagctgagattgcttcttgttcaatgcgaccaatatatgttcttcttttgtggtgcaattttggtagggtccataagttgtggtctttgggggcgtctgtaacttggttatttcagatcaaactccttgctatttttttttgtggatctactgcgaaacttgtcatctgtaaatgatccatgcattctcatttctcagggcatccatgagtttgtcatagatttgctgtagaataaatgcttggacggattcctccatcggtttctttacttgttgaaacattcaagaatctacttgcccttgccctacatccttcatggttgtactccacatgttattccccatggtaaaagcacggtttgttgtgtggattagttgggagaggcaacggatagacatatgatcatgtctttctccatggtaaaagcaagatttgttgtggattagttgggacaaccatatgatcatgtctttcactttcttgtgtgttgtttgtagtggatattgtctatagctttgaattgttcttttgaggagaggtatgatcttccagtcctgagcaattcaactgctccttttggatcataaatttcacctcttgaatcattatctagccagtttttctgcctaccagtatggtacatcaaatctgaccgattggagtactatgttcttttgtcaagtataactgtattattatctgtatggtatatctaatcataacagacattttcatttttctattttcactgggacaaagaacttgtactaattgtttgctttactttggtcaaatctggttgactgtatctgttgtaactatcaaggcctcaaacccttcatcgagtccgtgttatcaatgggatgctttatgagtgctatgacataatattggtaatcaatagtctttgaacattattttatatcttgatcgctcatacaacaatgatgactatcttgatcgctcatgcactatttttccggattaagaactaacttctggctgggtagttgttgaaattgttcaggagttgaataggccacgtgctttgtcagaaaattaaatagcagcaagtaaaaggttttctggaagctttcatgttaaattctttttataaactagcaaatgaaatggtctgagaagcatattttcattttggaagtgcaatattgcttagtagagagtaatcaaattgggttctatacctaccacttaatgctcgctgagtacattgacccaaaaatattatttctgagcacaataggtttcattaaacttttatactgaaatacaataagttgccgcaaccagagcagatcaacaaaatttgtcattagagaacttcagatgatcgacatcataactatattgtttgtaggctcaaacattaaggtccccaccagtggatttctgcacccgttgaaagtgtttttcttttttggcctgttggaatgcccatgtacctgatgataggactacctctatgactcaccgactatatcttttacggctgtgcatagggaagggatgaacctacaagttagaaatatggtagtcattgtctagttttctttatgtgactatcaaactcatgtattgattcaacgttttccttcttcaactccattttgatgttattgaaagtgcttgctcattttattcccaagctcagaagcaagggattttcttgattatattggtgtagtttaaatttcaggttggttttcttgctctttgcttcagtacttgaaccacaggcctctgactgtccatcctgtagcttgtaatgtttttatatggtgctcttaatgttggtgttactctatctcttttttcccctgctttacctgtattcttattgacctttgattaccattttgttcttattataaatcattttttataaacatgcttttcga

SEQ ID NO: 58727 - DNA, 1070 bp, Oryza sativa
tccccccccccccccccccgacccgatcggcgtcgcgcccgccgcgtagcagttgcaccgcgcgccgccgctacccgccaactcacacctaccaccctcccccctcccccgcgcgcgacgtgggctcgctgcatgagcccatggcggacacgtcgcctcgccacctcccccccgccgccgccctccgccgagcttaaatgcacccccgcttccgcctcctccaacgccattccccaccaccacctgtcgacggcgtacgactactatctcggtgctttgttgctagcttcttccagctagccatgggtgtgaagtggaaaggtggtggcgcgctcctcctgctcgccgccgggctgctcctggtggccgtggcggcggcggcggcggaggaggagggtcggcgggacccgaaggaggagctccggtggtgcaagaagcagtgccggtgggaggccgggcaggaccagcggcagctgagggagtgcgaggagcagtgtctccagcggcagcaggaggacgacgacgacgacgagaacacgcacggcggcggcggcaaggagtgccgccgcgagtgccgtggctaccgcgacgagccgtggcggaagcaggagtgcatgaggcagtgcgagtggcgccgccacgagcagcaccaccacggcggcggccatggcggatccaggccggactgccgtgagcagtgcgagcaccagcaggactggtgggagaagcagcgctgcctcatggactgccgccaccggcgacaggaggtcgacgccgacgacgacaaccaccatggcagagacccctgctacaagcagtgccgccaccaccacgaccagtggaagaagcaacaatgcatggaggagtgcagataccaccagccccaacaagacgccgccgtcgacgtcgacgaggaagacgacaaccacggcggcgatcgctgccgcaagcagtgccagcaccaccatgaccagtggaagaagcagcagtgcatccaagattgcaggtaccatcaccgccaagaagacgacgtcgtcgaggaagaagacggccaggcgatcagcaatgcc

SEQ ID NO: 58728 - DNA, 10996 bp, Oryza sativa
  unsure (1)..(10996): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaactaattgggtatgacttccccctgaataactttaggagcagttaaatcaactaactttggtcaatagcaggttgctgactattattcatggtcgggggcctgtagttcattgatgggggaacttcatcaagtccaatttctcgttcaagagtgctcctgaactcccttgaaacatcctatatgcggaaaaaagagacacgttacatatgtatcaaggaatcacatcagacaagtcacaaaccaacctgtagctctctaatggttggctggaaagcacgcaaagtcttccccaaattcctggctacctgcatacaagcaagcaagtgagacctaacagttcgtaatgatagaaaggttggcaggaagtacatgctcattttcattcacagtaaaataaagcagaacaacaacatgacatatttaaagtgaagaaaacaacaacataaaatatttcctgcaaggctttttcttttctgtatgtagtgtgtgctttcaaacctttgcagaaaacctaccacgatctggcagtacatgcaacaggttaagaaactataggcgattagaatatggtgctaatgctgagggtttagtgaagaattagctagaataggaagccggacaacagcaaaaatatgatgtccaggtttgttgggaaagagtttacctctgctagtcctttgggaccaaagactaacagagcaaccactccaatgaccagagcttcgggagctccaactccaaataaagaagcataaacacccgttccacgacttgttcttttgctctctacattgaagaagtcaaagaaacacaaaggctgtgagatgcctaatttggcaaagaattatggaacagcacgatacgaatacaggcatagtaaatatagtaaagggaatatccttcatccagctatataaagcaggaaggtagatgggcagttatagcggcgaagacaaattagatgggtataagaaatcctgatctcttcctttcctagtctttagctttcctgtttttcatacaaagatggtagtgtgttgacgtctaattccagcccaagagaaaatttgtagatgaggttaggaatggtagttatggaaacgaaggaagaagtggcgagcagccaggtgatcccaggcattttcccgagcttatggtgggcagcagctgagcctgagcagcacaaggacaaaaaatgttgaatgccgcccaatttgtgcactgtatagagcttgtgacaagagttgctatttccatccaagatatgatgaatacttttgacggatagtaatacaaagaataaggagtacaactaaaaggtaattagatactactactaaatgaatccaaacaatcaaatcaatcaatgaatcgtctgttggttgtgggagagtacccgtacggcggcggcggcggaggaggaagcggtggtggcggccggagacgaaggataggccgagcgtgcagtagggctgagcgagcgtgagcctcctcctcctcctcctctgtgaggaagggaaaggggaaggggaaggagtgcacatggcgacgcacggaggaggtcggagtagcaggccagcgacggccatcgccggcggcgggcttcgaattcgattcgattcgtagggtatatgcagctcactcgcaagtcgcaccgcaccaccacaacacaagaagagggaggcgaacgatagagggagatattgcggcggcgcccgacaacggggacggcgtaagggggaggcggaggtggcggcgcgaggggtggcagaggcggcggcgctcggtggcggcgccggagagggagagggagcgggcagagcgagagggtgcgagcggcggcggataaggtttgggttagtgggtgttattttgccaaaaaacccctactcttttctcattttgcagagcggtcccttttcgcccccaaatactgtttgtaatggcctatatataattacagaaaatcgaaggtctttttcgaaaaattatcgacccacttctcccatggctgggagtactaaattaaacaaattgggtgtaaattgtgaaacgaattttttaagtttaattagtccatgatttgataatgtggtgttaccgtaaatatttactaataatggattaattaggcttaataaattcgtcttgcagtttgcaagcggaatctgtaatttgttttgttattagtctacgtttaacactttaaatgtgtaccgacatacccgatctgacatgtcaaaactttatactactcgatctaaacacaacctaaaatttaaattcctgtcacatcggatgtttggacactaattagaagtattaaatatagactaatgataaaacctattttataaccttgaactaattcgcgagacgaatctattaagcctaattaatccatgattagcctatgtgatgctgtagtaaacatgtgttaattatggattaattaggctcaatagattcatctcgtaaattagctatcatttatgcaattagttttattattagcctatatttaatacttttaatgaaggccaaacattcgatgtgacatgtactacaatttagtccttatatgtgaagttgtggggagtcatctttcttggtctctgcctctctggtgcttctgatggaatattgacgaggttctatcaacgagtttcctgaagtaacaatgtggaaatcagttttctgctttaatacacattttaactcttatcgctagatatttaatatattactccaaagaaagcagttaactgtagtgctaacagattaagaaagagaaaccggttaacatgaaaaataaacattgaagatatcttggtcggccgaattacccctgaactatcgtggtcagccctgaactatcgtggtcagccgaattaccccctaaactcgaaaaccagacattactcacaacgaactttcaataccggacgaattacccccctcggcccaatccagagcgattttgtcctacgtggcgtacgcgtggcaatccagtcagtattttatttaattaaaaaatgtgggtcccacctgtcatactcttcccctcttcctctctcctctctctcttctttctctcttacagggcagcgcgcaggggtgaggaggtgggcggcgatgcagggacgggcggtgggctggaggaggtgtagcgccggcacctgccggcggtggtgtcggtggtggagggtgccgctgcggaggccaaggcggcacgaggtgaggagacggcggcgagagatgaggaggaggcggcctcgctgtgcggccgcgccgccaccaacagaaacctcgccgcggcgcgctccgtcgcccacgcggccacgccgtcggcgccaccgtcatcaccaacgaacacgacgcaggtctgcgcgcccgctgcagcctcgtcggatgcgtcgcctccccggaagacagcctcgccgtcgatgaaggtgtcggcagtggagggcgccgccgcgcggaggccgagctggggcggtcggctccggcacgggaaacggaggcggcgcgagacgaaggagggtcgccgagggagctcgacacggcagcgggatcgtcgattccttcccgcgagatccgtcgtgggctacgcgcacaccctcaacgcccctgccatgcccgccgccggcctcggggtctcacctgagccgagaaggagagagacagagagatacacacagagagagaaagagggacgacatagcccgctggccgcctcgcctcctcaccgcgcgcgccgcgtgcagcgccgccgcgccctccccgtggaggactcgtctcccgctgcctgcctgagctgagaaggaaagagacacagagagcgagagagggagggacgacctagcccgcctcctccaacgccttcctcggcgccggcgccgcgccatcctcgcactctgctgtcgacccccgcacgccgaccacccgcctgctccaggtgcgtcgtcgtcgccgccgcccactgcctatccacgtgcgctggagagagagagagagagggggggtagaggggaaaaggggtaatgacatgtgggccatatttttttaatttctttttctgattggatttccacgtcggcgccacgtatatgccacgtaggataaaaactgctcaggattgtatggggggtaattcgttcggtatcaatagttcgaggtttaatatgtccggttttgtggtttaggggagtaattcgtaccgtcgcaatagtttagagggtaattcgtactttttccttttagtgatgaaattttcatgacatcataaaaatttccgcccaaacaagccatcatataaatttacatacccaagattttgactgcttatctttattctcttgtacagtgcttgctgccaccatcaagttcatcattatcaggaccaacaagatcaacaaaggtaattctgctagtctgtgagctgctgaagccatttgatgagcaaccctgtaatttggttgaacaaagtaaattcacaagataatgacagcatgtatatatatttgctgatcagttagtggaaactaatagaattgaattgactaaagagcatactgattttttaaatgataatactgacataactattgcaataagagaagttaaatatagctggttatgaggtctccaaacaacagaagaaataccagaggtttaatttaccttgctccatgcttcaatgacacaagtgaatattatatgagaacgtgaacttttcaagttcatactggtggtgccaacttttctgtttggaaggccctgtaagaaaaacaagctcagacaagctatcaataacgcttgagcaatggtaggcttcaattcagattttaatctctatagaggagaaggcagtgactcagttattagaaggacaacatgaaacaaatagtttcgaaagagcatgatacaagtagtaatatatgcgatcttaacaaaaatacagcttgttatcaagacaaaggtctttgtgactacagggtagatcaagcagaggtcctggttgtgatcctcatccatgcagaggtgaaattgaaaagcaaagaaaccctagttttaaaagcaaaaccgaaaggacaatttctttctgctactcttattgatcaaaattgtcccactgatgtgcctatagaggaaaaaaaaattttcgggctggttttgttggattactccgtgccataaaaggataaagaagattttctgaacaacttgacaaatgccttgctatgtttgctttatttatttattgttttgcgaactctccttgctattttctgacagaaacttgcagattagtgcagccacttcctgaccaaagctgtaaagcatcactggctacaaagtacactgacaatgcaatgaattgaaggtcattttgattataccttcatcaagatctgattgacgtcctcaaccgttgactcatactcatcggtcaagttctcaacatggacaccattgcaagcattctctcttatctagaataatggagctgaataagtttaatgcaatccattagcaaacaccatatacaggattagaatatacctaaagttacgctgagatggatccaacaggtcattaatctactcattatatacctggaaagcattgagcaaaatttgcatcatgtcagatatagaaaccttgttaaattaactaaattcagaaaaaaaattcacatctagatgcacttttcagttcaattaagaacacgcagatgagtcagtactcagtactcacctcaagaaacgagcactggcattggtagcttgtctgcttctccggtgagatttctcgcctctgtaccaggaataaacagaattgtgattatatggaacaactagaattttagaattttcaggatataccacccaatacgcactgttttccggatttatcacccaattcacactactttcagaatacactactggagtgtgaattttcttcattccgggccactctgtctaaccaaagctacacatcgtcagttcatcccactcgcgccgttgcccacacgcatctggccgccggcgagctcgtcctctctcacaccggcgagctcctcctcccccacgcgcgcgctgtttggctgtcggcgagctcgtcctccccacaccagcaaagctcctcctcctccatgcggacggcgccatatatgcgcgcggacggcacgaagtagcagcacgagggtgacctctggcgagctcgctcgtatcgtccccaagctcaaccgctgccgcaccgggctgctgccaccacgccccgagccatcgccggtccaatctccgccaccgcagcctcgagctcgtatagagctttgccaccggagctcgacgccctctggcctctgccctccaccgctgctcccttctcctccggcccaccaccacgtacgccaatgacggcgacgaaccagcgacggcgcggctgacgcgggcggcgatggacgggcaatggcgaggctgacgcgacggacgggcgacggcgcggttaacgcaagcgcgagcggtggcggactgatgacggtggcgccgggaggacggaggatgatggtgtgactgacgctaggggatggagtggcccggaacgaagaaaattcacactccattggtatattctaaaagtagtgtaaattgggtgataaatcctgaaagcagtgcgtactaggtggtataatctgaaaattctcatggaacaacaggtttaatcaaatttctcccttaagccttggatttgagcaacgagattctggaattcgtaggatttgtgcaagagcatgcagaattgcaggaagcttagattcaacccgaactcacaacggtgggccgcgttgaggacggtggaggcggcagacgctgccaactgccaactgccaaggcagggggctatggcgacgtggcgaggagtcctcgattccgtgcggcgcgcatggctcctcctccacatccgccggcgcacagctcctccttggtgttcgccagcgagcacggctccacctgccatccctgtcgtctccgccacgtttggctccgcgccacgccgcgcccacgatgccggagggaaggagagagagtttagtactactccatatgacatgtggggcccatgttaatttttaattttttattttttattggattgccacgttagcgctacatgtataccatgtaggacaaaactgttccgatctgccacgtgtacatatataccatgtaggacaaaaccattccgatctgccacgtgtacacgtaggatgaaaaccattctatattgagtagggggtaattcgtccggttttaaaagtggttttaaaagtttagggtgtgaaatatctggtcaaaccgtcgggatccaaaaaacacgtatcgacgaaacaaagtgcatctaaagcactcctctctcaactaagtgcacctaaagcactcctctctcaactaacgaactatgattgaaacctcgaagtaatccctctcaactaacaaactatgattgaaaccttgaagtaaaccctaactttttttcttcgtctcaacccctcatctatttatataaaaacttgtaaaacttttattaacaataggactcaatcccttaatttccaaacctatacattttccgaaactacagccggactgcttataaaccaatcaaactcctgcgcgaaaccgactgcccgtcgatctccgtttcctgtcaacacacgtgcgcctcctctactgaagcttcacgcatgggccatctcctccacgcgctgacccttcttccaatgggccagcaaatcaccaagcaggccgtcgctcgtctgggcctcctcctgggtcggttgttccagcacaagccgacgccaacacaacagtatagcacacgcaagtacgcagcacatgcatgcaacgagacatgcatatgcaccacgctacagtaccatgagtactgtagcaaccatatactccgaatttcctcaaccaatttccttcgcgaacaccgacacttgcatgcacacctcgtgaagcctattacgaagatttctcccacacgatgtccatccaccgtatactatatcgtatccaacttcgttattcggtatccttgaccgtctggacctcaactcctccctgagtttagtcctgatccccaccgttgaccaaagttgatcgacctctaagaatcctgactctagtcaccttctcatatggtattccgaccgcactagacctctactcctctctgagcatagtcccggtcctcaccattgaccaaggctgacctcaagtcacgtgcacataatcagataaaacaatcgtttctgggtacagatatcacaacctgacccacattagtcacacgcactcacaccaacatccacacatcttttcaaaatcaattcattgattaaatcatttgtaaagccaatttattcatcataaaatattaaacatgacaatgatttcacaatctcccccttgatgaacatattggcaacatcaccaaaatgcaattttgtatttttgaaaaataaaaacaaaaatcacaaaagtgaaaagaaaaactctccccctttttaaaagaaagaatttctcccatcaatttataatcaaagcacaaaatcgactatttttacaatcaaaacaattcaattctccccctttcaaaaagcattcattttgcatatttctccccctttgacaatgatttcatcaagaatgcaaaagaaaaaaaataataaacaataaagtacaaatgcaatgatgtcatgattgtcacttgaaataaccaattttttcttttctattttctaatttttttcgagagctttgaagtgcaccaaaagcaatccatgatcgtgtgttgcaagacaaagaagataaattaattagccagttagcaagcatgcatcataatataaacatgaatcaaagatattacaattaagcttaaattagcaataaggattcataatttcaaatgatttataatgcaatatattcacaagcacatagattgaaaaataaacactatacatatatacctattacatttatcactctttctcaaattaactttagtacaaaacaatcaagagaatttttaaacttttttttgagcctttttgctcactttttttctctcaattattccgggtatgtccttgtcgtcaagactgtttccaaggattcggcactcattatttttgctcacatcgaatatgtatttatcgtcatgactatttccaaggattcggtattctttttttttctttcatagatattttttattctcttgcacaatgagcaaataaaagctatttgaggaataacaattcaataaagcatatacataagcatttataaatcaatccatatgctatcatcaatattgcatattttattaattcaagtaaaagaattagtatcatgcatcatctcacttaaaagcaatatctaagccttatataaagactaaaacgcatacaagctaacattgcaacaaatatacctcaattattttgctagcatgcacaagaatatactagaggtataaaacaaagctcttcttttttttatttttatttattttcagaattaaaagcaatgcataaaaataaacatgaatgcacgaaaaagcataaactccacctcaaattaacctctaattctccccgaagaaaaatcaagaagaaatcaaagattttgaaaaagacatccaattgccaatgatatcaccaaggttctcatgaattgacatgtatccacttgtattaacaaaaactactatctcaaacactagcatatgaaaacctaataatcaagaaagtagaacaaaattatgtcaatccaaaattatcttgatattaccttgaaaagcactcaccatctcaacgttgaacgcacatagggagtatgccaccaaaatacctacgaacaagaaaatgtcgaggcctccatgttggggttagaaataaaaaattttggaatccaacactgagtcacacgaccagtagaaccaataggtacatatgcactaacaaaatcagaactaaacttacctgaaaacttaccttgtcgtttcacaaaagtccgatttgaattacgtgcaaaatcgcccggaagccggtttgaccaccgttgtccctgcggtctgaccgggcctggcatctagtctgaccaccggttcaactgcgatctgaccgctggccggtctgaccgactagtcagtgtcggtctaaccgtgctcctcgaaccaaaacccgatttttgccatcgtcgttttgcaaaagcaatttctctttcctttttctgtttacgggcaagtcgaaaacaaaaactaaccaaatgtgcatcttttccacaaaaagaacaaatataattctcacaacaagtttgtaaagtagatggttttgaaagatttgtttttgtttcttttaaagttctagaaagagagggcaaaattccagcagacttaaaaactgttttcttagcacttggttttctcaaaatttcaccatgttcagtcacactcaaaacattgggatgatttttggtgaaatagttatgaacatcaaaaccaacacccctattgtaactagtcaccttagattgatccaaaatcatgttgagctgtttcttaccatcagaaaatctttgcaaagaacttttcaaataagaaacttctttttccaaattagcacaattttcacaatctaccattatacttttgcttttacaacatttggggcaagaaagcacttcatcagatttcacaatattttccatatgctcaaccagtcctaaaacatctttcaatttcatctcattcaaaaaacactttgaacaattttgaga
